US011607443B2

(12) United States Patent
Combier et al.

(10) Patent No.: US 11,607,443 B2
(45) Date of Patent: Mar. 21, 2023

(54) THERAPEUTIC PEPTIDES

(71) Applicants: UNIVERSITE TOULOUSE III-PAUL SABATIER, Toulouse (FR); CENTRE NATIONAL DE LA RECHERCHE SCIENTIFIQUE, Paris (FR); INSERM (INSTITUT NATIONAL DE LA SANTE ET DE LA RECHERCHE MEDICALE), Paris (FR); ETABLISSEMENT FRANÇAIS DU SANG, La Plaine Saint Denis (FR)

(72) Inventors: Jean-Philippe Combier, Castanet Tolosan (FR); Anne Prel, Toulouse (FR); Frédéric Deschaseaux, Toulouse (FR)

(73) Assignees: UNIVERSITE TOULOUSE III-PAUL SABATIER, Toulouse (FR); CENTRE NATIONAL DE LA RECHERCHE SCIENTIFIQUE, Paris (FR); INSERM (INSTITUT NATIONAL DE LA SANTE ET DE LA RECHERCHE MEDICALE), Paris (FR); ETABLISSEMENT FRANÇAIS DU SANG, La Plaine Saint Denis (FR)

( * ) Notice: Subject to any disclaimer, the term of this patent is extended or adjusted under 35 U.S.C. 154(b) by 143 days.

(21) Appl. No.: 16/481,111

(22) PCT Filed: Dec. 22, 2017

(86) PCT No.: PCT/FR2017/000259
§ 371 (c)(1),
(2) Date: Jul. 26, 2019

(87) PCT Pub. No.: WO2018/115602
PCT Pub. Date: Jun. 28, 2018

(65) Prior Publication Data
US 2020/0000878 A1    Jan. 2, 2020

(30) Foreign Application Priority Data

Dec. 22, 2016 (FR) ..................... 16/63245

(51) Int. Cl.
| | | |
|---|---|---|
| *A61K 38/17* | (2006.01) | |
| *A61P 9/10* | (2006.01) | |
| *A61P 31/14* | (2006.01) | |
| *A61P 11/00* | (2006.01) | |
| *A61P 19/08* | (2006.01) | |
| *A61P 35/00* | (2006.01) | |
| *C12Q 1/6883* | (2018.01) | |

(52) U.S. Cl.
CPC ............ *A61K 38/1709* (2013.01); *A61P 9/10* (2018.01); *A61P 11/00* (2018.01); *A61P 19/08* (2018.01); *A61P 31/14* (2018.01); *A61P 35/00* (2018.01); *C12Q 1/6883* (2013.01); *C12Q 2600/178* (2013.01)

(58) Field of Classification Search
None
See application file for complete search history.

(56) References Cited

U.S. PATENT DOCUMENTS 5,403,824 A * 4/1995 D'Souza ............... A61K 31/00
514/16.9

FOREIGN PATENT DOCUMENTS

| WO | WO 2004/083241 | * | 9/2004 |
| WO | 2015/063431 A1 | | 5/2015 |
| WO | WO 2015/063431 | * | 5/2015 |

OTHER PUBLICATIONS

Couzigou et al. (RNA Biol. Nov. 2015; 12(11): 1178-1180) (Year: 2015).*
Preliminary Research Report dated Aug. 1, 2017 in corresponding French application No. 1663245; 6 pages.
International Search Report and Written Opinion of the International Searching Authority dated Apr. 18, 2018 in corresponding International application No. PCT/FR2017/000259; 32 pages.
Database EMBI, "Human DNA sequence from clone RP11-2B6 on chromosome 9q22.2-31.1", Database accession No. AL158152; 22 pages.
Nelson et al., "A peptide encoded by a transcript annotated as long noncoding RNA enhances SERCA activity in muscle", Science, Jan. 2016, p. 271-275; 6 pages.
Anderson et al., "A Micropeptide Encoded by a Putative Long Noncoding RNA Regulates Muscle Performance", CELL, Feb. 2015, p. 595-606; 14 pages.
Kim et al., "Long noncoding RNAs in diseases of aging", Biochimica Et Biophysica Acta. Gene Regulatory Mechanisms, Jul. 2015, p. 209-221; 14 pages.
Makarewich et al., "Mining for Micropeptides", Trends in Cell Biology, May 2017, p. 1-12; 12 pages.
Andrews et al. "Emerging evidence for functional peptides encoded by short open reading frames", Nature Reviews Genetics, Feb. 2014, p. 193-204; 12 pages.
Tonkin et al., One Small Step for Muscle: A New Micropeptide Regulates Performance, Cell Metabolism, Apr. 2015, p. 515-516; 2 pages.
Dhgushi et al., "Marrow cell induced osteogenesis in porous hydroxyapatite and tricalcium phosphate: A comparative histomorphometric study of ectopic bone formation", Journal of Biomedical Materials Research, 1990, p. 1563-1570; 8 pages.
Wang et al., "Bone tissue engineering via human induced pluripotent, umbilical cord and bone marrow mesenchymal stem cells in rat cranium", Acta Biomaterialia, 2015, p. 236-248; 14 pages.

(Continued)

*Primary Examiner* — Sergio Coffa
(74) *Attorney, Agent, or Firm* — Maier & Maier, PLLC

(57) ABSTRACT

Compositions containing micropeptides capable of modulating the accumulation of miRs involved in certain pathologies, and the use of these micropeptides for treating the certain pathologies. Also, methods of identifying these micropeptides modulating the accumulation of miRs involved in pathologies. Further, nuclei acids encoding those micropeptides that modulate the accumulation of miRs involved in pathologies.

9 Claims, 380 Drawing Sheets
Specification includes a Sequence Listing.

(56) References Cited

OTHER PUBLICATIONS

Mok et al., "microRNAs in skeletal muscle development", Seminars in Cell & Developmental Biology, 2017, p. 67-76; 10 pages.
Alexander et al., "Skeletal Muscle MicroRNAs: Their Diagnostic and Therapeutic Potential in Human Muscle Diseases", Journal of Neuromuscular Diseases, 2015, p. 1-11; 12 pages.
Chiellini et al., "Stathmin-like 2, a developmentally-associated neuronal marker, is expressed and modulated during osteogenesis of human mesenchymal stem cells", Biochemical and Biophysical Research Communications, 2008, p. 64-68; 5 pages.
Cordonnier et al., "Consistent Osteoblastic Differentiation of Human Mesenchymal Stem Cells with Bone Morphogenetic Protein 4 and Low Serum", Tissue Engineering, 2011, p. 249-259; 12 pages.
Esquela-Kerscher et al., "The let-7 microRNA reduces tumor growth in mouse models of lung cancer", Cell Cycle, 2008, p. 759-764; 7 pages.
Guttman et al., "Modular regulatory principles of large non-coding RNAs", Nature, 2012, p. 339-346; 8 pages.
Ingolia et al., "Ribosome Profiling of Mouse Embryonic Stem Cells Reveals the Complexity and Dynamics of Mammalian Proteomes", Cell, 2011, p. 789-802; 14 pages.
Lauressergues et al., "Primary transcripts of microRNAs encode regulatory peptides", Nature, 2015, p. 90-104; 15 pages.
Li et al., "MicroRNA-7a/b Protects against Cardiac Myocyte Injury in Ischemia/Reperfusion by Targeting Poly(ADP-Ribose) Polymerase", PLoS One, 2014, p. 1-9; 9 pages.
Montgomery et al., "MicroRNA mimicry blocks pulmonary fibrosis", EMBO Molecular Medicine, 2014, p. 1347-1356; 10 pages.
Mukherjee et al., "Transcriptional Suppression of miR-181c by Hepatitis C Virus Enhances Homeobox A1 Expression", Journal of Virology, 2014, p. 7929-7940; 12 pages.
International Preliminary Report on Patentability (Chapter 1) dated Jun. 25, 2019, in corresponding International application No. PCT/FR2017/000259; 9 pages.

\* cited by examiner

Figure 1

| miR | order | mPEP | mPEP SEQ ID | miORF | miORF SEQ ID |
|---|---|---|---|---|---|
| hsa-let-7a-1 | 1 | MADAAASAGPSPFYFAETRGSGWAEWESRAPARACPANAGWDWWGGLPPPAGGWPRGAGGLLAEVAGARGTGEGCRVAAAGPAPTPSASRPAPHRQGGGGGVILHPYPALPPASIKLGAGGRPAFRPAPVGRRRL* | 1 | ATGGCGGACGCGGCAGCGAGCGGGTCCGTCGCAGCCATTTTATTCGCGGAGACTCGCGGCAGCGGGTGGCAGAATGGAGAGCGGTGCCGCCGTCTCCGGCTAACGCGGGCTGGGACTGTGGAGCCGGCTGCCCCTCCAGCGGGCGGTGCCCGGGGGCCGTGCGGCTGCTAGCGAGAAGTCGCGGGGCTCGGGGCACGGCGGAGGGTGCCGGTGCCCCGCGCCGGGGGCCGCTCCAACCCCTCCGCTTCCGCGCCAGCTCTCACCGACAGGGCGGGGAGGGGGGTCATTCTTCACATTCCTACCCCGCCCTTCCCCCGGCTTCAATCAAACTTGGGGCGGGGGCGGAAGGCCCGCCCTTCCGGCCGGCCGCTGTTGGCCGGCGCCGCCTCTGA | 2 |
| | 2 | MGEPCAGPRLSG* | 3 | ATGGGAGAGCCGTGCGCCGGCCCCGCGCCTGTCCGGCTAA | 4 |
| | 3 | MKEGR* | 5 | ATGAAGGAGGGAAGTAG | 6 |
| | 4 | MPLLPAAKCSLPS* | 7 | ATGCCTCTGCTCCCCGCGGCCAAGTGCAGCCTCCCTTCCTGA | 8 |
| hsa-let-7a-2 | 1 | MRETIRKTEKL* | 9 | ATGAGAGAACGATCAGAAAACTGAAAGCTGTAG | 10 |
| | 2 | MSPWIQCSSPQGIKTQINFPFCKQLHCEEAFH* | 11 | ATGTCACCATGGATTCAGTGTTCAAGTCCACAGCCAGGCAAAACTCAATAAATATTTCCTTTTGCAAGTCCACTGTGCACTGTGCCTTCCATTAG | 12 |
| | 3 | MDSYFKSTARQNSNKFSFLQAAAL* | 13 | ATGGATTCAGTGTTCAAGTCCACAGCCAGGCAAAACTCAAATAAATTTTCCTTTTGCAAGCAGCTGCACTGTGA | 14 |
| | 4 | MKGRRTPRPKHGQ* | 15 | ATGAAGGAAGGCGAACCCCGGTCAAAACATGGCAATGA | 16 |
| hsa-let-7c | 1 | MYKYIHLGFLIFFISVAPGVQVVIGYMDELYSGEV* | 17 | ATGTATAAGTACATACATTTGGGGTTTTTAATTTTATTCAGTAGCTTTGGGTACAAGTTGGTTATTGGTACATGGAGATGAATTGTATAGTGGTGAAGTCTGA | 18 |
| | 2 | MNCLVVKSEILVHSSPT* | 19 | ATGAATTGTATAGTGGTGAAGTCTGAGATTTAGTGCACTGTCACCTACCTGA | 20 |
| | 3 | MLSSV* | 21 | ATGCTTTCAAGTGTCTAA | 22 |
| | 4 | MKRKFFDRFYDNSFFFSS* | 23 | ATGAAGAGAAAATTTGATCGCTTTTATGATAATAGTTTTTTTTCTCTTCCTAA | 24 |
| hsa-let-7d | 1 | MADAAASAGPSPFYFAETRGSGWAEWESRAPARACPANAGWDWWGGLPPPAGGWPRGAGGLLAEVAGARGTGEGCRVAAAGPAPTPSASRPAPHRQGGGGGVILHPYPALPPASIKLGAGGRPAFRPAPVGRRRL* | 25 | ATGGCGGACGCGGCAGCGAGCGGGTCCGGTCCGTCGCCATTTTATTCGCGGAGACTCGCGGCAGCGGGTGGGCAGAATGGGAGAGCGGTGCCGCCGTCCGGCTAACGCGGGCTGTGGGACTGTGGCCGCTGCCCCTCCAGCGGGCGGTGCCCGGGGCCGTGCGGCTGCTAGCGGAAGTCGCGGGGGCTCGGGCACGGGGGAGGGGTGCCGGTGCCCCCGCGCCCAACCCCTCGCTTCCGCTTCCGCCCAGCTCTCACCGACAGGCGGGGAGGGGGGTCATTCTTCACATTCCTACCCCGCCCTTCCCCCGCTTCAATCAAACTTGGGGCGGGGAAGGCCCGCCCTTCCGGCCGGCCGCTGTTGGCCGGCGCCGCCTCTGA | 26 |
| | 2 | MGEPCAGPRLSG* | 27 | ATGGGAGAGCCGTGCGCCGGCCCCGCGCCTGTCCGGCTAA | 28 |
| | 3 | MKEGR* | 29 | ATGAAGGAGGGAAGTAG | 30 |
| | 4 | MPLLPAAKCSLPS* | 31 | ATGCCCCTGCTCCCCGCGGCCAAGTGCAGCCTCCCTTCCTGA | 32 |

Figure 1 (Continued)

| | | | | |
|---|---|---|---|---|
| hsa-let-7e | 1 | MGHDTENAFQAEKEDUDRERAKGRTDVQRQKGGQTER DTERQQKQPRMTGAERRRERGRERERERREGGREG ERERESTHRARRRRREEGGRPARDRTGRRGGGELGKA GEERDWPRRRAGERERPRRLPASFVPSLLCVRLLWPG LPLPLPPPPRGWMEFFPLDLGQLRGRGEARPDWAGRW GGRAGGPLORGLVRRPRSRRGPGRGSPGPQSRGGGD GRRESGRREGGWRGRREEGERPPCGEGGERMESARRR WGPACCPGAAEKTPSLRRGSRGSRESAFREGGGLGPAL LGP* | 33 | ATGGGAGACACAGATAATGCCCACAGGCAGAGACCAGGAAAGAGGGAGATGAGATAGGAGA GGGCGAAGGAGAGCAGATGTCAGAGACAGGAGGACAGACGGAAAGAGA CACAGAGAGAGTCAGCAGAAGAGAAGCAACAAGAATGACAGTAGCAGAGGAGAAGAGA AGAGGGAGAGAGCGAGAGAGCACTGCACAGAGGCGAGGAGGAGGCGCAGAGAGAGAAGAG GAGAGAGAGCGAGGCCAGCAGGACAGACTGGCCGAGAGACTGGCGGAGGAGAGCTAGGG AAAGCCGGGAGGAGGAGCGAGACTCCCGGCCTCTTTGTCCCTCTCCCTCCCGGGCTGGATGGAATTTTTCCC GGCCCGGCCTCCCCCCCGGCCTCCCGCTCCCGCCCGGGCTGGATGGAATTTTTCCC CTGGACCTGGGCCAGCTCCGGGCCAGTGGGGGGAAGCCAGGCCGGACTGGGCTGGGC GGGGGAGGGGCGGGGTCCAGGGAGGGAGCTCCTCGGAGAGGATCGGGGAGGGACGGCGGG GCGCAGCCGGCGGCGGAGTCCGCGCCGGGCGCCCGGAGTCGGGGAGGGGCGGGACCCGCC GGTGACGGCGGAGGGGCGGAGTGAGAGAAGGGAAGGAGGATGGGCGGGAGACGGCGCGG AGGAAGGGATGGGGAGGGCGCTGGCCGCGCCGGGCGCGCCGGAGAAGACCCTTCCCTGC GACGGCGGAGCGGCGGAGCCGGAGTCTGCGAGTGCGAAGGGAGGGTTGGGGGCTGGG GCCGGCACTCGGTCCCTGA | 34 |
| | 2 | MPHRQRKRMEIGRGRKEGQMCRDRREDRRKETQRGSK SNQE* | 35 | ATGCCCCACAGCAGACAGAAGAGAGGATGGAGATAGGGAGGAGGGCGAAAGGAAGGAC AGATGTCAGAGACAGAAGGGAGGACAGACGGAAAAGAGACACAGAGAGGCAGCAA AAGCAACCAAGAATGA | 36 |
| | 3 | MAGTAGGRGEAAVRRRGEDGERSAAVGPGLRARGG GEDPFFATREPREP* | 37 | ATGGCGGGAGGCGCTCGGGGAGAAGGGAGAGGCCGCGTGCGCGAAGGCGGGAG AGGATGGGAGGCGCTCGGCGCGCGGACGGGCGGCGCGCTGCGGCCCCGGAGCCGTGA AGAAGACCCTTCGGCGCTGGGCTGGTAGATGTGCTGGAAGAGACTAG | 38 |
| | 4 | MGAGAGRIVAGRD* | 39 | ATGGGGCTGGGCTGGTAGATGTGCTGGAAGAGACTAG | 40 |
| hsa-let-7f-1 | 1 | MADAASSAGPSPFYAETRGSGWAEWESRAPAKACPA NAGWDWWGGLPPPAGGWPRGAGGLLAEYAGARGTGE GCRVAAAGPAPTPSASRPAPHRQGGGGVLLHPYPALP PASIKLGAGGRPAFRPAPVGRRRL* | 41 | ATGGCCGGACGCGGCAGCGAGCGCGGCGGTCCGTCGCGCCATTTTATTTCGCGGAGACTCG CCGCAGCGGCGGTGGGCAGCAAGGGAGAGCCGTGGGCGGCGGCTCTTCGGGTACGGGCCA ACGCGGGCTGGCCGCCGGGCGCGGCTCAGGGAAGTGCAGCGCCCCGGCGCTTCCGCCCCGCCAGCTCCTC GCCGTGGCCGCCGCGGAGCCGCGCGCCTCCAACCCCCTCCGCGGGCACGGGAGGGT ACCGACAGGGCGGGGAGGGGGTCAATTCAAACTTGGGGGGCGAAGGCCCGCTTCCGGCCGGCCTTCCC GCCGGCGCGCGCTGA | 42 |
| | 2 | MGEPCAGPRLSG* | 43 | ATGGGAGAGCCGTGCGCGGCCGGCCGTCCGGCTAA | 44 |
| | 3 | MKEGR* | 45 | ATGAAGGAGGGAAGGTAG | 46 |
| | 4 | MPLLPAAKCSLFS* | 47 | ATGCCCCTGCTCCCGGCCGGGCAGCTGCAGCCTCCCTTCCTGA | 48 |
| hsa-let-7i | 1 | MYKYIHILGFLIFFISVAFGVQVVIGYMDELYSGEV* | 49 | ATGTATAAGTACATACATCAGTTTTGGCGTTTTTTAATTTATTCAGTAGCTTTG GGGTACAAGTGGTTATTGGTTACATGGATGAATTGTATAGTGGTGAAGTCTGA | 50 |
| | 2 | MNCIVVKSEILVHSSPT* | 51 | ATGAATTGTATATGTGGTGAAGTCTGAGATTTTAGTGCACTCGTCACTTACCTGA | 52 |
| | 3 | MLSSV* | 53 | ATGCTTTCAAGTGTCTAA | 54 |
| | 4 | MKRKFDRFYDNSFFFSS* | 55 | ATGAAGAGAAACATCAGAAAATGCTTATGATATAGTTTTTTCTTCCTAA | 56 |
| hsa-mir-100 | 1 | MRETIR&TEKL* | 57 | ATGAGAGAAACGATCAGAAAACTGAAAAGCTGTAG | 58 |
| | 2 | MSPWFQCSSPQPGKTQNFPCKQLHCEFAFH* | 59 | ATGTCACCATGGTTCAGTGTTCAAGTCCACAGCCACGGCAAAACTCAAATAAATTTT CCTTTTGCAAGGATTCAGTGTTCAAGTCCACTGTGAGTGCGCTTCCATTAG | 60 |
| | 3 | MDSVFKSTARQNSMKFSFLQAAAL* | 61 | ATGGATTCAGTGTTCAAGTCCACAGCCAGGCAAAACTCAAATAAATTTCCTTTTG CAAGCAGCTGCACTGTGA | 62 |
| | 4 | MKGRRFPRPKHGQ* | 63 | ATGAAGCGAACGCGAACCCCGCGTCCAAACATGGCAATGA | 64 |

Figure 1 (Continued)

| | | | | | |
|---|---|---|---|---|---|
| hsa-mir-101-1 | 1 | MRVCFFY* | 65 | ATGAGAGTCTGTTCTTTATTAG | 66 |
| | 2 | MSVPSPPPPRQVVICRCFGIFSSLWTCPPPTSK* | 67 | ATGTCTGTCCCAGCCCCTTTCCCCCCGGCAAGTTGTGATCTGCAGATGTTTGGG ATTTTCTCTTCCCTGGACCTGTCCCCGCCCCACCAACCAGCAAATAG | 68 |
| | 3 | MFWDELFPLDLSPTNQQIAPGPRLREREK* | 69 | ATGTTTTGGGATTTCTCTTCCCTGGACCTGTCCCCACCAACCAGCAAATAGCTC CTGGGCCTAGGTTGAGGGAGAGAAGTGA | 70 |
| | 4 | MESAVPP* | 71 | ATGGAATCTGCTGTCCCCGTAG | 72 |
| hsa-mir-103-1 | 1 | MKSAASSRGGGGGGGRGGGGWGSWWGGGRGGGCGAGK GGGGDGGOGGKGGFGARARGFGGGRGRGRGGDG KDRGGGGQORRGGVAKSKSRRRKGAMVVSVEPHRHEG GGCTTCGGCGGCGCGGCCCGGGGGCCGGGGCGCGGCGGCGACGGCAAGGATC GCGGCGGCGGTGGACAGCGGCGCGGGCGGCTGGGGCCAAGAGCAAGAGCCGCCCAG GAAGGGCGCCATGGTGGTCGTGGGGGCGTCCGAGCCGCAGCCGGCAGCACTGGTGCCGGTCTTCATCT ACCGCGGCGGAGGACGCCGTCACCGTGACAGCGGAACCGCTGAACATTGGTCCGGCCAGTCTGTG VFTYRGAEDALVTLNMVPGQSYYGERRVTVTEGGVRKQ TACGGCGAGGCGGAGGACGCGGCTGGAACATTGGTCCCGGCCAGTCTGTG EYRTWNPFRSKLAAAILGGVDQIHKPKSKVLYLGAASG GTGAACCCGTTCTCGTCCTTAAGCTGGCCGCGGCGATCCTGGGCGGGTGGACCAG TVSHVSDHGPDGLYVAVEFSHRAGRDLYNVAKKRTNI TCCACATCAAGCCAAGTCAAAGTCCTGTACCTGGGCGCCGCCAGTGGCACCACCG BPVLEDARHPLKYRMLIGMVDVIFADVAQPDQSRIVALN TCTCCCCATGTCTCCGACATCATTGGCCCAGACGGCCTGTCCAGCGTCGAGTCT AHTFLRNGGHFLJSIKANCJDSTASAEAVFASEVRKLQQ CCACGGCCGGCCTGGAGACGCCGGGCACCATCGGCCGTCGAGCGCCAATGCT ENLKPQEQLTLEPYERDHAVVGVYRPLPKSSSSSK* GACTCCACCGCCATCCGGCGCGAGGGTGTGTTGCTTGAGGGGAGTTGCAG | 73 | ATGAAGTCGGCCGCCGAGTCTCGCGGGGGCGGTGGGGGCGGCCGGGGGGCCG GCTGGGGCAGCTGGGGGTCGGGGGCGTCGAGCCGTGGGCAGCAAGGGCCGG GCGGCGGCGACGGCGGCGGCGAGCGGCGCTTCGGGCGCGGCGGCGCGC GGCTTCGGCGGCGCGGCCCGGGGGCCGGGGCGCGGCGGCGACGGCAAGGATC GCGGCGGCGGTGGACAGCGGCGCGGGCGGCTGGGGCCAAGAGCAAGAGCCGCCCAG GAAGGGCGCCATGGTGGTCGTGAGCGTGGAGCCGCACCGGCACGAGGGCGTCTTCATCT ACCGCGGCGGAGGACGCCGTCACCGTGACAGCGGAACCGCTGAACATTGGTCCGGCCAGTCTGTG TACGGCGAGGCGGAGGACGCGGCTGGAACATTGGTCCCGGCCAGTCTGTG GTGAACCCGTTCTCGTCCTTAAGCTGGCCGCGGCGATCCTGGGCGGGTGGACCAG TCCACATCAAGCCAAGTCAAAGTCCTGTACCTGGGCGCCGCCAGTGGCACCACCG TCTCCCCATGTCTCCGACATCATTGGCCCAGACGGCCTGTCCAGCGTCGAGTCT CCACGGCCGGCCTGGAGACGCCGGGCACCATCGGCCGTCGAGCGCCAATGCT GACTCCACCGCCATCCGGCGCGAGGGTGTGTTGCTTGAGGGGAGTTGCAG CAGGAGAACTTGAAGCCTCAAGAGCAGCAGCTTGACCTGGAGCCTATGAGCGGAGACCA CGCTGTGGTGGGTCGGGGTCTACAGACCGCTTCCCAAGAGCAGCAGCAAATAG | 74 |
| | 2 | MSPTSLAQTAWSTPSSSPTAPAAIWSTWPPRSAPTSFRSW RTRGTRSSTACSSGWWT* | 75 | ATGTCTCCGACACATTGGCCCAGACTGCCTGGTCTACGCCGTCGAGTTCTCCACC GCGCCGCCGGATCTGGTCAAGTGCCAAGAAGCCACCAACATCATTCCGGTC CTGGAGGACGCGCCACCGCTCAAGTACCGCATGCTCATCGGGATGGTGGACGT GA | 76 |
| | 3 | MGATFSSRPTASTPPHPPRLCLLLR* | 77 | ATGGGGGCCACTTTCTCATCTCAAGCCATGCAACTGCATCGACTCCACCGCATCCG CCGAGGCTGTGTTGCTTCTGAGGTGA | 78 |
| | 4 | MSGTTLWWSGSTDLFPRAAANSTQLRLACHLPKAALCL LLFSVCFLCECPVLFFY* | 79 | ATGAGCGGGACCACGCTGTGGTGGTCGGGGTCTACGGACCTCTTCCCAAGAGCAGC AGCAAATAGCACCCAGCTCCGCCTGGCCATCCTCCCCAAGGCTGCTTGTGTTT GCTATTATTTCTGTGTTTCTTTGTGAGTGTTTGTTTCTATTAA | 80 |
| hsa-mir-103-2 | 1 | MATSGGQTERDSC* | 81 | ATGGCCACTAGTGGAGGCCAGAGTTTAGGGAGACTGAAAGGACAGTGCTAA | 82 |
| | 2 | MVTAEFMGTSQPEGGETAVSWDEDYGTAAQRSTNAER RQCLGAGAQR* | 83 | ATGGTAACAGCAGAGTTTATGGGCACTCTCACAACCTGAAGGTGGTGAGACGGCAGT AAGCTGGGATGAGGATGTGGGCACTGCTGCACAGAGATCAACAAATGCAGAGAA GGCAGTGTTGCAGTGGAGCTCAGAGGTAA | 84 |
| hsa-mir-103-2 | 3 | MRMWALLHRDQQMQREGSVSGLELRGKGWLKCSLEIS QKDANDCLGRPRTEAEDSHS* | 85 | ATGAGAATGTGGGCACTGCTGCACAGAGATCAACAAATGCAGAGAAGGCAGTGT CTGGGGCTGGAGCTCAGAGGTAAGGGTGGTGTTGAAGTGTTCCCTGAAATCAGTC AAGGTGATGCTAATGACTGCTTGGGAGACCCAGGACTGAGGCTGAGGACAGCCAC AGCTAA | 86 |
| | 4 | MLMTAWGDPGLRLRTATANCQQRMNQNISSLGGRTGK RALLSEN* | 87 | ATGCTAATGACTGCTTGGGGAGACCCAGGACTGAGGCTGAGGACAGCCACAGCTAA CTGTCAGCAGAGAATGAACCAGAACATTAGCTCAGGAGGCAGGACAAGA GGGCTCTGCTGAGTGAGAACTGA | 88 |

Figure 1 (Continued)

| | | | | |
|---|---|---|---|---|
| hsa-mir-106a | 1 | MKKGRKPTCAEDSRWRNDCCBRCIHR* | 89 | ATGAAAAAGGGAGGAAGCCACCTGTGCGACTGACTCGCGGTGAGAAATGATTG TGGTTTTCGTTGCATCCACCGGCTGA | 90 |
| | 2 | MIVVFVASTADS* | 91 | ATGATTGTTGTTTTCGTTGCATCACCGCTGACTCCTGA | 92 |
| | 3 | MAPLSSSGLWAATITLVTMVEREGSGFILHPFPPSLPPAC LPGLSSSDPACSLVSDL* | 93 | ATGGCGCCCTTGCTCTCTGGCTTTGGGCTGCCAACTACCCTGGTAACAATG GTGGAAAGGAGGGGTCCGGCTTCATTTGCACCCCTCCTCCTGCCCC GCTTGCCTTCCAGGCGTTTCCTCCTCCGACCCAGCTGGTGCTCACTGGTCTCTGATTTGT AA | 94 |
| | 4 | MLNSILIYRLKLRLHHFILQSAVGLWP* | 95 | ATGCTTAATTGCATTTGATTGTGCGTCTAAACTAAGACATCATTTATTCTACAGA GCGCTGTCGGGCTTTGGCCTTGA | 96 |
| hsa-mir-122 | 1 | MTGGC* | 97 | ATGACGGGAGGCTGCTGA | 98 |
| | 2 | MPPSA* | 99 | ATGCCACCAGCGCTGA | 100 |
| | 3 | MHLFPQKA* | 101 | ATGATTATTCTGTTTCCTCAGAAAGCTTGA | 102 |
| | 4 | MVSV* | 103 | ATGGTTTCCGTTTAA | 104 |
| hsa-mir-124-1 | 1 | MAIHWGIRFSFMLFP* | 105 | ATGGCTATTCACTGGGGCATCAGGTTTCTTTCATGCTATTCCTGA | 106 |
| | 2 | MVHMYGTYFTFEQQYLQSCECNN* | 107 | ATGGTACACATGTATGGCACTTACATTTCACTGAGCAGCAATACTTGCAAAGCTGT GAGTGCAATAACTAA | 108 |
| | 3 | MALTFSLSSSNTCKAVSAITKQIMVFSSGKGSEITYSTPLF HRRGF* | 109 | ATGGCACTTACATTTCTCACTGAGCAGCAATACTTGCAAAGCTGTGAGTGCAATAACT AAACAGATCATGGTGTTTCAAGCGGGATTACCGGAGCGCAATCACGTATTCAACCCCC TTGTTTCACAGAAGAGGATTCTGA | 110 |
| | 4 | MGEQ* | 111 | ATGGGTGAGCAGTGA | 112 |
| hsa-mir-124-2 | 1 | MKIFIPLPHSTRLQDSCFRSFSPVHDV* | 113 | ATGAAAATCTTCATCCCCCCTCCATTCTACTAGGCTACAAGATTCTGTTTCGTT CCTTCTCACCGGTTGGAAGATGTGTAA | 114 |
| | 2 | MCKIKDVEVCSDFFKSQLTTARTATRITRAHAGCKYBP FLR* | 115 | ATGTGTAAAATCAAAGATGTGAAAGATCCTCAAGCCAACTAACC ACGCACGGACTGCGACGCGGATTACCGGAGCGCAACGCTGTAAGTACCATCC TTCCTGCGGTAG | 116 |
| | 3 | MLESRRLSSGL* | 117 | ATGCTTGAGAGGCGCCGCCTCAGCTGCGGGCTGTAA | 118 |
| | 4 | MDGNQVTEIPKLARLSDTLGRQNGIGRRDLKRREEGIRV PPPRA* | 119 | ATGGATGGAAATCAGGTCACAGAATCCTAAGCTTGCCAGGCTCTCAGACACGCTT GGGAGACAGAATGGAATTGGAAGGAGGGATCTGAAGAGGAGGAGGAATCCGTG TTCCCCACCCCCGGGCCTAG | 120 |
| | 1 | MSIQLRHAVNAKRGASSAAPPSWKWPASPSGPAPLPREE GEPGPRRPFAPRTNPANNAPAQSAAQLPGRGSGRGTQR GPHASGVAGRVGAAEGKRGGSLRPGPGCGPAPGHVC PQRGAPRRPQRAAGPGRQREGPRGAAGGCVGRRARVR RCPRCWRRGGPRGTGRPSAALAPTAGALDSCHGNVG GGGAGSEVTAKSSALPRAAAPRGGAEAALAVAPEQPPQP RTRLAWGRGSASASRVQTRAVDTPDRIPPPKSPALGCAG PGT* | 121 | ATGTCTATACAATTAAGCACGGCGGTGAATGCCAAGAGAGGCGCCTCCGCCGCTCCT TTCTCATGGAAATGGCCGGCGTCCCCAAGCGGCCCTCCCCGGGAGGA AGGGCGAGCCCGGGCCCCAGAGTGCGGCCATTCGCGGGAACATCTGGCGAACAATG AGGGGGAGGCCGGGGAGCCTCGGCCTGCCGCAGGCTGCGCGCAGCCCGGCCACGTG GAGGGGAGCCGGCCAGCCCCAGCTGCGCCAAGGCGCGGGCGGCCCGGAGAGC TGCGCGCCGAGGGGTCCACGGAGGCGGCGCCCCGGACGGGAGGCGGG AAAGGAGGCTCGCGGGCGGGGACGCCCGCCCTGGACAGTTGCCACGCAACGT CCAAGTGCGGCCCGGCCAGGCTTGCATGGGCGACACGCGGGGTCTGCGTCGTCGT GGGAGGAGTGGGGCAGGGTGGGGTGGAGGTGACGCCTAAGTCGCCCCTTCCGGGCCG CTGCGCCAGGACCAGCCGGCGGAGCGTCCGGTGATGGACACGCGGGGTGTCGTCGTC AACGAGGGCCGGTGGACACGCCCATCCGCCCACCTAAGCTCGCCCTTCTGGGCGG GTGCAGGACCAGGCACGTGA | 122 |

Figure 1 (Continued)

| | | | |
|---|---|---|---|
| hsa-mir-124-3 | 2 | MPREAPPLLSHGNGNGPRARPAQRPSRGRKASPAPGGHS RRGQIRRTMRPPRVRPSCRAGDLAAGHKCARTPLASRG GWGRPRAAEGGACGRGQAAASRPPATCVRSAERPGAR RGBRGPGDKGRVHGERRAGAWGGGLGCGAVRGAGGG AAPAGREGGQVRPSPPQRAPWTVATATWEEVGQGLRS PLSLPFLGPLRRGAGRRRSLWPQSSPRSPGPLHGDGG LRPRPGSKRGRWTRRTASRPQSRLWAVQDQARETPQPR EKMTNPSPAAICSRSDTHSGLLQGFFFCPRKPAPPADAR HRLCAASPAFIPGPGWAVMPR* | 123 | ATGCCAAGAGAGGCGCCTCCGCGCCTCCTTCTCATGGAAATGCCCGCGAGCCGT CCGGCCCAGCGCCCTCCGCGGAGGAAGGCGAGCCCGGCCCCGGCGGCCATTC GCGCCGCGGGACAAATCGCGCCGAACAATGCGCCCGCCCAGAGTGCGCCCAGCTGCC GGCCCGCGGGGATCTGGCCGCGCGGGACACAAAGGCCCGAACACAAGGCCGACCTCGGCCGCCTCTGCGTGCGCG GGCGGTGGGGCTGCCGGCTCCGGCGCAGGGGAGCCTTGCGGCCGCGGGGCCAGG CTGCCGGTGGCCCAGGGGGCGTCGGGCGCCCGAGGGGACGGCGGTGTCCGCAGCAAAGGAGGTCCACGGAGACGCGCGG CGCAGAGGGCGGTCGGGACGGGAGAGGGCGCGCAAGTGCGGCGCCTCGGCCCCACAGCGCGCC GGGGCCCCGCGGCGGGGACAGTTGCCACGGCAACGTGGGAGGAGGTGGGGCAGGGTCTGAGGTCAC GGCCTAAGTCTGCCCTTCCTGCGCGCCCTGCCGCCCGGGGCGGGGCGGGGAGGCGGCGC GCTGTGTGCCCCAGACAGCAGCCCCAGGACCCAGGCTGCATGGGGACGG TTGCTCTGCCCCAAAGACAAATGACAAATCCTCCCGCCCATCTGCACGCCAGTGACACC GGGTCTGCGTCCAGGTCCAAACGAGGCGGTGGACACGGCAGCAGCCACTGCTCCGAG CCCAGGGAGAAAATGACAAATCCTCTGCAGGACCAGGGCGTCAATCGCCAT CACTCGGGTTTGCTGCAGGGGTTTTTCTGCGCCTCCTGCGCTTCTGCAATCGCCAGCCCCGGCTGG GACCCCGCGCACCGCGCTCTGCGCCTCGCGCTCTGTCCCCGACCGCCCATCCCAGCCTCCGGCTGG GCTGTGATGCCCGGTAA |
| | 3 | MEMAIREPVRPSAPPAGGRRARPPAAIRAADKSGEQCAR PECGPAAGPGIWPRDTKCPARLWRRGACGRGRPRG EPAAGARLRPAGPRPRVSAARSAQAPAEGGGARETKGG STGSGRVRGAAG* | 125 | ATGGAAATGCTGCCCGGCCGTCGAGCGCTCCGCGGCCCAGCCTCCGGAGGAAGGCG AGCCCGGCCCCGATTGCGGCCCAGCTGCCGGCGCGACAAATCCGGGAACAATGCGCC CCCGCAAGTGCGGCCGCCAGCTGCGCGGGAGCTCGCCGGGAGGGGTGGACGAGGGCGCG GGAGGCCTGGCACGCTCTGCGCCGGCGTTGCGCGGCCAGGCTGCGCGCGACAGGGCTGCAGG CCGCACGCCTGGGCGAGCGCCAGGCGCCCGCAGAGGGCGCGGAGGGCGCGGGACAAAGG GAGGGTCAGCGGGAGCGGCGCGTGGGGCGGTCGTTGCAGGCTAG |
| | 4 | MGTCVCVRYVQGPNEGGHAGPHPAPKAGSGLCRTRFV RLRSPGRK* | 127 | ATGGGGACGTGGGTTGCTGCGTCGCGCCTCAGGCCTCCCAAACGAGGCGGGTGACACGC CGGACCCGATCCGCCTCGCCCCAAAGCGGGCTCTGGGCGGTGTGCAGGACCAGGCACGTGA GAGCTCCGCAGCCCAGGCCCCAGGGAGAAAATGA |
| hsa-mir-125a | 1 | MGDTNAPQAEKEDGDREAKGCRTDVQRQKGGQTER DTERQKQKPRMTGAERRRERGRERERERGGREGG ERERESTHRARRRRRRREGGRPARDRTGRGGGELGKA GEERDWPRRAGERERRPRRLPASFVPSLLCVRLLWPG LPLPLPPPRGWMEFFPLDLGQLRGRGEARPWAGRW GGAGGGPLGRGLVRRPRSRRGPGRGSRGGDSRPQGCRQGGD GRRRESGRREGWRGRRREEGERPPCGEGGEPMESARRR WGPACGPGAAEKTPSLRRGSRGSRESAEREGGGLPAL LGP* | 129 | ATGGGAGACACAGATAATGCCCACCAGGCAGAGAAAGAGGATGCGAGATAGGAGA GGGCGAAAGGAGGCAGCAGATGTGCAGAGACAGAGGGGAAAAGACCAGACAGAGGAAAGAGG CACAAGAGGAGGCAGCAAAACCAAGAGAATGACAGGAGCAGGAGAAAGAGGAGGAGGAAGAGGGA AGAGAGGAGAGCCAGGAGGACCAGGAGACACGGAGGCGAGCAGCAGAGAGAAGAGAG GAGAGGAGGCCAGGAGGCCAGGAGGCAGGACTGGCAGAGAGGCGCAGGAGAGGGAGCTAGG AAAGCGCGGTAGCGACGTCCCCGGACCTCTGTCCCTGCTTGTCCTCCTCTCCCTGGTCCAGGCTTCTCTG GCCCCGCGCCTCCCGCGACCTTCCCGGCTGTTGATGGAATTTCCCAGGCTTCTCTG CTGGAACCTGGGCTCCGGGCTGATGGGCTGATGGGCTGATGGACTGGCTGGGC GGTGACGGGCGGAGGGGCGGCCAGGGAGGGCGGAGGGAAGGCCAGCCAGCAGGCCAGGCGGCC GCGAGGGCCTGAGGAGGCCCGCGCCTTGCCGGCCAGGAGGCGGAAGGGCGGAGGGAAGGCGCTCG AGGAAGGGAGAGGCCCGCCTTGCCGGGCCTGCGGGCCCGGAGCCGTGAGTTCGGGAGCCGTGAGGAGGGA GCGGCGGAGGGCCGGAGGCCGGAGCCGTGAGTTCGCGGAAAGGGAGGGTGGGGGCTCCCTGA GCCCCGCACTCCCTGGGTCCCTGA |

Figure 1 (Continued)

| | | | | | |
|---|---|---|---|---|---|
| | 2 | | MPHRQRKRMEHGRGRKEGQMCRDRRREDRRKETQRGSK SNQE* | 131 | ATGCCCCACAGGCAGAGACAGAGAAAGAGGATGGAGATAGGGAGAGGCGAAAGGAAGGAC AGATGTGCAGAGACAGAAGGGAGGAAGACAGAGGCGAAAGAGAGGCAGCAA AAGCAACCAAGAATGA | 132 |
| | 3 | | MAGTAGGGRGEAAVRRRRGEDGERSAAVGPGLRARGG GEDPFPATREPREP* | 133 | ATGGCGGGGACGGCGGGAGGAAGGGAGAGGGAGAGGCCCGCCGTGCGGCGAAAGGCGGGAG AGGATGGAGAGGCGTCGCGCGGTTGGGGCCTCTCGGCCTCGGGCCCGGGGGCCGCGG AGAAGACCCCTTCCTGCGACGCGGGAGCCGCGGAGCGTGA | 134 |
| | 4 | | MGAGAGRIVAGRD* | 135 | ATGGGCGCTGAGGCTGTAGGATCGTGGCTGGAAAGCTGTAG | 136 |
| | 1 | | MREIIRKTEKL* | 137 | ATGAGAGAAACGATCAGAAAAACTGAAAAGCTGTAG | 138 |
| hsa-mir-125b-1 | 2 | | MSPWIQCSSPQPGKTQINPFCKQLRCEFAFH* | 139 | ATGTCACCATGGATTCAGTGTTCAAGTCCATGCCAGCAACCTCAAAACTCAATAAATTTT CCTTTTTGCAAGCAGTCACTGTCAGTTCGCTTCCATTAG | 140 |
| | 3 | | MDSVFKSTARQNSNKFSFLQAAAL* | 141 | ATGGATTCAGTGTTCAAGTCCACAGCCAGGCAAAACTCAATAAATTTTCCTTTTTG CAAGCAGTCACTGTGA | 142 |
| | 4 | | MKGRRTPRPKHGQ* | 143 | ATGAAGGGAAGGCAAGGCCCGTCCAAAACATGGCCAATGA | 144 |
| | 1 | | MRRAL* | 145 | ATGAGGAGGGCATTGTAG | 146 |
| hsa-mir-127 | 2 | | MRVIDPGCRSPKE* | 147 | ATGAGGGTCATTGATCCTGGGTGCAGATCTCCAAAGAATGA | 148 |
| | 3 | | MTERKRIEWWKETIGWEKMKIEKRK* | 149 | ATGACAGAAAGAAAGAGGAGAATTGGGGAGAAGAGATAGGATGGGAAAAAATGA AAATAGAAAAGGAAGTGA | 150 |
| | 4 | | MGKNENRKKEVKEHN* | 151 | ATGGGAAAAATGAAATAGAAAAAAGGAAGTGAAAGATAATAATAATTAG | 152 |
| hsa-mir-129-1 | 1 | | MLGVWARHEGPSLAGPDGSSTPSGKARDKPLHAELCRE LEADTHSANLQW* | 153 | ATGTTGGGAGTCTGGGCAAGGCACGAGGCCCCTCTTAGCAGGTCCGATGGCTC CTCCACACTTCAGGAAAAGCAAGACAGAGATAAACCATTGCATGCTGAGCTCTGCAGGG AACTGGAGGCGGACACTGGCAATGTCAT | 154 |
| hsa-mir-129-1 | 2 | | MAPPHLQEKQEINHCMLSSAGNWRRTPSILQTCNGDTS GISLPLPGLQPLRQVRPRPGWLRDLCVALLTSCYGSRRP L* | 155 | ATGGCTCCTCCACACTTGCAGGAGAAGCAAGAGATAAACCATTGCATGCTGAGCTCT CCAGGGAACTGGAGGCGGACACCTGAGGCACCATCTGCAAACCTGCAATGGTGACACTTCT GGAATCTCCTTGCTCTTCCAGGCTCTAAGGCAGTTAAGACCCAGGCCA GGTTGGGCTCAGGGACCCTCGTGACCTCGTAGCATTGCTGACCTCATGTTATGAAGCAGGAGG CCACTGTGA | 156 |
| hsa-mir-129-1 | 3 | | MVTLLESPCLFQGCSL* | 157 | ATGGTGACACTTCTGGAATCTCCTTGCTGCAGGGCTGCAGCCTCTAA | 158 |
| hsa-mir-129-1 | 4 | | MLWKQEATVRCGA* | 159 | ATGTTATGAAGCAGGAGGCCACTGTGAGATGCGGGGCTTAG | 160 |
| hsa-mir-129-2 | 1 | | MKTAARGAFELRRLLSRCPLSAPRTSLPLPAGARSGAPA RSPAKRRVFNKLEEGRNAGVKLGKPQLPRS* | 161 | ATGAAAACCGCTGCCAGGGGGCATTGAACTCGGCGTTGCTTGCTGTCGTCTGCGCCT CTCTCTGCCGCTCCCGCTAAGCGACGAGTCTTCAACAAGTTGAGGAAGGCAGGAACGC AGGGGTTAAGCTCGGAAAGCGCAATTACCAAGATCGTGA | 162 |
| hsa-mir-129-2 | 2 | | MPWEGEWVAELQEGDGWAKGVGRQGLEDSASTVERR FLRACWARVGVCVRARAPARTSIPGCQRTNMATFPPSS CNVCSSNPSWVRFPPLGDYTAREGDSQDVY* | 163 | ATGCCGTGGAGGGTGAGTGGGTCGCGAGCTCGAGGAGGGTGATGGATGGCGA AGGGGTGGGTCGACAGGACTTGAAGACAGTGCCTCCACCGTGCAGGACGTTTT CTCCGGGCTGTGTGGGCGAGGGTGCCAAAGAACAAATATGCAACTTCCCCCAAGTTCTTG CACGTGGATTGCAGTAACCACCTCTGGTGAGGTTTCCCCACGTCAGGGGACTATACTGC TAGGGAGGGAGATAGTCAGGACGTCCCTTAG | 164 |
| hsa-mir-129-2 | 3 | | MDGRRGWYDRDLKTVPPPSRDVFSGRAGRGWECVCA RARPARRFQGAKEQIWQLSPQVLAMFAVTHPG* | 165 | ATGGATGGGCGAAGGGGGTGGGTCGACAGGACTTGAAGACAGTGCTCCACGTC GAGAGACGTTTCTCCGGGCTGTGTGGGCGAGGGTGGGAGGTGTGAGTTGTGTGCGCGCG CGGCCCCGCCGCAGTTCCAGATTCCAGGGTGCCAAAGAACAAATATGGGAACTTCCCC CCAAGTTCTTGCAATGTTTGCAGTAACCATCCTGGGTGA | 166 |
| | 4 | | MGEGGGSTGT* | 167 | ATGGGCGAAGGGGGTGGGTCACAGGGACTTGA | 168 |
| | 1 | | MCRYRELPEG* | 169 | ATGTGTAGGTATCGAGAGCTCCCGAAGGGTAA | 170 |

Figure 1 (Continued)

| | | | | |
|---|---|---|---|---|
| hsa-mir-130a | 2 | MCGGSAGHGRAGPSVSTWVCEGVECSEGDRGPKGWSRAGSSAPPEVVG* | 171 | ATGGGGGCTCCGCTGGGCACGGCGGCCGAGCTGGGCGTCCACCTGGGTGTGTGGAGGGCGTGGAGGTGTCCGAGGGGGAACCGGGGCCGAAGGGCTGGAGCAGGGCAGGGAGTTCTGCACCTCCAGAAGTTGTAGGGGTGA | 172 |
| | 3 | MCVGGRALTQFLLEGCVMRAELCSKYG* | 173 | ATGTGTGTGTGGGGGGGCGTGCAGTCCAGCAAGTATGCTGA | 174 |
| | 4 | MAESLCVCYCVCVCVTCACVVQPRGCVVRGEHSWVLKESAPHPPLPSCLSHPHRTWLSGPSWSPPPVAMAARRGWEETVGASPLPLLQLIIPHLPFLSLSQAGFHPLLLWGQGPEDGGQ* | 175 | ATGGCTGAGAGTTGTGTGTGTGTGTGTGTGTGTGTGTGTACGTGCGGCCTGTGTGGTCCAGCCCCTCACCCCTGTCGGGGGAGCACAGTTGGGTGTTGAAGGAGAGCGCCCCCACTTCCAGGTGCTCTCATCCATTCACAGAACATGGCTTTCAGGACCTCGTGCCATGGCTGCGAGGAGGGGTGGGAGAGACAGTTGCGCGCCAGCCCTGCGCCAGCTAACCCCACCTGCCCTTCTCCCTTTCACAGCTGGGCCCATCCCGCTGCTCTGCCCAGCGCCAAGATGTGGCCAATGA | 176 |
| | 1 | MITSHKKPLVRWLLSCSSSCLEWPGASIVSSIVCPAHSPAGTHTGRVRAVRRPGRLAPARHFSPPLPLPSAERGHQPCGLGTGEGPAALWSGSPGRPARTRRRSRR* | 177 | ATGATCACGTCGCACAAGAAGCCCTTGGTGCGCTGGCTGCTCCAGCAGCACTCTCCTTGCGGGACACACACCTCCATCGTGTCCAGCACGTCTGCCCAGCCACCTCTGCTGCGGGACACACACCCGGCGGCCTCGGTGAGAGCCGTGCGGCCCGCTTCCTCAGTGCGGGGGCATCACCCAGCGCCGCCTGGGCACCGGCGAAGGACCGGCTGCCCTGCGCCTGCGCCTCAGTGCGGGGGCATCAGCGCCGCCGCCGCCGCCGCCCGCCCGAGGAAAGTCATTCAGGCGGAGAACTTTACCAAAGTAGGGAGAAGGAAAATGA | 178 |
| | 2 | MSASGKVIQGGELYPSREKGSRGTSASRLGRSCPSWGK* | 179 | ATGTCCGCTTCAGGAAAAGTCATTCAGGGCGGAGAACTTTACCCAAGTAGGGAGAAGGGAAGTTGCCCAGTTGGGGGAAGTGA | 180 |
| | 3 | MPHPPLPGPELCCQGSAPASPARQLPFPSLPLASPAHVRAEPAPGR* | 181 | CCGCCCCACCCGCCGCTGCCAGCCCGCCCTTCCCTCCCTGCCCAGCCCATGTGCGGGCAGAGCCGGCCCCCGGGCCGCTGA | 182 |
| hsa-mir-132 | 4 | MCGQSRPRAADPAVNPARSRGPVYLSPKGTTPGALNASRQPRWGTRARRCTRGGRRTRTGLSRVPRPSRSPARGPTWGACRKPRARLTADPGGTWLRCPPPAGFPVGLSCWSVLPASWSRLSPAALSAHSYLERPGPAGAAAAMAPPKGRAGLCAAGRCLPPAHLSWRRTDAEPAGRGPPYPQVRPPTCTHLGPRPRTRESOKPWGFELSAPMYVFLGTQPQPFGKVLPASTGLGWWGRGYPAQE* | 183 | ATGTGCGGGCAGAGCCGGCCGGCCGCCGACCCGGCCGTTGAACCCGCCGCCGCCGGAGGCAGAGGCCAGGCCGGCCGTGCGGCCCGGGGACGCCCCTGAAGCCGGACACCGGACCCTGAACCCAGGGCCGCAGCGCTCAGAGAGATGCACCGAGGCGGCCGACGCACGAGGAACCGGGGCCATGTCGAAGCCCCGGGCGCGCCGCCGCTAGACTCCCGGGGCCGGGGACCCTGGGACCCTGCGACGGACGCGGCGGTCGCGCTTTGCTGTCCGCACACTCTTATCTGGAGCGCCGGGGACCTGCAGCCCCGCGGTCGCTCAGCCGCCGCTATGCGCGCCACCCTGCGGGGGCAGATGCCTGAGCGCGGACAGGGCCTGCGCAGCCCTGCGCAGCCCTGCGCCATGTACGTATTTCTAGGCACACAGCCAGCCCCAGTTGCGGAGAAAAGTCCTGCCCGAGCGGAGCGCCCGGAGCCTGGAGGTTATCCGCGCAGGAGTAG | 184 |
| | 1 | MLLTLWERFINERNVSLFQVCAFDIVYIGKGHNAVLVCEMK* | 185 | ATGCTATTGACATTATGGGAAAGATTTATCAATGAGAAATGTCTCTTTTCAGGTATGTGCTTTTGATATAGTTTACATTGGAAAGGGTCATAATGCTGTTTTAGTTGTGAAATAAGTAA | 186 |
| hsa-mir-133a-1 | 2 | MGKIYQ* | 187 | ATGGGAAAGATTTATCAATGA | 188 |
| | 3 | MREMCLFRYVLLJ* | 189 | ATGAGAGAAATGTGTCTCTTTTCAGGTATGTGCTTTTGATATAG | 190 |
| | 4 | MLFP* | 191 | ATGCTTTTCCCATGA | 192 |

Figure 1 (Continued)

| | | | | | |
|---|---|---|---|---|---|
| hsa-mir-133b | 1 | MELKNEGEMGGQGTNWGMTAYSVRIGNAHKGQMKMISLCVIRRIAITKIRVKGEGGKGKRE* | 193 | ATGGAACTAAAGAATGAAGGAGAAATGGGTGACAGGCACAAATTGGGAATGACAGCCTATTCAGTGAGGATAGGAAATGCACATAAAGGACAGATGAAGATGATTCTCTGTGTTGATTAGAAGGATAGCAATTACAAAGATAAGAGTGAAAGGAGAGGGAGGAAAGGGAAAAGGGAATAA | 194 |
| | 2 | MKEKWVDRAQIGE* | 195 | ATGAAGGAGAAATGGTTGACAGGCACACGCACAAATTGGGAATGA | 196 |
| | 3 | MHHKDR* | 197 | ATGCACATAAAGGACAGATGA | 198 |
| | 4 | MLRKSPGC* | 199 | ATGCTTAGAAAATCACCAGGCTGTTAG | 200 |
| hsa-mir-134 | 1 | MPNKPGSMMTTGGV* | 201 | ATGCCCAATCTGGATCGATGATGACCACTGGTGGCGTATGA | 202 |
| | 2 | MSHT* | 203 | ATGAGTCATACATGA | 204 |
| | 3 | MMNMCLEL* | 205 | ATGATGAATATGTGTCTGGAACTCTGA | 206 |
| | 4 | MHSYVIIMIGSMKE* | 207 | ATGCATTCTTATGTTATTATTATGATTGGTCAATGAAGAATGA | 208 |
| hsa-mir-135a-2 | 1 | MMKMEYKAIPSLLSLTNLYQFSE* | 209 | ATGATGAAAATGAAATATAAAGCAATATTTCTCTGTTGAGTCTAACTAATCTTTATCAGTTTTCAAGATAA | 210 |
| | 2 | MGHLYCVALDLFCSTM* | 211 | ATGGGACATTTATATTGTGTAGCGTTGGGATTTATTTGCTCAACAATGTAA | 212 |
| | 3 | MLKGKLRS* | 213 | ATGCTCAAAGGAAAGCTAAGGTCTGA | 214 |
| | 4 | MFYFPGPVWS* | 215 | ATGTTCTATTTTCCAGGCCAGTCTGGTCATAG | 216 |
| hsa-mir-136 | 1 | MRRAL* | 217 | ATGAGGAGGCATTGAG | 218 |
| | 2 | MRVIDPGCRSPKE* | 219 | ATGAGGGTCATTGATCCTGGGTGCAGATCCAAAGAATGA | 220 |
| | 3 | MTERKREWWKETIGWEKMKIEKRK* | 221 | ATGACAGAAGAAAGAGGGAGTGTGAAAACAATAGGATGGGAAAAATGAAATAGAAAAAAGGAAGTGA | 222 |
| | 4 | MGKNENRKKEFVKEHNN* | 223 | ATGGGAAAAATGAAAATGAAAGAAGTGAAAGATAATAATAATTAG | 224 |
| hsa-mir-138-2 | 1 | MLLCALSGVSGPQ* | 225 | ATGCTTCTCCTGTGTGCCCTCTGCCTTTGCTTCGTGCTGATCTGCCACAGTAG | 226 |
| | 2 | MSRCFALSSCARLLPTSSGSAPKA* | 227 | ATGAGCAGATGCGTTTGTCTTGTCCTCGTGCCAGGCTCCTCCCCACATCCTCTGGATCAGTCCACGTGCTAG | 228 |
| | 3 | MLCFVLLCQAPPHLWISSTCLDSDSVIHRGGP* | 229 | ATGCTTTGCTTTGTCCTTGTCCTGTGCCAGGCTCCTCCCCACATCCTCTGGATCAGTCCACGTGCTAGATTCAGACTCCGTGATTCAACCGTGGGGCCTTAA | 230 |
| | 4 | MSPRIK* | 231 | ATGTCTCCCAGGATCAAATGA | 232 |
| hsa-mir-141 | 1 | MGAALRGGRRRRRRGGD* | 233 | ATGGGGGCCGCCTCCGGGGAGAGGAGGCGCCGCGCGCGTCGTCGCGGGGGGGACTGA | 234 |
| | 2 | MDRRIDGSEVGHEASRKKLQRTRTRVPEPGVGGFRNRREVGNGKGVW* | 235 | ATGGATAGGAGAGATGGCAGCGAGGTGGGGCATGAAGCCTCCAGGAAAAGCTCCAAGGACCAGACGGTTCCGGAGCCTGGGGTTGGGGCTTAGGAATAGACGGGAAGTGGGAAACGGGAAAGGGGTGTGTAG | 236 |
| | 3 | MAARWGMKPPGKSSKGPEHGFRSLGLGALGHDGKWETGKGCGRWKEGLWLMNLGETEAWAKRGPFLRRAGGFPAWKREGHVFYTVFIPLLQYTSDPVFPTPDIVISWKGHWGPVVWVIPKLVRRKIGTQKGELGRKGFWEDGNGELSNLTGTPGKLRPPPSTLQFPERPLPLEL* | 237 | ATGGCAGCGAGGTGGGGCATGAAGCCTCCAGGAAAAAGCTCCAAGGGAAGTGGGGAGACCGGGTTCGGAGCCTGGGAGATGGCAGCGAGGGATTGTGCTGATAGAGCCTGATGAACCTGGGCGAGACGAAGGCTTGGGCAAAGAGGTCATTTTGACAGGTTTCATTCCCTACTGCAGTCACCTCTGACCCTGTTTCCCTATCCCACACATAGTTATTTCTTGGAGAGGACCTGGGGCACAGTAGTGTGGGTTATCCCAAAACTAGTGAGGAATGGAAAACAGGAACACAGAAGGGGGAGTTGGGAAGGAAAAGGGGTTCTGGGAGGATGGAATTGAGCAACCTTACAGGCACTCCAGGCAAGTTGCGACCTCCACCCTCCAATTTCCGGAGCGTCCGCTGCCCCTGGAGCTGTGA | 238 |
| | 4 | MEMEN* | 239 | ATGGAAATGGAAATTGA | 240 |
| | 1 | MREFAQGKAP* | 241 | ATGCCGGAAGCTCAGGCAAAGGCCCTTGA | 242 |

Figure 1 (Continued)

| | | | | | |
|---|---|---|---|---|---|
| hsa-mir-142 | 2 | MAPGPQAGKFVSKEEGWRVRRGWQRVRRG* | 243 | ATGGCTCCGGGACCCCAGGCGGGGACGGGGAAAGAGGTGTCCAAGGAGGAGGGCTGGAGAG TAAGGCGGGGATGGCAGAGGGTACGCAGAGGCTGA | 244 |
| | 3 | MAEGTQRLRSGTSVSRGASLFLRPTWPPFLLG* | 245 | ATGGCAGAGGGTACGCAGAGGCTGAGAAGTGGGACCAGTGTCTCAAGGGGCGGCCAG CCTCTTCCTCCGCCACATGGCCACCATTTTGTTGGGATAG | 246 |
| | 4 | MATIFVGHALGSCQGWSRAVRESGLWAGGEAENQGSGE SGLWGWWSGWGLRPWGVRTLGCYGGWD* | 247 | ATGGCCACCATTTTGTTGGGATAGCCTTGGGCTCCTGCCAGGGAACAGCAGGGCA GTGAGGGAGTTCAGGACTTTGGGCTGGTGGGAGGCCGAGAATCAAGGCTCTGGGGA GTCAGGACTTTGGGCTGGTGGGAGGCTGGGGACTGAGGCCTGGGGGTCAGGA CCTTGGGCTGCTATGGAGGCTGGGACTGA | 248 |
| | 1 | MPLWQRGAPEAGSN* | 249 | ATGCCCTGTGGCAGCGAGGCGGGACGCAGAGGCTGGGTCTAATTAG | 250 |
| | 2 | MLHLGVLLSC* | 251 | ATGCTCGATCTGGGGGTCTTGTCTGTCTGCTAA | 252 |
| | 3 | MISKHPSS* | 253 | ATGATCTCTAAGCATCCATCCAGCTGA | 254 |
| hsa-mir-143 | 4 | MVLLASRIPCCCSQLGHEGAEGGVHRVNILSAQASPRHPS LRQSPWLLHRQCFFLIVWGHDFVIPRAWGSWQGKWFSN NGFFEKQSWGRGNVSSGSGRQAEHLGRLGADCTWSNGK GCW* | 255 | ATGGTTCTGTTGGCTTCGAGGATTCCTGTTGTTGTAGTCAATTGGGGAAGAAGGT GCAGAGGAGTGCAGTCTCCTGGCTTCAAGAGCTCAGGCCAGTGCTTCAGCCACCCG AGTCTCAGGCAGTCCCTGGCTTCAAGAGCTCAGGCCAGTGCTTCTTCCATTGTGTG GGCTTTGATTTGTAATTCCAAGAGCCTGGGCTCCTGGCAAGGAAACAAAGCTGGGGCTCTGG AATAATGGTTTCGAGAAACAACTGGGGAAGGCAATGTAAGCTCAGGCTCTGG CAGGCAGGCAGAGATCCTGGGAAGGCTGGGTGCTGACTGCACATGGAGCAATGGGA AGGGATGCTGGTGA | 256 |
| hsa-mir-144 | 1 | MGGGSRSPGGQVPVWGGALKQRSFLGTVRPVNSKQAG ACWGLPALPAQETRMRPLQVGKPGSGQCSLGLQNAAS SRISJ* | 257 | ATGGGGGCGGGTCGCCAGAGGTCGTTTCTGGCACAGGCACGACCCGTAATTCAAGCAGGCTGGGG GAAACAGAGGTCGTTTCTGGCACAGGCACGACCCGTAATTCAAGCAGGCTGGGG CTTGTTCGGGGATTACCGRACTGCGCCAGGAGACGCGATGCGRCCTCTACAG GTGGGAAACCCGGTTCTGGGCAGTTGGGATTGCAAAATGCTGCAAGTTCC AGAATTCTATCTAG | 258 |
| | 2 | MGRGPETEVVSRHSQTR* | 259 | ATGGGGGAGGGGCCTGAAACAGAGGTCGTTTCTCGGCACAGTCAGACCCGTTAA | 260 |
| | 3 | MLQVPEFLSRWGMGTAVLGKRNCY* | 261 | ATGCTTCAAGCTCACTTGGATCTCAAATCAATCTCCACTGGGACATCCCTAG GAAAAGGAACTCTATTGA | 262 |
| | 4 | MASGSLWISKSISPLGHPQCVGDKYPTPLKTRNSLEDRR ETPREH* | 263 | TGTGTGGGAGGATAATACCTACCCCCTGAAGACCAGAAATAGCCTTGAGGACAG AAGGGAGACTCCCAGAGAACACTAA | 264 |
| | 1 | MPLWQRGAPEAGSN* | 265 | ATGCCCTGTGGCAGCGAGGCGCACCAGAGGCTGGGTCTAATTAG | 266 |
| | 2 | MLHLGVLLSC* | 267 | ATGCTCGATCTGGGGGTCTTGTCTGTCTAA | 268 |
| | 3 | MISKHPSS* | 269 | ATGATCTCTAAGCATCCATCCAGCTGA | 270 |
| hsa-mir-145 | 4 | MVLLASRIPCCCSQLGEEGAEGGVHRVNILSAQASPRHPS LRQSPWLLHRQCFFLIVWGHDFVIPRAWGSWQCKWFSN NGFFEKQSWGRGNVSSGSGRQAEHLGRLGADCTWSNGK GCW* | 271 | ATGGTTCTCGTTGGCTTCGAGGATTCCTTGTTGTTGTAGTCAATTGGGGAAGAAGGT GCAGAGGAGTGCAGTCTCCTGGCTTCAAGAGTTAACATCCTATCAGGCAGTCGGCACCCT AGTCTCAGGCAGTCCCTGGCTTCAAGAGCTCAGGCCAGTGCTTCTTCCATTGTGTGG GGCTTTGATTTGTAATTCCAAGAGAACAAAGCTGGGGCTCCTGGCAAGGAAATGGTTTCA AATAATGGTTTCGAGAAAACAAAGCTGGGGCAAGGCAATGTAAGCTCAGGCTCTGG CAGGCAGCAGAGATCCTGGGAAGGCTGGGTGCTGACTGCACATGGAGCAATGGGA AGGGATGCTGGTGA | 272 |
| | 1 | MLFLQDA* | 273 | ATGCTCTTTCTCCAAGACGCTTGA | 274 |
| hsa-mir-146a | 2 | MAPAGPIGVVNPGPEGMPKGGQDGQETVAQRGGGEQR LNWK* | 275 | ATGGCCACCAGCAGGGCCGATTGGAGTGGTAAACCTGGGCCGGAAGGCATGCCAAA GGGTGGACAGGATGGACAGGAACAGTAGCAACGACGAGGAGGGGGAGAACAGCGG CTGAATTGGAAATGA | 276 |
| | 3 | MDRRQ* | 277 | ATGGACAGGAGACAGTAG | 278 |
| | 4 | MSWEKHHAS* | 279 | ATGAGCTGGGAAAAACATCATTGCAAGCTGA | 280 |

Figure 1 (Continued)

| | | | | |
|---|---|---|---|---|
| hsa-mir-146b | 1 | MSGFSIPVWLDSGQGASSPGPREFHL* | 281 | ATGTCTGGGTTCTCTATTCCGTCTGCCTTGATTCTGGACAAGGGGCTTCCTCTCCAG GGCCTCGGTTTCCCCATCTTTAA | 282 |
| | 2 | MRSGFRCDEPAEAVAPERQTYSGAVALASFTSPHTHPV DDGGRHYSWGSPKRILGLLGPGDAVRGSPEAESRGLGRH CPRADPAPDPTTKPKASREALPLAG* | 283 | ATGAGAAGTGGTTTCGTTCGTGATGAGCAGCTGAAGCGGTTGCACCGGAGCGCA GACCGTCAGCGGTGCAGTGCCTCTCCGGTCTTCACATCCCACCCCATCCGT GGATGATGGGGAAGGCACTACTCCTGGAGGTTCCCGAAGCGGATCCTGGGACTGG GACCTTGGGACGCCGGTGAGAGGCAGCCCTGAAGCTGAGTCCAGAGTTCTGGGGCCT CATTGTCCCAGGCGACCGACCCAGCCCAGGCGACCCTACAACTAAGCCAAGCCTAAGCCG AGAAGCACTACCACTRGCGRGCTGA | 284 |
| | 3 | MSQLKRLHRSARPSAVQWLSRPSHPPTPIPWMMGEGTT PGVPRSGGSWDWDLGTR* | 285 | ATGAGCCAGCTGAAGCGGTTGCATCGGAGCGCATCCGTGAGCGGTCAGCGGTCAGTGGCT CTCGTCTTCACATCCCCACACCATCCGTGGATGATGGGGAAGGCACTAC TCCTGGGGTTCCCCGAAGCGGATCCTGGGACTGGGACCTGGGAGCGGGTGA | 286 |
| | 4 | MKGTQLEJ* | 287 | ATGAAAGGGACCCAGTTGGAAATATAG | 288 |
| hsa-mir-147a | 1 | MHRKPKTVYLIVFLSDTFFSAPLFFSILLRPHRSHDHMVI SWSSILLTTPS* | 289 | ATGCACAGAAAACAAAGACCGTGTATCTCATTGTATTCTTCTGACACTTTCTTT CAGCCCCCCTCTTTTTTCCATCCTTTTGAGACCCACAGTCACATGATCATATGGT CATTTCATGGTCTTCAACTCTTCAGACCCCTTCATAG | 290 |
| | 2 | MHWSFHGLQLLRPLHSTDFTISF* | 291 | ATGATCATATGGTCTTCAACTCTTCATGGTCTCAACTCTTCAGACCCCTTCATAGTACGGACT TCACCATTTCCTTTTAA | 292 |
| | 3 | MVFNSYDPFIVRTSPFPENFLVS* | 293 | ATGGTTCTCAACTCTTACGACCCCTTCATAGTACGGACTTCACCATTTCCTTTTAATT TCCTAGTGAGTTAA | 294 |
| | 4 | MKWSLF* | 295 | ATGAAATGGAGCCTTTCTGA | 296 |
| | 1 | MERWRGVWGKMGKHFPDLLHARNSCSGAVCGGRGSA RMGDRVVAYAAGKRGCREGEKSSLGDCVQKCARTGS AGSTA* | 297 | ATGGAACGGTGGCGAGGGGTTTGCGCGGAAGATGGAAAGCACTTTCCAGACCTGTT GCACGCGCCAACAGTTGGTCGTTATGCTGCAGGGAGAATGGAAGATGGAAGATCGAAGCGTGGGCGGTCTGCTAGGA TGGGGGACGAGCAGTCTTGGGACTGTGTGCAAGGTTGTGCGCAACGGGGTCCGCGGGAA GCACTGCCTAA | 298 |
| | 2 | MWGEGVC* | 299 | ATGTGGGAGGAGGGCGTCTGCTAG | 300 |
| | 3 | MLQCKGAGRGRRAVLGTVCKVVRERGPREALPNGA GRIPKSGWVERRGWDIFDPSSRGWARAAGRPGHEYWE WLGKGVSGEAPQSGSFLGRPILGAFFPGPVFVPHRLTLSA PNIRPRAAPPPPAFQMGR* | 301 | ATGCTCTCAAGGGAGAAAAGGGGTGCCGGGAGGGGAGAAGAGCAGTCTTGGGGACTG TGTGTGCAAGGTTGTGCGCGAACAGCGGGTCCCGGGAGAAGCACTGCCTAATGGGGCAGGG AGAATCCAAAGAGTGGGTTGGCCGGCGCGGCTGGAAGCAGGGGATGGCAGACGACTTTGACCCGA GTTCCCGGGCTGGGCTGGAGCCTGGAAGACCGGAAGAGTACTGGGAATGG CTGGGGAAGGGGGGTCTCAGGGAGGCCTGATTTGTTCCCACCGGTTAAACTCTTTCAGT CATCTTTAGGGCGTGCGTTAGCCGGCCTGGCAGCGCGCCAGCTTCCCAGATGGGAAGGTAA CCGAATATTGCGTTCCCTCGTGCAGCGCGCCAGCTTCCAGATGGGAAGGTAA | 302 |
| | 4 | MGQGESQRVGGWNGGDGTTSTRVPGAGRGRLEDRE* | 303 | ATGGGGCAGGGAGGAGAATTCCCAGGGAGTTCCCAGGGAAGAGGAGATCCAAAGAGTGGGTTGGGGATGGGGACGA CTTCGACCCGAGTTCTCACCTGGGGAAGGACAAGGACAAGCAGGTCTCAGTGAGATGAGCTTTAATGAGG | 304 |
| hsa-mir-148a | 1 | MKJFFTWGRTGLSEMSFNGGNAKQVKTKTK* | 305 | ATGAAATTCTTCACCTGGGGAAGGACAAGCAGTCTCAGTGAGATGAGCTTTAATGCGGCAAT AAACGCAAGCAGGTTAAAACAAAGACAAGTAA | 306 |
| | 2 | MEETPSRLKQRQSKSYWGTKISVELISIYQ* | 307 | ATGGAGGAAAACTCCAGCCGACTTAAGCAGAGGCAGTCTAAGACAAAGAATTCCTAGGGGTAC AAAGATTTCTGTGGAGTTAATAAATCTACTGGGGTAC | 308 |
| | 3 | MQWLFPVIAALWEAEAGKRSLEVRSLRPAWPTWRNPIST RKILSRAWWGTPVIPATRESEAQESREPRKRRLP* | 309 | ATGCAGTGGCTCACGCCTGTAATAGCAGCACTTTGGAGGCTGAAGCTGGCAGATC ACTTGAGGTCATGAGGTTAGCCGGCCATGTTGGGCACGCTGTAATCCAGCTACTCGG CAAAAAATATTAGCCGGGGCATGTTGGGCACGCTGTAATCCAGCTACTCGGG AGTCTGAGGCACAAGAGTGATTGAACCCAGGAGGCGGAGGTTGCCGTGA | 310 |
| | 4 | MAKPHLYQKNT* | 311 | ATGGCGAAACCCCATCTTACCAAAAAATACTTAG | 312 |
| hsa-mir-150 | 1 | MPPPGSMMTTGGV* | 313 | ATGCCAATCCTGATGATGACCGGTGGCGTATGA | 314 |

Figure 1 (Continued)

| | | | | | |
|---|---|---|---|---|---|
| hsa-mir-154 | 2 | MSHT* | 315 | ATGAGTCATACAATGA | 316 |
| | 3 | MMNMCLEL* | 317 | ATGATGAATATGTGTCTGGAACTCTGA | 318 |
| | 4 | MHSYVHMIGSMKE* | 319 | ATGCATTCTATGTTATTATGGTCAATGAAAGAATGA | 320 |
| | 1 | MPSRGGDARWGAWGQRRPDRPTPDRARGGHGPGRRR ALFLGARGGWGARKSNARREYGPARARS* | 321 | ATGCCCTCGCTGGGGGGGGACGCTGCCGGCGGAGTACCGGCCGGACACCTGACCGGCGCGGGAGGCCACGGGCGGCGGCGGGCTGTTCTTGGGTGCGCGGGGCTGGGGGCGCGGGGCCGGCTCGGAAATGCCAGAAGAGAGAGTACGGCCCGGCGCGGCGCGCGTTCGTGA | 322 |
| | 2 | MGGVGTAAPRPPDT* | 323 | ATGGGGGGCGTGGGGACAGCGGCGCCGCCGACCGCCGACACCTGA | 324 |
| hsa-mir-181c | 3 | MPEESTARRARVREGCSGQVHGRSGLRRPILAGAPLRP GRGLGVLQPRHLRKPWRPARAAPPACHYRQQLQGIYW GQGLRTGTRPPKLAIKRENGPESHCRGALLKLQGAFHG DLPWRAGWGWGGGKDTSLADRD* | 325 | ATGCCAGAAGAGAGTACGGCGCCCGCGCGGCGGCGTTCGTGAAGGCTGCTCCGGCCAAGTTCATGGGCGTCGGGCCTGGGAGACCGATCGGCACCTCCGGGGTGCTGCAGCCGCGCCACCTCCGGAAGCCCTGGCGCCTGTGGCGCGCCGCCCCCTCGGGGTGCTGCAGCCGCGCCACCTCCGGCAGCTGCAGGGTATTTACTGGGGCCAAGGTTTGCGAACAGGAACCCGCCTCCAAAACTGGCCATAAAAAGGAAAATGGCCCCGAATCCCACTGCCGGGAGCCTGGAGGCCTTTAAGCTACAGGGGCCTTTCACGGCGACCTGCCTTGGAGGGCAGGCTGGGGGTGGAAAAGACACCTCATTGGCTGATAGGGACTGA | 326 |
| | 4 | MGARACGDRSWRGPRSGLAAGWGCCSRATSGSPGALR GPPLRPVITGSSCRVFTGAKVCEQEPALQNWP* | 327 | ATGGGCGCTCTGGGCTGCGGAGACCGATCCTGGCGGGGACCGCGGAGCGGGGTGCTGCAGCCGCGCCACCTCCGGAAGCCCTGGCGCCTGCGCGGGCCGCCCCTCCGGAACAGGAACCCGCCTCCAAAACTGGCCATAA | 328 |
| | 1 | MPSRGGDARWGAWGQRRPDRPTPDRARGGHGPGRRR ALFLGARGGWGARKSNARREYGPARARS* | 329 | ATGCCCTCGCTGGGGGGGGACGCTGCCGGCGGAGTACCGGCCGGACACCTGACCGGCGCGGGAGGCCACGGGCGGCGGCGGGCTGTTCTTGGGTGCGCGGGGCTGGGGGCGCGGGGCCGGCTCGGAAATGCCAGAAGAGA | 330 |
| | 2 | MGGVGTAAPRPPDT* | 331 | ATGGGGGGCGTGGGGACAGCGGCGCCGCCGACCGCCGACACCTGA | 332 |
| hsa-mir-181d | 3 | MPEESTARRARVREGCSGQVHGRSGLRRPILAGAPLRP GRGLGVLQPRHLRKPWRPARAAPPACHYRQQLQGIYW GQGLRTGTRPPKLAIKRENGPESHCRGALLKLQGAFHG DLPWRAGWGWGGGKDTSLADRD* | 333 | ATGCCAGAAGAGAGTACGGCGCCCGCGCGGCGGCGTTCGTGAAGGCTGCTCCGGCCAAGTTCATGGGCGTCGGGCCTGGGAGACCGATCGGCACCTCCGGGGTGCTGCAGCCGCGCCACCTCCGGAAGCCCTGGCGCCTGTGGCGCGCCGCCCCCTCGGGGTGCTGCAGCCGCGCCACCTCCGGCAGCTGCAGGGTATTTACTGGGGCCAAGGTTTGCGAACAGGAACCCGCCTCCAAAACTGCCCATAAAAAGGAAAATGGCCCCGAATCCCACTGCCGGGAGCCTGGAGGCCTTTAAGCTACAGGGGCCTTTCACGGCGACCTGCCTTGGAGGGCAGGCTGGGGGTGGAAAAGACACCTCATTGGCTGATAGGGACTGA | 334 |
| | 4 | MGARACGDRSWRGPRSGLAAGWGCCSRATSGSPGALR GPPLRPVITGSSCRVFTGAKVCEQEPALQNWP* | 335 | ATGGGCGCTCTGGGCCTGCGGAGACCGATCCTGGCGGGGACCGCGGAGCGGGGTGCTGCAGCCGCGCCACCTCCGGAAGCCCTGGCGCCTGCGCGGGCCGCCCCTCCGGAACAGGAACCCGCCTCCAAAACTGGCCATAA | 336 |
| | 1 | MRLFPNRGRFCLASLVWTPRGAERRLCAQPGAGAGECL GPGAGGRAGRSQSGAQ* | 337 | ATGCGGCTCTTTCCAAACCGGGGCCGTTTTGCTGCTTCTCTGGTGTGGACTCCGCGGGAGCTGAGCGCTGAGAGGCGCCTGCAGCCTGGGGCTGGGGCTGTGCGCCTGACCGGCGGCGGCTGAGCGGGCCCGGGGCGGGAGCCGGGGGCGGAGCCGCAGAGCGGGGCTGAGTGTCTAGTAG | 338 |

Figure 1 (Continued)

| | | | | |
|---|---|---|---|---|
| hsa-mir-182 | 2 | MTRQCLLALPRLQAEAPTGRLGPGSASGVCPAPSAVPG RGRGRERLRSECGRCLRGAYPRGVWLGSGCVSPPWA QAEAPGWEGAAESAGAPELAPPASCQGCAAGSRLLPWP GAAPPSLWGKAALRPPVCLHFAATHPGNPGARE* | 339 | ATGACGCGGCAGTGCCTACTGCTCTTCCCGCCTTCAGGCGGAGGCGCCACGGG GCGGCTGGGTCCCGGAACGGCTCCGCCAGTGGGTCCGCCAGCGCTGTCCCGG GCCTACCCGCGAGGAGTTTGGCTGGGGTCGCGTTTGGCCGCCTGGTGGCT CAGGCCGAAGCGCCCAGGCTGAGGCGCCGGGGCCCCGGGAGC TGGCCCCCTCCAGCGTCTTGTCAGGCGGCTGCGCGGCTCGGTTCCGTCGGC CCGAGCCGCCCCCCAGTCTCTGGGGAAAGCGGCTCTCAGACCTCCGGTGCC TCCACTTCGCTGCGGCCACTCATCCCGGAACCCCGCGCGACGGGAATGA |
| | 3 | MRHRSPPSTAPFLLIALVAPRFPALPQDRRLDGLPLAPH RSAHPRTMGSEGVTRGQGSPDSTYSSRLSHSFALPTRAP GHRVQ* | 341 | ATGAGACACCGTTCCCAGCCCTTCCCAACTGCCCATTCCTGTAATAGCGCTAGTGGCA CCCAGGTTCCAGCCCTTCCCAAGATCGGCGCTGGACGGCTTGCCTTCTGGCGCCT CACCGGTCAGGCGCATCCAGGACTATGGGACAGTGAGGGTGTCACCGGGGTCAGGG GTGCCCGATTCCACGGTGTCCCAGGCTGAGCGCATTCGTTTGCTCTCTCCAACCCG GGCTCCGGACACCGGTGACAGTAA |
| | 4 | MGTESADL* | 343 | ATGRGCACCGAGTCGGATCTCTGA |
| | 1 | MRLFPNRGRPFCLASLVVTPRGAERRLCAQPGAGAGECL GFGAGGRAGRSQSGAQ* | 345 | ATGCGGCTCTTTCCAAACCGGGGCCGTTTTCTGCCTGGCTTCTCTGGTGGTGGACTCCG CGGGAGCTGAGAGCGGCTGTGCGCCCAGCCTGGAGCCGGCGCAGGTGAGTGTCT GGGGCCGGGCTGAGGACGGGCCGGCAGGGAGGGCCGGGGCTCAGTAG |
| | 2 | MTRQCLLALPRLQAEAPTGRLGPGSASGVCPAPSAVPG RGRGRERLRSECGRCLRGAYPRGVWLGSGCVSPPWA QAEAPGWEGAAESAGAPELAPPASCQGCAAGSRLLPWP GAAPPSLWGKAALRPPVCLHFAATHPGNPGARE* | 347 | ATGACGCGGCAGTGCCTACTGCTCTTCCCGCCTTCAGGCGGAGGCGCCACGGG GCGGCTGGGTCCCGGAACGGCTCCGCCAGTGGGTCCGCCAGCGCTGTCCCGG GCCTACCCGCGAGGAGTTTGGCTGGGGTCGCGTTTGGCCGCCTGGTGGCT CAGGCCGAAGCGCCCAGGCTGAGGCGCCGGGGCCCCGGGAGC TGGCCCCCTCCAGCGTCTTGTCAGGCGGCTGCGCGGCTCGGTTCCGTCGGC CCGAGCCGCCCCCCAGTCTCTGGGGAAAGCGGCTCTCAGACCTCCGGTGCC TCCACTTCGCTGCGGCCACTCATCCCGGAACCCCGCGCGACGGGAATGA |
| hsa-mir-183 | 3 | MRHRSPPSTAPFLLIALVAPRFPALPQDRRLDGLPLAPH RSAHPRTMGSEGVTRGQGSPDSTYSSRLSHSFALPTRAP GHRVQ* | 349 | ATGAGACACCGTTCCCAGCCCTTCCCAACTGCCCATTCCTGTAATAGCGCTAGTGGCA CCCAGGTTCCAGCCCTTCCCAAGATCGGCGCTGGACGGCTTGCCTTCTGGCGCCT CACCGGTCAGGCGCATCCAGGACTATGGGACAGTGAGGGTGTCACCGGGGTCAGGG GTGCCCGATTCCACGGTGTCCCAGGCTGAGCGCATTCGTTTGCTCTCTCCAACCCG GGCTCCGGACACCGGTGACAGTAA |
| | 4 | MGTESADL* | 351 | ATGRGCACCGAGTCGGATCTCTGA |
| | 1 | MVGLQRCLHLV* | 353 | ATGGTGGATTACAAAGGTGCTTAATTTGGTTGA |
| | 2 | MNAAQHILC* | 355 | ATGAATGCGTCAGCATATTTATGTTAA |
| hsa-mir-184 | 3 | MLLSIFYVKMLFLCLKIFRKGK* | 357 | ATGCTGCTCAAGCATATTTATGTTAAAAATTTGTTTTATGTTTAAAAATTTTAGAA AAGGTAAATAA |
| | 4 | MLKICFYV* | 359 | ATGTAAAATTTGTTTTTATGTTTAA |
| | 1 | MKKGRKPPTCASDSRWRNDCGFRCHIE* | 361 | ATGAAAAAGGGAGGAAGCCCACCTGTGCAGTGACTGCGCGTTGGAGAAAATGATTG TGGTTTCGTTGCATCCACCGCTGA |
| hsa-mir-18b | 2 | MIVVPVASSTADS* | 363 | ATGATTGTGGTTTCGTTGCATCCACCGCTGACTCTGA |
| | 3 | MAPLSSSGLWAATITLVTMVEREGSGFILHPFPPSLPPAC LPGLSSSDPACSLVSDL* | 365 | ATGGCCGCCTTGCCTTCCTCTTCCGGGCTTTGGGCTGCACAATCACCGTGTAACAATG GTGGAAAGGGACGGGAGGGTCCAGGCTTTCCTCCTTCTTGCCCCCC GCTTGCCCTTGCAGGACTTTCCTCCTCCGACCCAGCGTGCTCACTGGTCTCTGATTTGT AA |

Figure 1 (Continued)

| | | | | | |
|---|---|---|---|---|---|
| | 4 | MLNSILFVRLKLRHHFILQSAVGLWP* | 367 | ATGCTTAATTCCATTTGATTGTGGTCTTAAACTAAGACATCATTTTATTCTACAGAGCGCTGTCGGGCTTTGGCCTTGA | 368 |
| hsa-mir-190b | 1 | MAPFYNPVCHLFLTYHSTQNFMV* | 369 | ATGGCCCCATTCTATAATCCTGTGTCATCTACTTTTCTCACTTATCACTCTACCCAAAATTTCATGTATAA | 370 |
| | 2 | MIQVVKVYP* | 371 | ATGATCCAGGTGGTAAAGTTTATCCCTAA | 372 |
| | 3 | MSPKSPYLSDQSRNHSDHFG* | 373 | ATGAGCCCTAAGTCCCCATATCTTTCGACCAGTCTAGAAATCATTCTGATCATTTTGGTTAA | 374 |
| | 4 | MKLTPFLEQKTFLLAYQSHLKKE* | 375 | ATGAAACTTACCCATTCCTTGAGCAGAAAAACTTCCTCCTCGCCTACCAGAGCCACCTAAAGAAGAATGA | 376 |
| hsa-mir-192 | 1 | MCPDLLTPRS* | 377 | ATGTGCCCTGACCTCCTGACCCCACGGTCTGA | 378 |
| | 2 | MCMSTTASYRQYQC* | 379 | ATGTGTATGTCAACAACGGGTCAGTACGTCAGTACCAGTGTTGA | 380 |
| | 3 | MGQVGV* | 381 | ATGGGCCAAGTGGGTGTCTAG | 382 |
| | 4 | MAPTYISHRPPRLSVPAWREALEERWGDLASSREEAKGDAREAKRCKVRGLRLGTVRSPDSQLS* | 383 | ATGGCCCCCACTTACATCTCCCACGACCCCCCGGCTCAGTGTCCTCAGTCTGCTCCGGAGGGAGGGCCTGAGGAAAGTGGGGAGATCTGGCTTCAAGCCGGAGGAGGCCAAGGGAGATGCTAGGAGGAGCCAAGAGGTGTAAGGTCAGAGGCTTGAAGGCTGGGAACGGTGAGGAGCCCTGACTCACAGCTCAGCTGA | 384 |
| | 1 | MGTLRSRWPAGTRVPPDLRVLWRGNFPERVPEFPERWFLDCSLEGELCRPCALPVFLSTKQTRLFNWWVLLFQSW* | 385 | ATGGGGACACTAAGGTCAGTGCCGCGGGGACTCGGGTCCGCGATTGCGAGTGTTATGCGGGGCAACTTCAGAGAGGTGCCTGAGTTTCCGAACGGTGTTTCTGGATTGTTCTTTGGAAGGTGAATTATGCAGGCATGCGACCTGTCTCCTGTCTACAAAGCAAACCAGATTGTTCAACTGGTGCGTGCTTCTTTCCAGTCCTGGTGA | 386 |
| hsa-mir-193a | 2 | MACQLSREGA* | 387 | ATGGCGCGAAACTTTCCAGAGAGGGTGCCTGA | 388 |
| | 3 | MQAMRTACLPVYKANQVQLVGASPPVLVN* | 389 | ATGCAGGCCATGCGCACTGCGCTGTCTCCTGTCTACAAAGCAAACCAGATTGTTCAACTGGTGGGTGCCTCTTTTCCAGTCCTGGTGAACTGA | 390 |
| | 4 | MTLPTSSLG* | 391 | ATGACACTCCCACATCATCTCTAGGATAA | 392 |
| hsa-mir-193b | 1 | MGTGEGRWRRGSARFSRDSARDACLGCDCRRRCRHPGSPSDPSPAPQRGV* | 393 | ATGGGAACGGAGAGGGGAGGTGGCGCGGGGGAGCGCGGCGTTCTCGGGACTCGGCGCGAGACCCTTGCTCGGCTCGATTGCCGCGCTGCCGCCACCCGGCTCCCCCTCGGACCCCTTCCCGCTCCCAGAGRGGCGTGTGA | 394 |
| | 2 | MPRAEQAGRARRSTCARAPLAWAAAPAGAGPPRGSRTSREPPSESYRRPLKLSAPSPREAGSPGALALASAGRGQKN* | 395 | ATGCCGCGCGCAGAAGCAGCTGGCAGGGCGCGCCGCTGCGCTCCACGCGTCGCTCCACGCGTCGCGCGAGCGCGCTGCCATGCGGGAGGGCGCCTGCGGGGCGCCGCGATCGCCGGATCAGCCGGGAACCACCGTGCGTCCCAGAGAGTTACCCGGCGCCCCCTAAAGTTGTCAGTCCCTCCCCGAAGGCAGGGCGCGTTAGCTCTGCAGGACGGGGGCAAAAAACTAG | 396 |
| | 3 | MCGGACGGGRAPGIPD* | 397 | ATGCGCGGCGCGGCTGCGGGCCGGGCCCGGGGATCCCGGACTAG | 398 |
| | 4 | MRRLCPLRTHPYL* | 399 | ATGCGCCGCTTATGTCCTCTGAGGACACATCATATTATAA | 400 |
| hsa-mir-196a-2 | 1 | MPGLDGVGTGHLECCKFSVSSPNFFSIFF* | 401 | ATGCCTGGCTTGGATGGTGTTGGAACAGGGCATTGGAATGTTGTAAGTTTTGTTTCCTCTTTAATTTTTCTTTCCATTTTTCTAG | 402 |
| | 2 | MALEEQGIWNVVSFLPLLIFSFPFFSS* | 403 | ATGGCTTGGAACAGGGACATTGGAATGTTGTAAGTTTCGTTCCTCTCTTTAATTTTTCTTTCTCATTTTTCCATTTTTCTAGTTAA | 404 |
| | 3 | MSGWEISVCVARGFLLKGNVALVGFHCNFG* | 405 | ATGAGTGGCTTTGGGAAATTTCTGTGTCGCGGCAAGAGGTTTTCTCCTGAAAGGGAATGTGGCTTTGGTTGGATTCACTGTAATTTGGTTGA | 406 |
| | 4 | MWLWLDFTVILVERKPSQSSSSGFKJHFCCRSWGPSGSFSDTWGKNVEETGAGEEKLRGTTFPEKL* | 407 | ATGTGGCTTTGGTTGGATTCACTGTAATTCTTGTCTGTAGGAGCTGGGAGCTGGGGGCCTTCAGGATCTTTCTCTGATACTTGGGGAAGAATGTGGAAGAAACCGGGAGCAGGGAGGCAGGGGAGGAAAAGCTGAGGGGAACGACTTTCCTGAAAAGTGTAG | 408 |

Figure 1 (Continued)

| | | | | | |
|---|---|---|---|---|---|
| hsa-mir-197 | 1 | MGDLAPQN* | 409 | ATGGGAGACTTGGCACCACAAATTAG | 410 |
| | 2 | MAFYYKQVKEERHLLWLGSESVPTHKFPLCKGLALIAS* | 411 | ATGGCATTTTATTATAAGCAAGTGAAGGAGGAGAGACATCTGTTGTTGGCTGGGTCTGAATCTGTTCCAACTCATAAGGGCTTGGCACTGATAGCCAGCTAG | 412 |
| | 3 | MQPALCVWAALWTSLVTLLPDHSSRLCTEREG* | 413 | ATGCAGCCAGCTCTGTGTCTGGGCCGCACTATGGACTTCACTAGTAACCCTTTGCCAGATCACAGTAGTAGACTTTGTATAGAAGAGAAGGTTGA | 414 |
| | 4 | MDFTSNPFARSQ* | 415 | ATGGACTTCACTAGTAACCCTTTTGCCAGATCACAGTAG | 416 |
| hsa-mir-199a-1 | 1 | MFQARACSMRHHQPRGLLNAGRCCI* | 417 | ATGTTCCAGGCCAGAGGTGTAGCATGCGCCACCAGCCCACCAGCCCCGGGGCTTCTCAATGCTGTGTCGTGCTGTATGA | 418 |
| | 2 | MLVAAVYEPHCRPPVVRHSVPATLPSMMLPEYPTWVPTPGPSEDRATA* | 419 | ATGCTGGTGGCTGCTGTGTATATGAGCCCATCTGCCGGCCCTTCCCGTCCGTCACTCTGTCCCAGCCACGCTGCCTCCCTGAGTGTCCCTGAGTATCCACCTGGTTCCTACCCCAGGGCCTTCGGACGACCGGGTACTGCCTGA | 420 |
| | 3 | MSPSAGPSPSVTLSQPRCPP* | 421 | ATGAGCCCATCTGCCGGCCCTTCCCGTCCACTCTGTCCCAGCCACGCTGCCTCCCATGA | 422 |
| | 4 | MAPSCPNSTRTLPTSILLFPHTTRHVSCAC* | 423 | ATGGCTCCTCCTGCCTGCAACTCTACCCGACATCCTCCCAACTCTACCGTCACGTTCTGCCTTGTTGA | 424 |
| hsa-mir-199b | 1 | MWPQPRLPPRPAMSEETRQSKLAAAKKKVKCTGSRPPDPAPAPLRWQDHGQSLCHS* | 425 | ATGTGGCCCCAAGCCCGCCTCCTGCCGCCCAGCCCAGCCCGCCAGCGAGGAAACCCGACAGAGCAAAGTTGGCCGCAGGAAGAAGGTAAAGTGCACCGGTCGCCCCCCGACCCCAGCCCCAGCTCACTCCGATGGCAGGACCATGGGCAGAGTCTCTGCCACTCCTGA | 426 |
| | 2 | MAGPWPESLPLLRHTGLGSPRRVRAPSTKVLSASPAPSAAQPPPSPVAPG* | 427 | ATGGCAGGACCATGGCTCAGAGTCTCTGCCACTCCTGAGGCACACCGGGCTGGCTCCCGCTCAGCCTCGCCCAGCCACACCAAAGTGTGCTGAGCAAGTCTGTCCAGCCTGCTCCTGCGGCCGCCCCGGAGCCCAGCCCAGCCCGGCCACTCGCTCCAAGCCCCTGGGCAGTCTTTGAGCTGGCCTCCCAAGGAACTAGGACCCCAGCAATTCAGCGCTGCCCCTGCCAGTGACTTTGGGCCCGTGA | 428 |
| | 3 | MARVSATPEAHRAGLPTARPGSLHQSLVSQPRPLSRPAPALASRPRVTLGWCSRGSPLQTRPSPPAPRSPTSLGSLGWRLQGPRTPAIQPLPSPVTLGP* | 429 | ATGGCTAGGGTGTCTGCCACTCCTGAGGCACACCGGGCTGGCCTCCCACTCCGCCCGGGGCTCCCCAGCCAAGCCCAGGGAGTCTGAAGGGCACGGGTTCCCGCTCGGGTTGCACCAGCCTCGCCCCAGCCCAGCAGTCGCCCCGGGGTCACTTTGGGCTGTGTCGCGGCCTCCGGCAGCCTGCCTTCCCCCAGAAGTGCACTGGCCAGCCAATCCACGCCAAGCTCCCAAGGAACTAAGGACCCCAAGGAACTGGAAGCCTCCACATCATTGGAATCTCCAGTGATGTGGCCTCTGGG | 430 |
| | 4 | MFPLGVECSDYTIPLGTVISCARPVFDLRTQSPKCSRPASGSSGHSINFQLEGDWGLWPLCGRGFRLPYTLMIDIDSVKSLHFTRELKTLAVSLGGNVRTGLVWFSPRLLLSRETLTFFSDFSTSYSNSPWFWDQSALQWSLE* | 431 | ATGTTCCCCCTAGGAGTGGAAGTAGTAGACTTTGATCTTAGGACCCAGTCACAATCCCCCTGCGACTCACTGCAACCGTAATTAGGTCGCGAACAGCCAGCTCTTTGTCACGATCAAGTGCCAGCTCTGTTCCTCCTGGTTCCTCTGGTCACAGGATAAATTCCAGCTGGAAGGGGATTGGGGACTATGGACCTAGGAGGGAGCTTCAGCTGCTTCTTACAGCATAACATAGACATTGACAGTGTTGAAAAGCTCCAGGACTTCACCCTTGCCATTTGCACCCTTGCACCCTTGCACCCTCCGGACCCTTGCCATTTTGCACCCTGCTTACCATTGGCAGTATCTCTGGCTACTCTCCAGAGAGGCCAATGTGAGAACCTACACTTTCACCCTGCAGGTTCCATTGGTTTCTCCACCTATATTCCAATTCTCCAAGTTCTGGAAATTCCAAGTTCTGGAATGA | 432 |
| hsa-mir-19b-2 | 1 | MKKGRKPTCASDSRWRNDCGFRCHHR* | 433 | ATGAAAAAGGGAGGAAGCCCACCTGTGCGAGTGACTCGGTGAGAAATGATTGTGGTTTCGTTGCATCCACCGGTGA | 434 |
| | 2 | MIVVFVASTADS* | 435 | ATGATTGTTGTTTCGTTGCATCCACCGGTGACTCCTGA | 436 |
| | 3 | MAPLSSSGLWAATFLVTMVEREGSGFILHPFPPSLPPACLPGLSSSDPACSLVSDL* | 437 | ATGGCGCCTTGTCCTCTTCTGGCTTTGGCCTGCCACATCACCCTGGTAACAATGGTGGAAAGGGAGGGGTCCGGCTTCATTTGCACCCTTCCTCCTTCCCCTCGCTTGCCTTGCCTTGCACCCTCCAGGCTTCTCTCGACCCAGCGTGCTCACTGGTCTCTGATTTGTAA | 438 |
| | 4 | MLNSLIVRLKLRHHFLQSAVGLWP* | 439 | ATGCTTAATTCCATTTGATTGTGGTCTTAAACTAAGACATCATTTTATTCTACAGAGCGCGTCTGGCGCTTTGGCCTTGA | 440 |

Figure 1 (Continued)

| | | | | | |
|---|---|---|---|---|---|
| hsa-mir-200a | 1 | MGCRQPGQRPGELRSLQTQAGAGPSPPQGKVGPCADA AGFRVWSHLGPTGCVFRARAQCVGSRHGVPSGQGLGR GQAPRGVTFLPPT* | 441 | ATGGGCTGTCGCCAGCCTGGCCAGCCTCCCAGGGAGCTCCGGTCACTGCAGACACA GGCTGGACGCGGTCCTTCCCCCCCAGGGAAAGGTTGGGCCCTGCTGCAGATGCGG CTGGGTTCGGGTGTGAGCCATCTTGGACCCAGGCTGCGTCTTCCGGGCACGGG CACAGTGTGTGGGCTCCAGGCATGGGGTGCCCAGGGCAGGGCCTGGGCAGAGGG CAGGCTCCGAGAGGGCTCACGTTCTTGCCGCTACCTGA | 442 |
| | 2 | MRLGFGCGAILDPRAASSGHGHSVWAPGMGCPQGRAW AEGRLREGSRSCRLPDSRPSRKFSPEAATAVLRHFVRRR EAVASEVGA* | 443 | ATGCGCCTGGGTTCGGGTGTGAGCCATCTTGGACCCACGGGCTGCGTCTTCCGGG CACGGGCACAGTGTGTGGGCTCCAGGCATGGGGTGCCCAGGGCAGGGCCTGGGC AGAGGGCAGGCTCCGAGAGGGTCACGTTCTTGCCGCTACCTGACAGCAGGCCTT CTAGAAAGTTCTCTCCAGAAGCAGCCACCGCCGTCCTGAGGGCACTTTGTGCGGAGAC GGGAAGCTGTCGCCTCAGAGGTGCGTGCGTAG | 444 |
| | 3 | MTASPLGSGVCGGKGLVSAPSGQRPAEPMGGEVGAWG RGWSGTGGAQPGEAGAGSQAPRYDWGGGNVSREVFY LNVKRLSTVAAAGNKVRPTEAQP* | 445 | ATGACCGCGTCTCCTTGGGCTCTGGAGTCTGCGGTGGAAGGGCTTGGTTTCAGCA CCCTCTGGTCAGGAGCCCGGCCGAGCCATGGGCGGTGAGGTTGGTGCCTGGGTCG TGGAAGCTGGTACAGGTGGGGCTCAGCCGAGAAGCTGGAGCGGTTCCCAGG CCCGGCGCTATGACTGGGGTGGGGGCAACGTGTCTCGTGAGGTTTTTACTTAAATG TGAAACGGCTCAGTACGGTGGCCGCAGCCGGCGGGAACAAGGTCGCACCCGGAGGCC CAGCCTTGA | 446 |
| | 4 | MTGVGATSLVRFFT* | 447 | ATGACTGGGGTGGGGGCAACGTCTCGTGAGGTTTTTACTTAA | 448 |
| hsa-mir-200b | 1 | MGCRQPGQRPGELRSLQTQAGAGPSPPQGKVGPCADA AGFRVWSHLGPTGCVFRARAQCVGSRHGVPSGQGLGR GQAPRGVTFLPPT* | 449 | ATGGGCTGTCGCCAGCCTGGCCAGCCTCCCAGGGAGCTCCGGTCACTGCAGACACA GGCTGGACGCGGTCCTTCCCCCCCAGGGAAACCGGTTGGCCCCTGCTGCAGATGCGG CTGGGTTCGGGTGTGAGCCATCTTGGAGCCCAGGCTGCGTCTTCCGCGCACGGG CACAGTGTGTGGGCTCCAGGCATGGGGTGTCCCAGGGCAGGGCCTGGGCAGAGGG CAGGCTCCGAGAGGGTCACGTTCTTGCCGCTACCTGA | 450 |
| | 2 | MRLGFGCGAILDPRAASSGHGHSVWAPGMGCPQGRAW AEGRLREGSRSCRLPDSRPSRKFSPEAATAVLRHFVRRR EAVASEVGA* | 451 | ATGCGCCTGGGTTTCGGGTGTGAGCCATCTGTGAGCTCCAGCCATGGGGTGCCCGG AGAGGCACAGTGTGGTGGCTCCAGGGGTCACGTTCTTGCCCGCTACCTGACAGCAGGCCT AGAGGCAGGCTCCGAGAGGGTCACGTTCTTGCCCGCTACCTGACAGCAGGCCTT CTAGAAAGTTCTCTCCAGAAGCAGCCACCGCCGTCCTGAGGGCACTTTGTGCGGAGAC GGGAAGCTGTCGCCTCAGAGGTGCGTGCGTAG | 452 |
| | 3 | MTASPLGSGVCGGKGLVSAPSGQRPAEPMGGEVGAWG RGWSGTGGAQPGEAGAGSQAPRYDWGGGNVSREVFY LNVKRLSTVAAAGNKVRPTEAQP* | 453 | ATGCGCGGTCTCCTTGGGCTCCTTGGAGTCTGCGGTGGGAAGGCTTGGTTCAGCA CCCTCTGGTCAGGAGCCCGGCCGAGCCATGGGCGGTGAGGTTGGTGCCTGGGTCG TGGCTGGTCTGGTACAGGTGGGGCTCAGGGCTCAGCCGGAGAAGCTGGAGCGGTTCCAGG CCCGGCGCTATGACTGGGGTGGGGGCAACGTCTCGTGAGGTTTTTACTTAAATG TGAAACGGCTCAGTACGGTGGCCAGCCGGCGGGAACAAGGTCGCGACCCACCGGAGGCC CAGCCTTGA | 454 |
| | 4 | MTGVGATSLVRFFT* | 455 | ATGACTGGGGTGGGGGCAACGTCTCTGTGAGGTTTTACTTAA | 456 |
| | 1 | MGAALRGGRGRRRRRRGGD* | 457 | ATGGGGGCCGCCCTCCGGGGTCGGGCCGGCCGCGTCGTCGGGGCGCGGA CTGA | 458 |
| | 2 | MDRRDGSEVGHEASRKKLQRTRTRVPEPGVGGFRNRR EVGNGKGVW* | 459 | ATGGATAGGAGAGATGGCAGCGAGGTGGGGCATGAAGCCTCCAGGAAAAAGCTCCA AAGGACCAGAACACCGGGTTCCGAGCCTGGGGCATGAAGCCTCCAGGAAAAAGCTCCA AAGTGGGAAACGGGAAAGGGAGGGTGGGTAG | 460 |

Figure 1 (Continued)

| | | | | |
|---|---|---|---|---|
| hsa-mir-200c | 3 | MAARWGMKPPGKSSKGPEHGFRSLGLGALGHDGKWET GKGCGRWKEGLWLMNLGETEAWAKRGPPLRRAGGFP AWKREGHVFVTVFIPLLQVTSDPVFPIPDIVISWRGHWG PVVWVIPKLVRRKTGTQKGELGRKGFWEDGNGELSNL TGTPGKLRPPPSTLQFPERPLPLEL* | 461 | ATGGCAGGCGAGGTGGGGCATGGCAGGCTCCAAGAAAAGCTCAAGGACCAGAACA CGGGTTCCGGAGCCTGGGGTTGGGGGCTTAGGAGTGAATAGACGGGAAGTGGAAGCGG GAAAGGGTGTGTAGGTGAAAGAGAGGTCCATTTGTGAAGAGGATTGTGGCTGATGAACCGGAGTTTCCAGGT GGAAGAGGGAAGGCCATGTCTTTGTGACGGTTTCATTCCCTACTGCAGGTCACCT CTGACCCTGTTTCCCTATCCCAGACATAGTTATTTCTTGGAGAGGGCACTGGGCC CAGTAGTGTGGGTTATCCCAAAACTAGTGAGGAGGAAAACAGGAACACAGAAGGGG GAGTTGGGAAGAAGGCTTCTGGAGGATGAAATGGAGAATTGAGCAACCTTAC AGGCACTCCAGGCAAGTTGCAGCCTCCACCCTCCAATTTCCGGAGCGTCC GCTGCCCCTGGAGCTGTGA | 462 |
| | 4 | MEMEN* | 463 | ATGGAAATGGAGAATTGA | 464 |
| | 1 | MRARGCGGMGVGAAEPQRCLCPQARCPWPRRSRPWW RTCCTCWWAAWTGGTSVLSPWLGGRAGPSSWTPTWTC PSGSWCTGSSQWPPATPL* | 465 | ATGAGGGCACGTGCTGTGGGGCATGGAGTGGAGGCTGCAGAGCCACAGCGCTG TCTGTGCCCGACGCTGTGTGGCGTGGAGCGGAGCCGCGGCCGGCGGCCGTGGTGGAGGA CCTGCTGTACGTGCTGCAGGCACGTCGTGGCGTGGCGTGGCAGGAGTACGTCAGTCAGCGCCTGG CTGGGGAGGCAGAGCCGGACCTGCACAGGATCCTCCAGTGGCCGCGAGCCAGTACTCGCTGTA GAGCTGGTGCACAGGATCCTCCAGTGGCCGCAGTACTCGCTGTGA | 466 |
| hsa-mir-202 | 2 | MTMGTSASLLKRAPALVTTPCPTQFWRVCESPSRVLTH LLLGQKFPSGMWGSSESFASCLG* | 467 | ATGACCATGGGGACGTCTGCATGCGCTTCTAAAGAGAGCGCCGCTTGGTGACAACT CCGTTGCCAACTCAGTTTGAGGGTCTGTGAGTCACCATCCAGGTCCTGACTCAT CTCCTCCTGGGGACAAAAGTTCCCCTGGGATGTGGGGTTCAAGTGAGTCATTTGCT TCCTGTTTGGGATGA | 468 |
| | 3 | MRLRISDIVCACSLPF* | 469 | ATGAGACTCAGAATATCGACATTGTATGTGCCTGCAGCTTGCCTTTTGA | 470 |
| | 4 | MCLQLAPLRKSDSPSSRFIEEKSSPEYGQVNHALAAAMR TLVKEHLILVSQLEQLHRQGLLSLQELWFVIQPAMRTM DILASLGACPPGGHGAVVGGRC* | 471 | ATGTGCCTGCAGCTGGCCCTGCTTCGTAAGAGTGACAGTCCTTCCAGTTCATTG AAGAGAAGTCTTCCTGTGAAGGAGCACCTGAATCGGCAGGTGAACCACCGCTGGCCGTCGCATG CGCACCCTGGTGAAGGAACACCTGATTCTGGTGTCACAGCTGGAGCAGCTGCACAG GCAGGGCCTCCTTCGCTGCAGAAGCTCTGGTTCTACATCCAGCCAGCCATGCGCAC CATGGACATCCTGGCCAGCCTCGGGGCCCCCGGGGGACATGGGGCAGTGTGG TGGGTGGCAGGTGTTGA | 472 |
| hsa-mir-203 | 1 | MARAVGPERRLLAVYTGGTIGMRSELGGESETLGGVG LWTWPRPGASDPPAFTGVVGESNPRLLDGGCGLRSLSSG SGHRRPHAWSPDLDRGHGCGGFPSPRSCSRERPATLGPGP LCCRCAPEGQRPEVLEYGAGGPQGIGLPLLLWTQKA* | 473 | ATGGCGCGCGTGGGTGGGGGCCGAGCGGGAGGCTGCTGGCCGTGTACACCGGCGGCCAC CATTGGCATGCGGAGTGAGCTCGGGGAGGTGAGCCGGAGACCCTGGGCGTCGGCGGGGTAGGCC CTGACCTGCGCCGACCCGGCCGGAGCCTCGCGGAGCTGAGGGCGTGCGGCGGTGTTG GGGAGTCAAATCGCGCCTGCCGGTGATGGGGGTGCGGTCGGAGGAGATTGCGG TCCGGCCACCGGGCCTCGCCGTCCGCCATGGAAGGCTTCCGGGAACGCCTGAGCCGGCCAGCCGG TGGGTTCTGCGCTGCCGCTGCGCGGCCCAGCGTCCGCCATTGGCCTGCGCTCGAAGTCTGGACAGAAGGCTAG GGGAGGGCCCCAGGGCATTGGCCTGCCGCTCCTGCTCTGGACAGAAGGCTAG | 474 |
| | 2 | MGGAG* | 475 | ATGGGCGCGGGCTGA | 476 |
| | 3 | MEPRPGQRRLRWVLAVLPGAPCDPGARPPVLRPF* | 477 | ATGGAGCCCGACCTGGACAGAGGAGGATTGCGGTGGTTCTCGCCGTCGCGGTGCT CCCGGGAGCGCCCTGCGACCTGGGGGCCAGGCGCCGGCCCCCTGTGCCGCTGCGCCCTG A | 478 |
| | 4 | MGREGPRALACRSCSGHRRLRRLPWRRLRRLRGPLNCD TQHGVPVPWGPGQAAVVGTILGLPGICGDARVHTRGGL RALLPLCGPG* | 479 | ATGGGGGAGGGCCCGAGGGCGCTGGCCTGCCGCTCGTGCTCTGGACACAGAAG GCTTAGGAGGCTGCCCTGGAAGGCTTAGGAGGCTGCCCTGGAAGGCTTAGAGCGTCGAGAGGACCCTCAACTGCG ACACCCAGCACGGGGTGCCCGTACCTGGCATCTGGGGGTCCAGGTCAGGCAGCAGTGGTTGGC ACGATACTGGGGCTACCTGGCATCTGGGGGACGACGCACGTGTTCACACCCGAGGTGG CCTCAGAGCCCTGCTTCCTGCCCCTGTGTTGA | 480 |

Figure 1 (Continued)

| | | | | | |
|---|---|---|---|---|---|
| hsa-mir-206 | 1 | MELKNEGEMGGQGTNWGMTAYSVRIGNAHKGQMKM BSLCYIRRLAHTKIRVKGEGGKGKRE* | 481 | ATGGAACTAAAGAATGAAGGAGAAATGGGTGGACAGGGCACAAATTGGTGAATGA CAGCCTATTCAGTGAGGATAGGAAATGCACATAAAGGACAGATGAAGATGATTTCT CTGTGTTGATTAGAAGGATAGCAATTACAAAGATAAGAGTGAAGGGAGGGGAGG AAAGGGAAAAGGGAATAA | 482 |
| | 2 | MKEKWVDRAQKGE* | 483 | ATGAAGGAGAAATGGTTGGACAGGGCACAAATTGGGAATGA | 484 |
| | 3 | MHIKLDR* | 485 | ATGCACATAAAGGACAGAATGA | 486 |
| | 4 | MLRKSPGC* | 487 | ATGCTTAGAAATCACCAGGCTGTTAG | 488 |
| hsa-mir-20b | 1 | MKKGRKPTCASDSRWRNDCGFRCIHR* | 489 | ATGAAAAAGGGGAGGAAGCCCACCTGTGCGAGTGACTCGGCTTGGAGAAATGATTG TGGTTTTCGTTGCATCCACCGTGA | 490 |
| | 2 | MIVVFVASTADS* | 491 | ATGATTGTGGTTTTCGTTGCATCACCGCTGACTCCTGA | 492 |
| | 3 | MAPLSSSGLWAATHLVTMVEREGSGFILHPFPPSLPPAC LPGLSSSDPACSLVSDL* | 493 | ATGGCGCCTGTCCTCTTCTGGGCTTTGGCTGCCACAATCACCCTGGTAACAATG GTGGAAAGGGAGGGGTCCGGCTTCATTTTGCACCCTTCCCCTCCCTTCCTTGCCCCC GCTTGCCTTCCAGGGCTTCCTCCTCCAGCCCCAGCGTGCTCACTGGTCTCTGATTTGT AA | 494 |
| | 4 | MLNSILIVRLKLRHHFILQSAVGLWP* | 495 | ATGCTTAATTCCATTTTGATTGTGCGTCTTAAACTAAGACATCATTTATTCTACAGA GCGCTGTCCGGCTTTGGCTTGA | 496 |
| hsa-mir-21 | 1 | MLVGEILVFKGLLDGVNFLFFFH* | 497 | ATGTTGGTTGGGGAGATTTTGGTTTTAAGGGTTGTTAGATGAGTAAATTTCTT TTTTTTTTTTAA | 498 |
| | 2 | MCLFLWATVPCFQCCPRHRSISAEAISGVPGGSTAEASP QKRNGHTTGKTLIRFLLPSGKFRAEITFTALTHIFRQISEV GLPVFLDRS* | 499 | ATGTGTCTTTTCTTTGGCTACTGTACCCTGCTTCCAGTGCTTCTCCCCGCATAGGT CCATTCTGCAGAAAGCCATTTCAGGAGTACCTGGAGGCTCAACGGCAGAAGCTTCAC CACAAAAGCGAAATGGCACACCACAGGTAGAGACTTTAAGATCCGGTTTCTTCTCCCT CTGGAAGTTTCGGGCTGAAATTACATTCACAGCTCTCACTCACATTTTTAGGCAAA TAAGTGAAGTTGGTTTGCCAGTGTTCCTTGACAGAAGTTGA | 500 |
| | 3 | MGITPQVRL* | 501 | ATGGGCACACACCAGGTAAGACTTTAA | 502 |
| | 4 | MLYWEICLCLRLESVTSVHLLLKTRVEPMESNGSVT* | 503 | TTCTCCTAAAAGAAATTTGTCTTTGTCTTAGACTAGAAAGTTAACTTCTGTTACAATC TTCTCCTACTGGGAAATTTGTCTTTGTCTTAGACTAGAAAGTAACTTCTGTTACATAG | 504 |
| hsa-mir-210 | 1 | MRVGRGGRRRRRGSAELRTGRGGHEGAKRHCLGPAF PGIA* | 505 | ATGAGGGTGCGGCGGGGACGGGGTGGGGGATCGGAGGAGGTGCGAAGCGCGGGT TCCGCGGAGCCTGA | 506 |
| | 2 | MCARRPHLQSHL* | 507 | ATGTGTGCCGCGCCGGCTACACCTGCAGTCACACCTGTAG | 508 |
| | 3 | MALAPER* | 509 | ATGGCCTTGGCTCCTGAGAGCGTAA | 510 |
| | 4 | MPVPERPAAGPDSPRPGTRRAAPRVLFGEWLLGEISSGC YEGLQWLDEARTCFRVPWKHFARKDLSEADARIFKVG TPAPPRPCGWESPPRTPRARHTCSVPLFRPGLWPAAGGRL AAGEVARPPRLRLRSAPAGKPTSAAHCAARVAS* | 511 | ATGCCAGTCCCCGAGCGCCCGGCCGGCTCCGCGCCGGCACCCGC AGGGCAGCCGGGCCCCGGAGATCAGCAGGCGG CTGCTATGAGGGGCTGCCAGTGCTGGACTGGAGACGAGGCCCGACCTGTTCCGCTGCCTG GAAGCACTTCGGCGTGCGCAAGGACCTGAGCGAGGCCGACGCGCGATCTTCAAGGTGG GACACCGCAGCCGCCTCGTCTCCCCCCCTGCAGCCTGGGCTGGCCCCGGCAGGTGGCC CGCCTAGCAGCAGGGAGGGCCCGCCCCCCGCACTGCGCAGCCAGCCGCGAGCGCCGCC GGCTGGAAAACCAACTTCGCTGCGACTCGGCAGGAGCACGCGTCGCTTCGTGA | 512 |
| | 1 | MTSHKPLVRWLLSCSSSCLEWPGASIVSSIVCPAHSPA GTHTGRVRAVRRPGRLAPARHFSPPLPLPSAERGHQPC GLGTGEGPAALWSGSPGRPARTRRRSRR* | 513 | ATGATCACGTCCACAAGAAGCCTTGGTGCCGTTGTTGAGCTGCAGCAGC TGCCTGCGGAGTGCCGCGGCGGCTCCAGCATCGTCGTCCAGCATCGTCGTCCAGCACACTCT CCTGCGGTGGACACACACCGCCGGTGACGCCCGTGACGCTGCTGAGGCCCTGGCC CCAGCCCCGGACACTTCTCCCCCACTTCCTCCCCAAGGAACCTGCCCTCGAGCATCA GCCCTGCGGCCTGGCCTGGCCCCTGAGCGCACCCTGCCCTCCGTCCGGGAGCGCCGG GCCGGCCCGCCCCCGGACCCAGGGAGGAGGGAGCAGGGAGGGGTGA | 514 |

Figure 1 (Continued)

| | | | | | |
|---|---|---|---|---|---|
| | 2 | MSASGKVIQGIGELYPSREKGSRGTSASRLGRSCPSWGK* | 515 | ATGTCTGCTTCAGGAAAAGTCATTCAGGGCGGAGAACTTTACCCAAGTAGGGAGAAAGGGAGCCGAGGAAACCAGCGCCTCCGCCTCCGGCCTCGGGAGAACTTGCCCAGTTGGGGGAAGTGA | 516 |
| hsa-mir-212 | 3 | MPHPPLPGPELCQGSAPASPARQLPPPSLPLASPAHVRAEPAPGR* | 517 | ATGCCCCACCCGCCAGTCCCCTTCCCTGCCCTGAGCTGTGCCAGGCAGCGCCCCTGCCAGCCCCGCGCCCAGTCCCCTTCCCTTGCCTCTCCAGCCCATGTGCGGCGAGAGCCGGCCCGGGCGCTGA | 518 |
| | 4 | MCGQSRPRAADPAVNPARSRGPVVYLSPKGTTPGALNASRQPRWGTRARRCTRGGCRRTRTGLSRVPRPSRSPARGPTWGACRKPRARLTADPGGTWLRCPFPAGFPVGLSCWSVLPASWSRLSPAALSAHSYLERPGPAGAAAAMAPPRGRAGLCAAGRCLPPAHLSWRRTDAEPAGRGPPYPQVRPPTCTHLGPRPRTRESQKPWGFELSAPMYVFLGTQPQFGKVLPASTGLGWWGRGYPAQE* | 519 | ATGTGCGGCCAGAGTCCGCCGGCGGCTGCTGACCCGCCGTGAACCCGGCGCGAGCCGGGGCCCGTGCTCCTGAGTCCGAAAGGACGACACCGGAGACCGGAACGCACGCCGCAGTCCCTTCCCTGCCTCGATGGGCACCCAGAGATGCCCAGAGAACGGGGCACCTGGGGGCATGTGACCCGCCCCGGGATCCGAAGGCGGATCCAGGGGGACACCTGGGGGCGCTGTCGCTGCCTCCCGCGGTCTCTGCCCGCACCCGGGGCGCGTCGGTCCGGCCCGCCCGAGGGTCTGTCCTGTCTGGTCCGTCCCCGCCGCCCGAGCCGCCCTCAGCCCGCCGCCTTCGCCACACTCTTATCTGGAGCGGCCGGCGCTGCTGCGGCGTATGCGCCACCTGCGGGCGCGGGAAGGGCTCTGCTGCGGCGGGCCGGCCGTCGCGGCGCGAGGGCCCACCCGAGTCCCCACCTCGAGCTGAGGCAGCAGATGCTGAGCGCCCCATGTACGTATTCTAGGCACACGCGAGTCCCAGAAACCTGGGGGCGCAGAAAGTCGTACCCACTGGGCGCTCCCATGTACGTATTCTAGGCACACGCGAGTCCCAGAAACCTGGGGTTTCTGCCCGAGCACGGACCTCGGGTGGTGGGGAGAGGTTATCCTGCGCAGGAGTAG | 520 |
| | 1 | MSNYTILGQYCVPLVLCFLRSPTYWNFDYLDIFVFKRGGEFA* | 521 | ATGTCTAATTATACAAATCCTTGGACAATACTGTTTTTTGGTGTCTGTGTTTTTAAGAAGTCCTACTTACTGGAATTTGACTATTTGGATATTTTGTTTTTAAAAGGGGAGGGGAATTTGCTTAA | 522 |
| hsa-mir-214 | 2 | MNLPFLPFLKYFVTILH* | 523 | ATGAATTTGCCTTTCTGCCTTTCTTAAATAGGTTCCTGTTGTTCACATATAA | 524 |
| | 3 | MRHLNRFLLFH* | 525 | ATGAGACATTTAAATAGGTTCCTGTTGTTCACATATAA | 526 |
| | 4 | MHFPPMDKVMVLIY* | 527 | ATGATAATTTTCTTTTCATGGACAAGGTTATGGTACTTATTACTAA | 528 |
| | 1 | MRLQLLTAVGALAGTIACALLTEGGAVGSELAGGAGPGWVLPFTAGGFHYVATVSYVLPELLREASPLQSLLEVLGLLGGVIMMVLIAHLE* | 529 | ATGAGGCTCTGCAACTACTGCAGCAGTAGGGGCACTGCAGGCACAGCCTGTGCCCTTCTCACTGAGGAGGAGGAGCAGTGGCAGTGAAAATTGCAGGTGCAGTCCTGGCTGGGTCTGCCATTACTGCAGGGGTCTTATCTACGGAGGTGGTGTCGTGTCAACAGTGTCGTGTGCCGAGCTGCTGAAGGAGGAGCATTCAATCATTGTGCTGATTGCCACCTTGAGCTGA | 530 |
| | 2 | MVTLALGPSRAGSLTEAGAVRMRGQRDHSVGHCLTMLHLEG* | 531 | ATGGTTACTTTGGCATTAGGGCCTTCAAGGGCTGGCAGTCTTACAGAGGCTGGAGCGGTGAGAATGAGAGCCAGAGGGACCATAGTGTTGGCGACTGTCGACCATGTTGCATTTGGAAGGCTAA | 532 |
| hsa-mir-219-1 | 3 | MKKAGRDRG* | 533 | ATGAAGAAGCTGGAAGGGACAGGGGGTGA | 534 |
| | 4 | MAAYLVSPTPPVLGEPSCYTGSSPRSSFLSPTSWWRLLQGRPESWTERVTGGVGDKHQTSIVCPDLGVIGGMGWERVSWYSHGLIFFVSIPFISLCLNRGGGVVTGNKDLRSSAPHAVFVFLGKMGPLVFSTPGAPKQQCRATFPRWEVGLRWWPQMA* | 535 | ATGGCAGCCTACCTGGTGTCCCCACCGCCACCTGTTCTGGGAGAACAAGTTGCTACACAGGAAGTTCTCCAGTTCTCTCCACCAGTTGGTGGAGGCTTCAGGGAAGACCAGAGTTCTGACAGAGACCCTGAACAGGAGGAGTCGGGATAAACATCAACATCAATCGTGTTCTCATGCCGATTTTTTTGTCTGAATTTTTTTGTCTATCCTTTTCATTCTATATCACTGTGGTTCGGAATCCAGGGTAGGGAGGGGTGTAACCGAAATAAACGACCTCGCTGCCCCACATCAGGTAGCTTCTTTTGGGGGAATGGCGCCCCTTCCACGCCACGCCGGTGGCCGGCCAGTAGTTGCGCCACGCCACGCCACACCCCGGGCCCTAAGCAAGCAAGGTTGCGGCAGCAATCCCTCAAGGTCAGGCGCCATTATCACCCGCCACCTGCGGGCGCCGGCTTGAGAGGCACCACCCCGGGCCTAA | 536 |
| | 1 | MPARSQAPCLPKAPHSPPSSPRSGPEQWDFYYLHPPDEETEAENKEVI* | 537 | ATGCCTGCCCGTAGCCAGGCCCCTGCCTGCTGCCCCAAGCACCTTGCTGCCCAAAGCACCTCACTCCCCGCCATCTAGTCCCTGCAGCGCCCTGAGCAGTGAGACTCTACTACCTCCATTTCCAGATGAGGAAACAGAGAGCTGAGAACAAGGAAGTCATTTGA | 538 |

Figure 1 (Continued)

| | | | | |
|---|---|---|---|---|
| hsa-mir-219-2 | 2 | MRKQRLRTRKSFD* | 539 | ATGAGGAAACAGAGGCTGAGAACAAGGAAGTCATTGATTAA | 540 |
| | 3 | MQPSAVAHAYNPSTLGSRDGRIT* | 541 | ATGCAGCCAGCGCAGTGGCTCATATGCCTATAATCCAGCACTTTGGGAAGCCGAGA CGGGCGGATCACCTGA | 542 |
| | 4 | MPRPALWEAETGGSPEVGSSRLA* | 543 | ATGCCTATAATCCCAGCACTTTGGGAAGCCGAGACGGGCGGATCACCTGAAGTCGG GAGTTCAAGACTAGCCTGA | 544 |
| hsa-mir-220 | 1 | MLFFPPPKVVFP* | 545 | ATGCTGTTCTTTCCGCCATTCCCAAAAGTTGTTTCCCTTAA | 546 |
| | 2 | MKTFHQGECSLTTFSLNDRNIK* | 547 | ATGAAGACTTTCCATCAAGGTGAGTGTTCTCTCACCACCTTTTCACTTAATGATAGA AACATAAAATGA | 548 |
| | 3 | MIET* | 549 | ATGATAGAAACATAA | 550 |
| | 4 | MSSDNVEKLDAFYKLQLLVFFT* | 551 | ATGAGTTCTGATAATGTTGAAAAACTAGATGCATTTTACAAGCTACAACTACTGTT TTTTCACCTAA | 552 |
| hsa-mir-220b | 1 | MGALAPVVSPVGLRRGPHPDPNAWASPSPVPRCPVAGA PGRRCGRRGEREKPLPRRCQPATQPMANPGLGLLLALG LPFLLARWGRAWGQSRYQLRALGGRGLDSWISAGDVA * | 553 | ATGGGTGCCTGGCGCAGCCTGTTCTCTCGTGGCCTGGCGCGGAGCTGCGCCACCCC GATCCCAACGCCTGGCCTCCGCGTAGGAGGCGGCAGCGGAGAAGCCCCTTCCTGGCGCTG CCAACCCGCCACCCAGCCATGGCGAACCCTGGGCTGCTCCTCTGGCGCTGG CCTGCGGTCCTGCGCCGCTGGGCCGAGCCTGGGGCCAAGTAGGTACCAG CTGAGAGCGCTGGGGGAGAGGGTCTGGATTCCTGGATCTCTGCTGGGGAACGTGCC TTAG | 554 |
| | 2 | MKGRV* | 555 | ATGAAAGGCAGAGTTGA | 556 |
| | 3 | MPKAGADGRGWERKMETELFSAFTLHSTDHFCK* | 557 | ATGCCCAAAGCAGGTGCAGATGGCGGGATGGGCGTGGAGAGAAAGATGGAGACTGAGT TATTCTCTGCCTTCACCCTGCATAGCACCGATCACTTCTGCAAATGA | 558 |
| | 4 | MGGDCRERWRLSYSLPSPSTVQITSANENSTVLPSSTSS SSDGNLVSWRYMWEDGSKDVI* | 559 | ATGGGCGGGGATGGAGAGAGATGGAGACTGAGTTATTCTCGCTTCACCCTC CACAGTACAGACCACTTCTGCAAATGAAAATGAGAATAGCACTGTTTGCTTCATCCACCAG CTCCAGCTCCGATGCAACCTGGTAGTGAGTTGGAGGTATATGTGGGAAGATGGCAGCA AGATGTTATCTAG | 560 |
| | 1 | MIEGDHNVPGVAAHVDHLCADGEERGEGVRHRQDPSP* | 561 | ATGATAGAGGGAGACCACAACGTCCCGGGGTTGCGGCCCATGTAGATCACCTGTG TGCGGATGGTGAGGAGGAGGGGAAGGCGTCAGACACAGGCAAGACCAGGCCCCCT GA | 562 |
| hsa-mir-220c | 2 | MVRRGEKASDTGKTPAPEASCPGDPSLLTLKQEGLRAD SFFFAMESDSVSPRLECSGAISAHCNLCLLGSGDSPVSAS * | 563 | ATGGTGAGGAGAGGGGAGAAGGCGTCAGACACAGGCAAGACCCCAGCCCTGAGG CCTCCGCCTGAGAACCCCTCTTCTGACCTGCACCCTCTTAAGCAGGACTCAGGCGAG ACTCTTTTTTGCGATGGAGTCTGACTCTGTTTGCCCAGCTGGAGTGCAGTGG CGCCATCTCAGCTCATTGCAACCTCCTGCGTCAGCGGTTCAGCGATTCTCCTGTGTCA GCCTCCTGA | 564 |
| | 3 | MFSRDGVLPCWLLTD* | 565 | ATGTTTAGTAGAGATGGGGTTTTACCATGTTGGTTACTCACAGATTGA | 566 |
| | 4 | MGFYHVGYSQIEEPLEDRQGLTRS* | 567 | ATGGGGTTTTACCATGTTGGTTACTCACAGATTGAGGAACCCCTTGAGGACAGGCAG GGTCTTTACAGTTCCTAG | 568 |
| hsa-mir-221 | 1 | MQSKHLHFMNYLQFK* | 569 | ATGCAAAGTAAACATCTGCATTTATGAACTACTTCAATTAAATAG | 570 |
| | 2 | MTCFGSKIC* | 571 | ATGACATGTTTTGGGAGTAAGACCTGTTAA | 572 |
| | 3 | MFWE* | 573 | ATGTTTTGGGAGTAA | 574 |
| | 4 | MWLKKCHLVDLFSLA* | 575 | ATGTGGTTATGTAAATGCATCATTTAGTTGATCTTTTTCTTAGCCTAG | 576 |
| hsa-mir-222 | 1 | MQSKHLHFMNYLQFK* | 577 | ATGCAAAGTAAACATTTGCATTTTATGAACTACTTCAATTAAATAG | 578 |
| | 2 | MTCFGSKTC* | 579 | ATGACATGTTTTGGGAGTAAGACCTGTTAA | 580 |
| | 3 | MFWE* | 581 | ATGTTTTGGGAGTAA | 582 |
| | 4 | MWLCKCHLVDLFSLA* | 583 | ATGTGGTTATGTAAATGCATCATTTAGTTGATCTTTTTCTTAGCCTAG | 584 |
| | 1 | MTKAPLH* | 585 | ATGACCAAAGCACCACTCCACTGA | 586 |

Figure 1 (Continued)

| | | | | | |
|---|---|---|---|---|---|
| hsa-mir-223 | 2 | MVSICPLFLDSQAGAESMAAKGGLDLPIPPSSDPPQGLR SKVGGRRLPLAFYPRGSNGGEKGIGYPLSNQDV* | 587 | ATGGTATCCATTGCCCTCTCTTGGATTCTCAAGCTGGGCAGAGTCCATGGCA GCCAAGGGTGGCTTGGATCTGCCCATTCCATTCTCTTCAGACCCTCCAGGGATTA AGGTCAAAGGTGGGAGGAAGAAGGCTTCCATTGACCTTTATCCTAGAGGTTCTAAT GGAGGGCAAAAGGCGATAGGCTATAGGGATATTTTCTATCCAATCAGGATGTTTAG | 588 |
| | 3 | MEGKRG* | 589 | ATGGAGGGGAAAAGGGGATAG | 590 |
| | 4 | MFRR* | 591 | ATGTTTAGGAGATAG | 592 |
| hsa-mir-23a | 1 | MSHRAQPEIHFF* | 593 | ATGAGCCACGCGCTCAGCCTGAAATTATTTCTTTTTAA | 594 |
| | 2 | MVIDHGSLKLLGSSSPPTSAA* | 595 | ATGGTCATAGATCACGGCAGCCTCAAACTCCTGGGCTCAAGCAGTCCTCCCACCTCA GCCGCCTGA | 596 |
| | 3 | MCTTTPG* | 597 | ATGTGTACCACCACTCCTGCTGA | 598 |
| | 4 | MAKPHLYKN* | 599 | ATGGCAAAACCCCATCTCTACAAAATTAG | 600 |
| hsa-mir-23b | 1 | MSHRAQPEIHFF* | 601 | ATGAGCCACGGCGCTCAGCCTGAAATTATTTCTTTTTAA | 602 |
| | 2 | MVIDHGSLKLLGSSSPPTSAA* | 603 | ATGGTCATAGATCACGGCAGCCTCAAACTCCTGGGCTCAAGCAGTCCTCCCACCTCA GCCGCCTGA | 604 |
| | 3 | MCTTTPG* | 605 | ATGTGTACCACCACTCCTGCTGA | 606 |
| | 4 | MAKPHLYKN* | 607 | ATGGCAAAACCCCATCTCTACAAAATTAG | 608 |
| hsa-mir-27a | 1 | MNLGTVISPS* | 609 | ATGAATCTGGGCACTGTAATCAGTCCATCCTGA | 610 |
| | 2 | MRSCLVLVLGCVDFLGLSQVCVGLIWTS* | 611 | ATGAGGTCCTGCCTCGTCGTCTGGTGTTAGGATGTGTGGACCCCTTAGGTCTCAGTCAG GTGTGTGTGGGGTTGATCTGGACGAGTTGA | 612 |
| | 3 | MCGPLRSQSGVCGVDLDELIRSVP* | 613 | ATGTGTGGACCCCTTAGGTCTCAGTCAGGTCAGGTGTGTGGGGTTGATCTGGACGAGTTG ATAATCAGATCAGTGCCTAG | 614 |
| | 4 | MRTLRCWMGWSTRSPPLLG* | 615 | ATGAGAACCCTGAGGTGTTGGATGGTTGGTCTACAAGGTCACCTCCACTGCTAGGA TGA | 616 |
| hsa-mir-27b | 1 | MNLGTVISPS* | 617 | ATGAATCTGGGCACTGTAATCAGTCCATCCTGA | 618 |
| | 2 | MRSCLVLVLGCVDFLGLSQVCVGLIWTS* | 619 | ATGAGGTCCTGCCTCGTCGTCTGGTGTTAGGATGTGTGGACCCCTTAGGTCTCAGTCAG GTGTGTGTGGGGTTGATCTGGACGAGTTGA | 620 |
| | 3 | MCGPLRSQSGVCGVDLDELIRSVP* | 621 | ATGTGTGGACCCCTTAGGTCTCAGTCAGGTCAGGTGTGTGGGGTTGATCTGGACGAGTTG ATAATCAGATCAGTGCCTAG | 622 |
| | 4 | MRTLRCWMGWSTRSPPLLG* | 623 | ATGAGAACCCTGAGGTGTTGGATGGTTGGTCTACAAGGTCACCTCCACTGCTAGGA TGA | 624 |
| hsa-mir-298 | 1 | MPNPGSMMTTGGV* | 625 | ATGCCCAATCTGGATCGATGATGACCACTGGTGGCGTATGA | 626 |
| | 2 | MSHT* | 627 | ATGAGTCATACATGA | 628 |
| | 3 | MMNMCLEL* | 629 | ATGATGAATATGTCTGGAACTCTGA | 630 |
| | 4 | MHSYVIBMIGSMKE* | 631 | ATGCATTCTTATGTTATTATTGGTCAATGAAGAATGA | 632 |
| hsa-mir-299 | 1 | MSWGKGAPAFGVSTCLFS* | 633 | ATGTCGGGAAAGGGAGCACCAGCATTGGTGTTTCACTTGCCTCTTTTCTGA | 634 |
| | 2 | MESNPLLPGQVLRLGILCTPVHW* | 635 | ATGGAATCCAATCCTCTGCTTCCAGGACAAGTCCTGCGCTTGGGGATCCTCTGTACG CCCGTTCACTGGTGA | 636 |
| | 3 | MYDSNF* | 637 | ATGTATGACAGCAATTTCTGA | 638 |
| | 4 | MTAISDFTSSCP* | 639 | ATGACAGCAATTTCTGATTTCACTAGTTCTTGCTTCTAA | 640 |
| hsa-mir-29a | 1 | MSWGKGAPAFGVSTCLFS* | 641 | ATGTCGGGAAAGGGAGCACCAGCATTGGTGTTTCACTTGCCTCTTTTCTGA | 642 |
| | 2 | MESNPLLPGQVLRLGILCTPVHW* | 643 | ATGGAATCCAATCCTCTGCTTCCAGGACAAGTCCTGCGCTTGGGGATCCTCTGTACG CCCGTTCACTGGTGA | 644 |
| hsa-mir-29b-1 | 3 | MYDSNF* | 645 | ATGTATGACAGCAATTTCTGA | 646 |
| | 4 | MTAISDFTSSCP* | 647 | ATGACAGCAATTTCTGATTTCACTAGTTCTTGCTTCTAA | 648 |

Figure 1 (Continued)

| | | | | | |
|---|---|---|---|---|---|
| hsa-mir-29b-2 | 1 | MGPNSGTFGTAAPYGGTKIWVCAGGDGWSDGLQDLMA* | 649 | ATGGGACCAACAAATTCTGAACATTCGGACTGCGGCACCTTACGCGCGGGACCAAGAT TTGGGTCTGCCGCAGGCGGCGGATGGGTGGTCCGACGGGCTTCAGGACTTGATGGCGT AA | 650 |
| | 2 | MGGPTGPRT* | 651 | ATGGGTGGTCCGACGGGCTTCAGGACTTGA | 652 |
| | 3 | MYLLGSGALSLCMWVLCLSHLLSRFLLFISLREGFPPL* | 653 | ATGTATTTGCTGGGATCAGGGGCGCTGTCTCTGTGTATGTGGGTGCTCTGTCTTCTC ACCTTCTTCTCGATTTTTGCTATTTATTTCTCTGAGGGAGGGTTTTTTCCACTTTAA | 654 |
| | 4 | MWKVRE* | 655 | ATGTGGAAGGTAAGGGAGTGA | 656 |
| hsa-mir-29c | 1 | MGPNSGTFGTAAPYGGTKIWVCAGGDGWSDGLQDLMA* | 657 | ATGGGACCAACAAATTCTGAACATTCGGACTGCGGCACCTTACGCGCGGGACCAAGAT TTGGGTCTGCCGCAGGCGGCGGATGGGTGGTCCGACGGGCTTCAGGACTTGATGGCGT AA | 658 |
| | 2 | MGGPTGPRT* | 659 | ATGGGTGGTCCGACGGGCTTCAGGACTTGA | 660 |
| | 3 | MYLLGSGALSLCMWVLCLSHLLSRFLLFISLREGFPPL* | 661 | ATGTATTTGCTGGGATCAGGGGCGCTGTCTCTGTGTATGTGGGTGCTCTGTCTTCTC ACCTTCTTCTCGATTTTTGCTATTTATTTCTCTGAGGGAGGGTTTTTTCCACTTTAA | 662 |
| | 4 | MWKVRE* | 663 | ATGTGGAAGGTAAGGGAGTGA | 664 |
| hsa-mir-300 | 1 | MPNPGSMMTTGGV* | 665 | ATGCCAATCTGATCGATGATGATCCACTGGTGGCGTATGA | 666 |
| | 2 | MSHT* | 667 | ATGAGTCATACATGA | 668 |
| | 3 | MMNMCLEL* | 669 | ATGATGAATATGTGTCTGGAACTTGA | 670 |
| | 4 | MHSYVHMGSMKE* | 671 | ATGCATTCTTATGTTATTATGGTCAATGAAAGAATGA | 672 |
| hsa-mir-30b | 1 | MTDAAEAAFSVRTPPIPSSRRAPCPPPLARPSPWRWRVP APSPPAAPGAPRARGAGRWEREGGRGGPAASSPDPRP RAR* | 673 | ATGACGGACGCGGCGGAGGCGGCTTTCTCAGTTCGGACGCCGCCGATCCCCAGCTCT CGCCGCCGCCCTGCCCGCCCGCCCCTCACCCTGCGCTGCCGCCGGGCG CCCGGAGCGGGAGGGTGGAGGCGGTGGGGCGCGCGTGGGGCTCGGCTCGGCGCGGGGCG CTGGAGCGGGAGGGTGGAGGCGGCGGCAAGCTGGGCCCCTCCGCCGACCCCC GACCCCGGGCCAGGTGA | 674 |
| | 2 | MGRAAGGRWAPPRGS* | 675 | ATGGGCGCGGCGGCGGGAGGCGCAAGCTGGGCCCCTCCGGGCTCGTGA | 676 |
| | 3 | MFIRQLQETLPSGRGALLFAGASESGGPHSKTRVKPGW TGRE* | 677 | ATGTTTATCCGGCAGTTGCAAGAACTCTGCCTGCCGGGACGAGGCGCCTTGCTTTT GGCGGGGCAGCGAAAGTGGCGAGATTTCACAGCAAAACTCGGGTGAAGCCAGGCTG GACCGGCGGGAGTGA | 678 |
| | 4 | MGTRDERIRLCVAPGHDVCTLLCQCLMFVAYGYFRTK* | 679 | ATGGGGACCAGAGAGATGAACGAATCCGCTCGTGTGTAGCACCAGGCATGATGTGTG CACGTTGCTATGCCAGTGTTAATGTTGTGTGCTTATGGTTATTTAGGACTAAGA | 680 |
| | 1 | MTDAAEAAFSVRTPPIPSSRRAPCPPPLARPSPWRWRVP APSPPAAPGAPRARGAGRWEREGGGRGGPAASSPDPRP RAR* | 681 | ATGACGGACGCGGCGGAGGCGGCTTTCTCAGTCGGACGCCGCCGATCCCCAGCTCT CGCCGCCGCCCTGCCCGCCCGCCCCTCACCCTGCGCTGCCGCCGTC CCCGGAGCGGGAGGGTGGAGGCGGTGGGGGCGCGCGGTGGGGCTCGGCGCGGGGCG CTGGAGCGGGAGGGTGGGCGGCGGCAAGCTGGGCCCCTCCGCCGCCGACCCCC GACCCCGGGCCAGGTGA | 682 |
| hsa-mir-30d | 2 | MGRAAGGRWAPPRGS* | 683 | ATGGGCGCGGCGGCGGGAGGCGCAAGCTGGGCCCCTCCGCCGGGCTCGTGA | 684 |
| | 3 | MFIRQLQETLPSGRGALLFAGASESGGPHSKTRVKPGW TGRE* | 685 | ATGTTTATCCGGCAGTTGCAAGAACTCTGCCTGTCCGGGACGAGGCGCCTTGCTTTT GCCGGGGCCAGCGAGTTGCAAAGTGGCGGAATTTCACAGCAAAACTCGGGTGAAGCCAGGCTG GACCGGCGGGAGTGA | 686 |
| | 4 | MGTRDERIRLCVAPGHDVCTLLCQCLMFVAYGYFRTK* | 687 | ATGGGGACCAGAGAGATGAACGAATCCGCTCGTGTAGCACCAGGCATGATGTGTG CACGTTGCTATGCCAGTGTTGTTGTTGCTTATGGTTATTTAGGACTAAGTGA | 688 |
| | 1 | MSHRAQPEHFF* | 689 | ATGAGCCACCGCGCCTCAGCCTGAAATTATTTCTTTTTAA | 690 |

Figure 1 (Continued)

| | | | | |
|---|---|---|---|---|
| hsa-mir-32 | 2 | MVDHGSLKLLGSSSPPTSAA* | 691 | ATGGTCATAGATCACGGCAGCCTCAAACTCTGGGCTCAAGCAGTCCTCCACCCTCAGCCGCCTGA | 692 |
| | 3 | MCTTTPG* | 693 | ATGTGTACCACCACTCCTGGCTGA | 694 |
| | 4 | MAKPHLYKN* | 695 | ATGCAAAACCCATCTCTACAAAAATTAG | 696 |
| hsa-mir-320 | 1 | MLPGREGATRSPEGTDTRTLAEPHPLAFRSPSRCVPPVASQLLPSHVARLPGPPR* | 697 | ATGTTGCCTGGGAGAGAAGGGGACGAGATCACCAGAGGGGACTGACACGCGGACCCTGGCGGAACCCCACCCCCTGGCTTTCGGTTCCGGTCGCGTCCTCCAGTGGCCCTCAGCTCGCCCCCACGTGGCCAAGTCCCGGAACCACCCAGGTGA | 698 |
| | 2 | MLRRSGYLASGRWRGGAKIRVPGFVGHHAAM* | 699 | ATGCTGCGCGCGCTCGGGGGGTCTTGGCCTCCGGCGGTGCGTGGAGGCGCCAAGATCAGGGTCCGGGTTTTGTCGCCACCAGCCCGCAATGTGA | 700 |
| | 3 | MCRGARRGAESFTWT* | 701 | ATGCGCCGAGCGGCGCGGCGGGCGCAGAGTTGAGACCTGAACTAA | 702 |
| | 4 | MVTLEWSLPPGSDLARFRGPLCAPGGVLG* | 703 | ATGGTTGACCTTGGAGTGGTCATTACCTCCGGGCAAGGACCTTGCCCACTTTCGGGACCCCTTCCGCTGTCCTGGTGGAGTCCTGGGTGA | 704 |
| hsa-mir-320-d | 1 | MESRSVAQAEVQWHNLSSLQPPPPWFK* | 705 | ATGGAGTCTCGTCTGTCGCCAGGCTGAAGTGCAGTGGCACAATCTCAGCTCACTGCAACCTCCGCCTCCTTGGTTCAAGTGA | 706 |
| | 2 | MRFHHVGQAGLKLLTS* | 707 | ATGAGGTTTCACCATGTTGGTCAGGCTGGTCAAACTCCTGACCTCGTGA | 708 |
| | 3 | MLVRLVSNS* | 709 | ATGTTGGTCAGGCTGGTCAAACTCCTGA | 710 |
| | 4 | MNGLIHSLRQRPHYPTTS* | 711 | ATGAATCGATTAATCATTCATTGAGGCAGAGACCTCATTACCCAATCACTTCTTAA | 712 |
| hsa-mir-323 | 1 | MPNFGSMMTTGGV* | 713 | ATGCCCAATCTGGATCCTGAATGATGACCACTGGTGGCGTATGA | 714 |
| | 2 | MSHT* | 715 | ATGAGTCATACATGA | 716 |
| | 3 | MMNMCLEL* | 717 | ATGATGAATATGTCTGAACTCTGA | 718 |
| | 4 | MHSYVIMIGSMKE* | 719 | ATGCATTCTTATGTTATTATAGGTCAATGAAAGAATGA | 720 |
| hsa-mir-324 | 1 | MPFLNCVALHVIHISFLSATRETAENN* | 721 | ATGCCATTCTTAAACTGTGTGGCTTTGCATGTGATCCATATCTCCTTCTTTCAGCCACCAGAGAAACGGCCGGAGAACAATTGA | 722 |
| | 2 | MLVTFPLAKR* | 723 | ATGCTGGTTACATTCCCTTAGCAAAGAGGTAG | 724 |
| | 3 | MRGVDGRDS* | 725 | ATGCGCGGAGTGGATGGGCGGGATAGCTAG | 726 |
| | 4 | MAGIASLNSSEEGGFGVAG* | 727 | ATGGCCGGGATAGCTAGCTTGAACAGCAGTGAAAGGAAGGGGATTTGGAGTCGGCTGGTTGA | 728 |
| hsa-mir-328 | 1 | MRWSRCPWR* | 729 | ATGCGATGGCGAGTCGCTGCCCTGAGGTCCCCTGAGGTGA | 730 |
| | 2 | MAESLPLEYRGSRPQA* | 731 | ATGGCGGAGTCGCTGCCCTGAGGTGAGGAAGCCGCCTCAGGCTAG | 732 |
| | 3 | MSAPSRRPEG* | 733 | ATGTCCGCTCCATCTCATCGTCCGAAGGTAA | 734 |
| | 4 | MSPPPTETAAPSPWQWETDCSLPLMCNDL* | 735 | ATGATCTCTCCATTTCCTACAGAGACGGCCGCCCCTTCTCCCTGGCAGTGGGAAACAGAGTGCCGTCCAATCTGCATGATGAACTGCAATGATCTGA | 736 |
| hsa-mir-329-1 | 1 | MPNPGSMMTTGGV* | 737 | ATGCCCAATCCTGGATGATGATGACCACTGGTGGCGTATGA | 738 |
| | 2 | MSHT* | 739 | ATGAGTCATACATGA | 740 |
| | 3 | MMNMCLEL* | 741 | ATGATGAATATGTCTGAACTCTGA | 742 |
| | 4 | MHSYVIMIGSMKE* | 743 | ATGCATTCTTATGTTATTATAGGTCAATGAAAGAATGA | 744 |
| hsa-mir-329-2 | 1 | MPNPGSMMTTGGV* | 745 | ATGCCCAATCCTGGATGATGATGACCACTGGTGGTGTATGA | 746 |
| | 2 | MSHT* | 747 | ATGAGTCATACATGA | 748 |
| | 3 | MMNMCLEL* | 749 | ATGATGAATATGTCTGGAACTCTGA | 750 |
| | 4 | MHSYVIMIGSMKE* | 751 | ATGCATTCTTATGTTATTATAGGTCAATGAAAGAATGA | 752 |

Figure 1 (Continued)

| | | | | | |
|---|---|---|---|---|---|
| hsa-mir-331 | 1 | MLLTLWERFINERNVSLFQVCAFDIVYIGKGHNAVLVCENK* | 753 | ATGCTATTGACATTATGGGAAAGATTTATCAATGAGAGAAATGTGTCTCTTTTCAGGTATGTGCTTTTGATATAGTTTACATTGGAAAGGTCATAATGCGTGTTTAGTTTGTGAAAATAAGTAA | 754 |
| | 2 | MGKIYQ* | 755 | ATGGGAAAGATTTATCAATGA | 756 |
| | 3 | MREMCLFPRYYLLI* | 757 | ATGAGAGAAATGTGTCTCTTTTCAGGTATGTGCTTTTGATATAG | 758 |
| | 4 | MLFP* | 759 | ATGCTTTTCCATGA | 760 |
| hsa-mir-345 | 1 | MRLTEKSSIT* | 761 | ATGAGACTAACAGAAAAATCAAGTATCACATAG | 762 |
| | 2 | MLKMNNRSRLHLVSRSLPCNDCALASPSCSLSAFLMWRFEM* | 763 | ATGTTAAAAATGAACAATGGAGCAGGCTACATTTAGTTTCACGGTCTCTTCCCTGTAATGACTGTGCACTAGCAAGTCCTTCCTGTTCTTGTCAGCGTTCTTGATGTGGCGATTTGAAATGTAA | 764 |
| | 3 | MTVR* | 765 | ATGACTGTGCACTAG | 766 |
| | 4 | MPSL* | 767 | ATGCCATCCCTTTAG | 768 |
| hsa-mir-34a | 1 | MRRPCTTAPGGARVPTATSWRLRAAGAEHQTDARC* | 769 | ATGCGGAGACCTGCACCACTGCTCCGGGCGGCGCTCCGGTCCGACGGCACCTCCTGGCGGCTGCGCGCAAGCGCCAGGATCCAGACGGACGCACGGTGCTGA | 770 |
| | 2 | MTNGECCF* | 771 | ATGACAAATGGGAGTGCTGCTTTTAG | 772 |
| | 3 | MGSAASRCSYQLASCVLGWAVFTCASGLSAHQVWRALLGNSVEDQDGPLEG* | 773 | ATGGGGAGTGCTGCTTCTAGGTGCTCTGTACCAACTGGCTTCGTGGTCTCGGATGGGCGGTGTTCACAGGCGCTTCGGGCTGAGCGCCACTCAAGTGTGGCGCGCTTTGGAAACTCCGTGAAGACCAGGACGGACCCTGAGGGTTAG | 774 |
| | 4 | MGGVHRRFGAERPPSVARAFGKLRGRPGRTPGGLGRL* | 775 | ATGGGCGGTGTTCACAGGCGCTTCGGGCTGAGCGCCACTCAAGTGTGGCGCGCTTTTGCGGAAACTCCGTGAAGACCAGGACGGACCCTGAGGGTTAGGAAGACTTTGA | 776 |
| hsa-mir-34b | 1 | MGVGARLPAWEGAGPPRQRRPLAQLRVLCAARPAGVPLGPGVSSGAACAQPW* | 777 | ATGGGGGTCGGGGCGCGGCTCCCGGCCTGGGAGGGCGCGGGTCCTCCCCGGCCTAGGCGCCGGTGGTCGGAGGGCCGGGGGGTCCCGCCATGGTAG | 778 |
| | 2 | MVGRPPVKWGPRRAPTPRRRCGPSGSCSRGCPVLGL* | 779 | ATGGTAGGGCGTCCCCCGGTGAAATGGGGTCCGAGGCGGGCAGCTGCGCGCTGCGACCGTCGGTTGTAG | 780 |
| | 3 | MGSEAGPDPASALRTVRELQPRVPGARFVGSVIS* | 781 | ATGGGTCCGAGGCGGCCGGGCCCGGTGCTGGCGTCGGACCGTCGGAGCTGCAGCCGCGGGTGCCGGTGCCGGTGCTGCCGGTTGTAGCACGTCATTAGCTGA | 782 |
| | 4 | MPEKRGVGVGPAQPAPRAPAASARKPAVSPDTVKLLALSRSHRR* | 783 | ATGCCTGAGAAGCGCGGCGTGGGCGTGGGTCCTGCGAGCGCCGGAGCGCCCGGCAAGTGCGAGGAAACCGCGGGTTCTCCAGATACAGTTAAACTGTTAGCTCTCTCTAGGAGTCACAGAAGATGA | 784 |
| hsa-mir-34c | 1 | MGVGARLPAWEGAGPPRQRRPLAQLRVLCAARPAGVPLGPGVSSGAACAQPW* | 785 | ATGGGGGTCGGGGCGCGGCTCCCGGCCTGGGAGGGCGCGGGTCCTCCCCGGCCGGAGGCGGGGGTCCCGCCAGCCATGGTAG | 786 |
| | 2 | MVGRPPVKWGPRRAPTPRRRCGPGSCSRGCPVLGL* | 787 | ATGGTAGGGCGTCCCCCGGTGAAATGGGGTCCGAGGCGGGCAGCTGCGCGGACCGTCGGGCCGGTGTCTCGGTTTGTAG | 788 |
| | 3 | MGSEAGPDPASALRTVRELQPRVPGARFVGSVIS* | 789 | ATGGGTCGCGAGGCGGGCCCGGTGCTGGCGTCGGACCGTCGGAGCTGCAGCCGCGGGTGCCGGTGCTGCCGGTTGTAGCACGTCATTAGCTGA | 790 |
| | 4 | MPEKRGVGPAQPAPRAPAASARKPAVSPDTVKLLALSRSHRR* | 791 | ATGCCTGCAAGTGCGAGGAAACGCGGGTTCTCCAGATACAGTTAAACTGTTAGCTCTCTCTAGGAGTCACAGAAGATGA | 792 |
| | 1 | MKKGRKPTCASDSRWRNDCGPRCIHR* | 793 | ATGAAAAAGGGGAGGAAGCCCACCTGTGCGAGTGACCTGCGGTTGCCGTTGGAGAAATGATTG | 794 |

Figure 1 (Continued)

| | | | | |
|---|---|---|---|---|
| hsa-mir-363 | 2 | MIVVFVASTADS* | 795 | ATGATTGTGTTTGTTCTTCTGTGCATCCACGCTGACTCCTGA |
| | 3 | MAFLSSSGLWAATTLVTMVEREGSGFILHPFPPSLPPAC LPGLSSSDPACSLVSDL* | 797 | ATGGCGCCTTGTCCTTCTGGCTTTGGGCTGCCACAATCACCCTGGTAACAATG GTGGAAAGGAGGGGTCCGGCTTCATTTTGCACCCCTTCCCTCCTTCCTGCCCCG GCTTGCCTTCCAGGGCTTTCCTCTCCGACCCAGGCTGCTCACTGGTCTCTGATTTGT AA |
| hsa-mir-365-1 | 4 | MLNSILIVRLKLRLHHFILQSAVGLWP* | 799 | ATGCTTAATTCATTTGATTGTGCGTCTTAAACTAAGACATCATTTATTCTACAGA GCGCTGTCGGGCTTTGGCCTTGA |
| | 1 | MGTGEGRWRRGSARFSRDSARDACLGCDCRRCGRHPGS PSDPSPAPQRGV* | 801 | ATGGGAACGGGAGAGGGAGGTGGTCGGCGGGGAGCGCGCGGTTCTCTGGGACT CGGCGCGAGAGACCCTGTCTGGGCTGCATTGCCGGCCGCGGCCACCCGGCTCCC CCTCCGACCCGTCTCCCGCTCCCCAGAGGGGCGTGTGA |
| | 2 | MPRAEQAGRARRSTCARAPLAWAAAPAGAGPRGSRTS REPPSPESYRRPLKLSAPSPREAGSPGALALASAGRGQK N* | 803 | ATGCCCCGCGCGGAGCAGGCGGGACGCGCCCGCTCCACGTGCGCCCGAGCCC GCTGGCATGGCCGGCGCGGCCCTGGCGGCGGCGCCCGCGGGATCCCGGACTAGCC GGAACCACCGTCCCCAGAGAGTTACCGCTCGCCCCTAAAGTTGTCAGCTCCTCCC CCGAGAAGCAGGCAGCCCTGGCGCGTTGGCTTAGCTTCTACGAGGACGGGGCAA AAAAACTAG |
| | 3 | MGGGACGGRAPGIPD* | 805 | ATGGGCGGCGGCGCCTGCGGGGACGGGCCCGGGATCCCGGACTAG |
| | 4 | MRRLLPLRTHPYL* | 807 | ATGCGCCGCTTATGTCCTCTGAGACACATCATTTATAA |
| hsa-mir-369 | 1 | MPNPGSMMTTGGV* | 809 | ATGCCCAATCCTGGATCGATGATGACCACTGGTGCGTATGA |
| | 2 | MSHT* | 811 | ATGAGTCATACATGA |
| | 3 | MMNMCLEL* | 813 | ATGATGAATATGTGTCTGGAACTCTGA |
| | 4 | MHSYVIRMGSMKE* | 815 | ATGCATTCTTATGTTATTATTCGGTCAATGAAAGAATGA |
| hsa-mir-370 | 1 | MRRAL* | 817 | ATGAGGAGGGCATTGTAG |
| | 2 | MRVIDPGCRSPKE* | 819 | ATGAGGGTCATTGATCCTGGGTGCAGATCTCCAAAAGAATGA |
| | 3 | MTERKREWWKETGWEKMKHEKRK* | 821 | ATGACAGAAAGAAAAGAGGAGTGGTGGAAAAAGGAAGTGAAAAGAATGGAAGATGAAGTA AAATAGAAAAGAAGTGA |
| | 4 | MGKNENRKEVKEHNN* | 823 | ATGGGAAAAAATGAAAATAGAAAAGAAGTGAAAGATAATAATAATTAG |
| hsa-mir-371 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 825 | ATGGAGACGCTTGTACCGTGTCCGTTCTTAGCGCTTGAATGTCCAACCTGAAGCTG AAGAAGCGCCTCCAATGCTGCACGATGTACGCGCTGGTCATGACTATGTATGCTGCGTGTG GTGTCTTACTTCGGCTCTATGACTGATGAACAAGGCATCAGAGGCAGTAGCTTCTTGGCC TACAGAGTGGCTCTATGACTGATGAACAATATTATATGGAAGGACTTGATCCAGTCCTGTTTAC AATGGAGAGTTTAGGTTTCATAATCCTGGACCGATCGAATGCACCAAATATCCCAAA ACTCAATAG |
| | 2 | MSQPEAEEAALAAHAVGHDYVCSGGGVLLPHHQRNRL* | 827 | ATGTCCCAACCTGAAGCTGAAGAAGCCGCCCTGGCTGCACATGCCGTTGGCCATGAC TATGTATGCTCTGGTGGGGGTGTTACTTCCTCATCACCAGAGGAAATCGTTTATGA |
| | 3 | MLWWCLTSSSPEESFMMLRLNRQVLAL* | 829 | ATGCTCTGGTGGTTGTCTTACTTCCTCATCACCAGAGGAAATCGTTTATGATGTTA CGGTTGAACCGGCAGTGTTGGCTCTATGA |
| | 4 | MNKGIRGQ* | 831 | ATGAACAAGGCATCAGAGGCCAGTAG |
| hsa-mir-372 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 833 | ATGGAGACTTGTACCGTGTCCGTTCTTAGCGCTTGAATGTCCAACCTGAAGCTG AAGAAGCGCCTCCAATGCTGCACGATGTGCGTTGGCCATGCTATGTATGCTGCGTGTG GTGTTGAACCGGCAGTGTTGGCTCTACTTCCTCATCACCAGAGGAAATCGTTTATGATGTTA CGGTTGAACCGGCAGTGTTGGCTCTATGACTGATGAACAAGGCATCAGAGGCCAGTAG GGTGTTGGCTCTATGACTGATGAACAAGGCATCAGAGGCCAGTAGCTTCTTGGCC TACAGAGTAAGTGGACAATATTATTATGGAAGGACTTGGATCCAGTCCTGTTTAC AATGGGAGGTTTAGGTTTCATAATCCTGGACCGATCGAATGCACCAAATATCCCAAA ACTCAATAG |

| | |
|---|---|
| | 796 |
| | 798 |
| | 800 |
| | 802 |
| | 804 |
| | 806 |
| | 808 |
| | 810 |
| | 812 |
| | 814 |
| | 816 |
| | 818 |
| | 820 |
| | 822 |
| | 824 |
| | 826 |
| | 828 |
| | 830 |
| | 832 |
| | 834 |

Figure 1 (Continued)

| | | | | |
|---|---|---|---|---|
| | 2 | MSQPEAEEAALAARAVGHDYVCSGGGVLLPHHQRNRL* | 835 | ATGTCCCAACTGAAGCTGAAGAAGCTGCCCTGGCTGCTGCCCTGGCCAATGAC TATGTTATGCTCTGGTGGTGGTGGTGTCTTACTTCCTCATCACCAGAGGAATCGTTTATGATGTTA | 836 |
| hsa-mir-374b | 3 | MLWWCLTSSSPEESFMMLRLNRQYLAL* | 837 | ATGCTCTGGTGGTGGTGTCTTACTTCCTCATCACCAGAGGAATCGTTTATGATGTTA CGGTTGAACCGCCAGGTGTTGGCTCTATGA | 838 |
| | 4 | MNKGHRGQ* | 839 | ATGAACAAGGGCATCAGAGGCCAGTAG | 840 |
| hsa-mir-375 | 1 | MHEGITNCTLSTREGINTFCYLGVWVGFVDTPLWFTI SMP* | 841 | ATGCATGAGGGAATCACAAACTGCACACTTTCCACAAGGGAGGAATAAATACTTTT TTCTGTGTCCTTGGAGTGGTGGGATTCGTGGATACATTTCTGTTTCACTATTT CAATGATATGA | 842 |
| | 2 | MRELQTAHFPQGRE* | 843 | ATGAGAGAACTACAAACTGCACACTTTCCACAAGGGAGGGAATAA | 844 |
| | 3 | MKEPHVAAQKIFHRWKLRLVHLH* | 845 | ATGAAGGAGCCTCATGTTGCAGCACAGAAGATTTTTCATCGTTGGAAGTTAAGGTTA GTTCACCTTCATTGA | 846 |
| | 4 | MLQHRRFFIVGS* | 847 | ATGTTGCAGCACAGAAGATTTTTCATCGTTGGAAGTTAA | 848 |
| | 1 | MRSGEGGG* | 849 | ATGCGTTCAGGTGAGGGCGGAGGCTAG | 850 |
| | 2 | MALGKSPFGLLVFPFAQ* | 851 | ATGGCCCTTGGGCAAGTCATTTCCGGCCTCTTGGTTTTCCATTGTCAGTGA | 852 |
| hsa-mir-375 | 3 | MLGKMQALTELEPRLRCGKSGRGKLRATMEPQHSSDL CGAADILRCHSLILPWSLFQSKNV* | 853 | ATGCTGGGAAGATGCAGGCCTTACGGAGTTGGAGCCAAGGCTGAGGTTGGAAA ATCTGGGCGGGGAAAGCTGAGGGCCACCATGGAGCCTCAAATCCACTCTGGATC TCTGTGTGCGGCTGACATCCTGAGATGTCACTCCTCCTTGGTCCTCTT TCAGTCTAAAAACGTCTGA | 854 |
| | 4 | MSLPDTPLVPLSV* | 855 | ATGTCACTCCCTGACACTCCTTGTCCTCTTTCAGTCTAA | 856 |
| | 1 | MPNPGSSMMTTGGV* | 857 | ATGCCCAATCCTGGATCGATGATGACCACTGGTGGCGTATGA | 858 |
| hsa-mir-376a-1 | 2 | MSHT* | 859 | ATGAGTCATACATGA | 860 |
| | 3 | MMNMCLEL* | 861 | ATGATGAATATGTGTCTGGAACTCTGA | 862 |
| | 4 | MHSYVIMIGSMKE* | 863 | ATGCATTCTTATGTTATTATGGGTCAATGAAGGAATGA | 864 |
| | 1 | MPNPGSMMTTGGV* | 865 | ATGCCCAATCCTGGATCGATGATGACCACTGGTGGCGTATGA | 866 |
| hsa-mir-376a-2 | 2 | MSHT* | 867 | ATGAGTCATACATGA | 868 |
| | 3 | MMNMCLEL* | 869 | ATGATGAATATGTGTCTGGAACTCTGA | 870 |
| | 4 | MHSYVIMIGSMKE* | 871 | ATGCATTCTTATGTTATTATGGGTCAATGAAGGAATGA | 872 |
| | 1 | MPNPGSSMMTTGGV* | 873 | ATGCCCAATCCTGGATCGATGATGACCACTGGTGGCGTATGA | 874 |
| hsa-mir-376c | 2 | MSHT* | 875 | ATGAGTCATACATGA | 876 |
| | 3 | MMNMCLEL* | 877 | ATGATGAATATGTGTCTGGAACTCTGA | 878 |
| | 4 | MHSYVIMIGSMKE* | 879 | ATGCATTCTTATGTTATTATGGGTCAATGAAGGAATGA | 880 |
| | 1 | MPNPGSMMTTGGV* | 881 | ATGCCCAATCCTGGATCGATGATGACCACTGGTGGCGTATGA | 882 |
| hsa-mir-376b | 2 | MSHT* | 883 | ATGAGTCATACATGA | 884 |
| | 3 | MMNMCLEL* | 885 | ATGATGAATATGTGTCTGGAACTCTGA | 886 |
| | 4 | MHSYVIMIGSMKE* | 887 | ATGCATTCTTATGTTATTATGGGTCAATGAAGAAGAATGA | 888 |
| hsa-mir-377 | 1 | MPNPGSSMMTTGGV* | 889 | ATGCCCAATCCTGGATCGATGATGACCACTGGTGGCGTATGA | 890 |
| | 2 | MSHT* | 891 | ATGAGTCATACATGA | 892 |
| | 3 | MMNMCLEL* | 893 | ATGATGAATATGTGTCTGGAACTCTGA | 894 |
| | 4 | MHSYVIMIGSMKE* | 895 | ATGCATTCTTATGTTATTATGGGTCAATGAAGAAGAATGA | 896 |
| | 1 | MPLH* | 897 | ATGCCACTGCACTAA | 898 |
| hsa-mir-378 | 2 | MGEFCDKELRRFPCKINLSL* | 899 | ATGGGAGAATTTGTGATAAAGAGACTTAGAAGATTTGTAAATAAACTTATCTTTATAA | 900 |
| | 3 | MFLIA* | 901 | ATGTTTTAATAGCATGA | 902 |

Figure 1 (Continued)

| | | | | | |
|---|---|---|---|---|---|
| hsa-mir-379 | 4 | MNFQISE* | 903 | ATGAACTTTCAAATTTCAGAATAA | 904 |
| | 1 | MPNPGSMMTTGGV* | 905 | ATGCCCAATCTGGATCGATGATGACCACTGGTGGCGTATGA | 906 |
| | 2 | MSHT* | 907 | ATGAGTCATACATGA | 908 |
| | 3 | MMNMCLEL* | 909 | ATGATGAATATGTCTGGAACTCTGA | 910 |
| | 4 | MHSYVIIMIGSMKE* | 911 | ATGCATTCTTATGTTATTATGATTGGGTCAATGAAAGAATGA | 912 |
| hsa-mir-380 | 1 | MPNPGSMMTTGGV* | 913 | ATGCCCAATCTGGATGATGATGACCACTGGTGGCGTATGA | 914 |
| | 2 | MSHT* | 915 | ATGAGTCATACATGA | 916 |
| | 3 | MMNMCLEL* | 917 | ATGATGAATATGTCTGGAACTCTGA | 918 |
| | 4 | MHSYVIIMIGSMKE* | 919 | ATGCATTCTTATGTTATTATGATTGGGTCAATGAAAGAATGA | 920 |
| hsa-mir-381 | 1 | MPNPGSMMTTGGV* | 921 | ATGCCCAATCTGGATCGATGATGACCACTGGTGGCGTATGA | 922 |
| | 2 | MSHT* | 923 | ATGAGTCATACATGA | 924 |
| | 3 | MMNMCLEL* | 925 | ATGATGAATATGTCTGGAACTCTGA | 926 |
| | 4 | MHSYVIIMIGSMKE* | 927 | ATGCATTCTTATGTTATTATGATTGGGTCAATGAAAGAATGA | 928 |
| hsa-mir-382 | 1 | MPNPGSMMTTGGV* | 929 | ATGCCCAATCTGGATCGATGATGACCACTGGTGGCGTATGA | 930 |
| | 2 | MSHT* | 931 | ATGAGTCATACATGA | 932 |
| | 3 | MMNMCLEL* | 933 | ATGATGAATATGTCTGGAACTCTGA | 934 |
| | 4 | MHSYVIIMIGSMKE* | 935 | ATGCATTCTTATGTTATTATGATTGGGTCAATGAAAGAATGA | 936 |
| hsa-mir-409 | 1 | MPNPGSMMTTGGV* | 937 | ATGCCCAATCTGGATCGATGATGACCACTGGTGGCGTATGA | 938 |
| | 2 | MSHT* | 939 | ATGAGTCATACATGA | 940 |
| | 3 | MMNMCLEL* | 941 | ATGATGAATATGTCTGGAACTCTGA | 942 |
| | 4 | MHSYVIIMIGSMKE* | 943 | ATGCATTCTTATGTTATTATGATTGGGTCAATGAAAGAATGA | 944 |
| hsa-mir-410 | 1 | MPNPGSMMTTGGV* | 945 | ATGCCCAATCTGGATCGATGATGACCACTGGTGGCGTATGA | 946 |
| | 2 | MSHT* | 947 | ATGAGTCATACATGA | 948 |
| | 3 | MMNMCLEL* | 949 | ATGATGAATATGTCTGGAACTCTGA | 950 |
| | 4 | MHSYVIIMIGSMKE* | 951 | ATGCATTCTTATGTTATTATGATTGGGTCAATGAAAGAATGA | 952 |
| hsa-mir-411 | 1 | MPNPGSMMTTGGV* | 953 | ATGCCCAATCTGGATCGATGATGACCACTGGTGGCGTATGA | 954 |
| | 2 | MSHT* | 955 | ATGAGTCATACATGA | 956 |
| | 3 | MMNMCLEL* | 957 | ATGATGAATATGTCTGGAACTCTGA | 958 |
| | 4 | MHSYVIIMIGSMKE* | 959 | ATGCATTCTTATGTTATTATGATTGGGTCAATGAAAGAATGA | 960 |
| hsa-mir-412 | 1 | MPNPGSMMTTGGV* | 961 | ATGCCCAATCTGGATCGATGATGACCACTGGTGGCGTATGA | 962 |
| | 2 | MSHT* | 963 | ATGAGTCATACATGA | 964 |
| | 3 | MMNMCLEL* | 965 | ATGATGAATATGTCTGGAACTCTGA | 966 |
| | 4 | MHSYVIIMIGSMKE* | 967 | ATGCATTCTTATGTTATTATGATTGGGTCAATGAAAGAATGA | 968 |
| hsa-mir-421 | 1 | MLFCVLDLNFKMCKLVIYLYYYNFIVYIFISSVSMLCLK LKISQHLFLTAFNM* | 969 | ATGTTATTTTGTGTTGATCTAAATTTAAGATGTGTAAGCTAGTATATATTTAT ATTTATTATATAAATTTATTGTATATATATTCATAAGCTCGTCAGTATGTATGCTT AAAGCTTAAAATAAGCAAATCATTCTTTCCTGACTGCTTTAACATGTAG | 970 |
| | 2 | MLKA* | 971 | ATGCTTAAAGCTTAA | 972 |
| | 3 | MLGPEPYSAKKAFRALKTKYNKHRIQSKDRYPNIEY* | 973 | ATGTTGGGATTTGAACCAGTAAGTGCAAAGAAAGCTTTCAGGGCCCTAAAACTAA GTACAATAAGCACCGCATACAGAGACCAGATATACTTCAATATAGAGTACTGA | 974 |
| | 4 | MFVGITELFWLHVPQAKGTTTIRLJPPPSESTGILCCLH* | 975 | ATGTTTGTTGTTGCGCATCACCAGGCTCATTCCTCCTCCCAGTGAAAGCACAGTCTCTTTGGCTACATGGACCAGTGAAAGCACAGTATTCTTTGTTGTCTTCACTGA | 976 |

Figure 1 (Continued)

| | | | | | |
|---|---|---|---|---|---|
| hsa-mir-422a | 1 | MAGAESLSPRLLGWNGFHRFPNIRWGGVRRAFARWS TPGRAPLVREGFQQDIDGKRTSGNEHRLSIYMHPAWGRH WRIFCRRIFLPLRSPSWERTCGYSACP* | 977 | ATGGCAGGGGCAGAAAGCCTCAGTCCCAGGCTTCTCTTGGTTGGAATGGGTTTCACAG GTTCTTTCCTAATATCAGATGGGAGGGTGAGGAGGGTGAGGAGGGCATTTGCCCGCTGGAGCA CACCTGGGAGAGCACCACTTGTGAGGGAAGGGTTCCAGCAGGACATCGATGGGAAA CGCACATCAGGAATGAACATCTGAGCATTTACATGCACCAGCATGGGGAAGGCA CTGGAGAATATTCTGCAGGAGGATATTCCTGTTCCTAAGGAGCCCGAGCTGGGAGC GCACCTGTGGATATTCAGCTTGCCCATAG | 973 |
| | 2 | MGFTGSFLISDGEG* | 979 | ATGGGTTTCACAGGTCTTTCTTCCTAATATCAGATGGGAGGGTGA | 980 |
| | 3 | MGRGEEGICPLEHTWESTICEGRVPAGHRWETTHIRK* | 981 | ATGGGGAGGGGTGAGGAGGGCATTTGCCCGCTGGAGCACACCTGGAGCACCAC TTGTGAGGGAAGGTTCCAGCAGGACATCGATGGGAAACGCACATCAGGAAATGA | 982 |
| | 4 | MGNAHQEMNI* | 983 | ATGGGAAACGCACATCAGGAAATGAACATCTGA | 984 |
| hsa-mir-429 | 1 | MGCCRQPGQRPGELRSLQTQAGAGPSPPQGKVGPCADA AGFRVWSHLGPTGCVFRARAQCVGSRHGVPSCQGLGR GQAPRGVTFLPPT* | 985 | ATGGGCTGCGAGCCAGGCCAGGCGACCCAGGGAGGAGCTCCGTGCACTGCAGACACA GCCTGGAGCGGTCCTTCCCCAGCCCCAGGGAAGGTTGGGCCTCGGCAGATGCGG CTGGGTTTCGGGTGTGGGCTCATCTGAGCCACCGGGCTGCGTCTCCGGCACGGG CACAGTGTGTGGGCTCAGGCATGCGGGGCCTCAGGRCAGGGCTGGGCAGAGGG CAGGGCTCCGAGAGGGTTACGTTCTTGCCGCTACCTGA | 986 |
| | 2 | MRLGFGCGAILDPRAASSGHGHSVWAPGMGGCPQGRAW AEGRLREGSRSCRLPDSRPSRKFSPEAATAVLRHFVRRR EAVASEVGA* | 987 | ATGCGCCTGGGTTCGGGTGTGGGCGCCATCTTGGACCCACGGGCTGCGTCTTCCGG CACGGGCACAGTGTGTGGGCTCCAGRCATGCGGGGCCTCAGGRCAGGGCTGGGC AGAGGGCAGGGCTCCGAGAGCAGGTCACGTTCTGCCGCCTACCTGAGCGACCAGGCCTT CTAGAAAGTTCTCTGCCCTCAGGGTCGCTAG GGGAAGCTGTGCGTCAGGAGTGTGGTCGTAG | 988 |
| | 3 | MTASPLGSGVCGGKGLVSAPSGQRPAEPMGGEVGAWG RGWSGTGAQPGEAGAGSQAPRYDWGGGNVSREVPY LNVKRLSTVAAAGNKVRPTEAQP* | 989 | ATGACCGCGTCTCTTGGGCTCTGGAGTCTGCGGTGGAAGGCTTGGTTCAGCA CCCTTGCAGAGCCGGACCAGGCCCAGCGGCCGAGATGGTGAGCTGGGCCGGGTCG TGGCTGGTCAGTGTACAGGTGGGGCTCAGCCCAGCAACGTCTCTGTGAGGTTTTACTTAAATG CCCGCTATGACTGGGGGAGGAGGGAAGGTCTGGAGGTTTTTACTTAAATG TGAAACGGCTCAGTAGGGTCAGTGGCCGCACCGCCGGAACAAGGTCCGACCACCGAGGCC CAGCCTTGA | 990 |
| | 4 | MTGVGATSLVRFFT* | 991 | ATGACTGGGGTGGGCACGTCTCGTGAGTTTTTACTTAA | 992 |
| hsa-mir-431 | 1 | MRRAL* | 993 | ATGAGGAGGGCATTGTAG | 994 |
| | 2 | MRVIDPGCRSPKE* | 995 | ATGAGGGTCATTGATCCTGGGTGCAGATCTCCAAAGAATGA | 996 |
| | 3 | MTERKREWWKETIGWEKMKIEKRK* | 997 | ATGACAGAAGAAATGGAGTGGTGGAAAGAAACAATAGGATGGGAAAAATGA AAATAGAAAAGGAAGTTGA | 998 |
| | 4 | MGKNENRKKEVKEIHNN* | 999 | ATGGGAAAGAATGAAATAGAAAAGGAAGATAATAAATAATTAG | 1000 |
| hsa-mir-432 | 1 | MRRAL* | 1001 | ATGAGGAGGGCATTGTAG | 1002 |
| | 2 | MRVIDPGCRSPKE* | 1003 | ATGAGGGTCATTGATCCTGGGTGCAGATCTCCAAAGAATGA | 1004 |
| | 3 | MTERKREWWKETIGWEKMKIEKRK* | 1005 | ATGACAGAAGAAATGGAGTGGTGGAAAGAAACAATAGGATGGGAAAAATGA AAATAGAAAAGGAAGTTGA | 1006 |
| | 4 | MGKNENRKKEVKEIHNN* | 1007 | ATGGGAAAGAATAGAAAAGGAAGTGAAAATAAGGAAGATAATAAATAATTAG | 1008 |
| hsa-mir-433 | 1 | MRRAL* | 1009 | ATGAGGAGGGCATTGTAG | 1010 |
| | 2 | MRVIDPGCRSPKE* | 1011 | ATGAGGGTCATTGATCCTGGTGCAGATCTCCAAAGAATGA | 1012 |
| | 3 | MTERKREWWKETIGWERMKIEKRK* | 1013 | ATGACAGAAGAAATGGAGTGGTGAAAGAAACAATAGGATGTGAAAAACAATAGGAAGAATGA | 1014 |
| | 4 | MGKNENRKKEVKEIHNN* | 1015 | ATGGGAAAGAATGAAATAGAAAAGGAAGTGAAAGAATAATAAATAATTAG | 1016 |

Figure 1 (Continued)

| | | | | |
|---|---|---|---|---|
| hsa-mir-451 | 1 | MGRGGSRSPGGQYPVWGGALKQRSFLGTVRPVNSKQAG ACWGLPALPAQETRMRPLQVGKPGSGQCSLGLQNAAS SRISI* | 1017 | ATGGGGGGCGGGTCGCGCAGCCCTGGAGGGCAGGTGCCTGTATGGGGAGGGCCCT GAAACAGAGGTCGTTTCTGGCACAGTCAGACCCGTTAATTCCAAGCAGGCTGGGG CTTGTTGGGGATTACCGGCACTGCCCGCCAGGAGACGCGGATGCGGCCTCTACAG GTTGGGAAACCCGGTTCGGGCAGTGCAGTTTGGGATTGCAAAATGCTGCAAGTTCC AGAATTTCTATCTAG | 1018 |
| | 2 | MGRGPETEVVSRUSQTR* | 1019 | ATGCGGGAGGGGCCCTGAAACAGAGGTCGTTTCTCGCACAGTCAGACCCGTTAA | 1020 |
| | 3 | MLQVPEFLSRWGMGTAVLGKRNCY* | 1021 | ATGCTGCAAGTTCCAGAATTTCTATCTAGGTGGGGCATGGGGACTGCGGTACTGGG GAAAAGGAACTGCTATTGA | 1022 |
| | 4 | MASGSLWISKSISPLGHPQCVGDKYPTPLKTRNSLEDRR ETPREH* | 1023 | ATGGCTTCAGGTCTCACTTTGGATCCAAAATCTCTCCACTGGGACATCCCAG TGTGTGGGAGTAAGTACCCTACCCCCTGAAGACCAGAAATAGCTTGAGGACAG AGGGAGACTCCCAGAGAACACTAA | 1024 |
| hsa-mir-485 | 1 | MPNPGSMMTTGGV* | 1025 | ATGCCCAATCTGGATCGATGATGACCACTGGTGGCGTATGA | 1026 |
| | 2 | MSHT* | 1027 | ATGAGTCATACATGA | 1028 |
| | 3 | MMNMCLEL* | 1029 | ATGATGAATATGTCTGGAACTCTGA | 1030 |
| | 4 | MHSYVIMGSMKE* | 1031 | ATGCATTCTTATGTTATTATGGTCAATGAAAGAATGA | 1032 |
| hsa-mir-487a | 1 | MPNPGSMMTTGGV* | 1033 | ATGCCCAATCTGGATCGATGATGACCACTGGTGGCGTATGA | 1034 |
| | 2 | MSHT* | 1035 | ATGAGTCATACATGA | 1036 |
| | 3 | MMNMCLEL* | 1037 | ATGATGAATATGTCTGGAACTCTGA | 1038 |
| | 4 | MHSYVIMGSMKE* | 1039 | ATGCATTCTTATGTTATTATGATTGGTCAATGAAAGAATGA | 1040 |
| hsa-mir-487b | 1 | MPNPGSMMTTGGV* | 1041 | ATGCCCAATCCTGGATCGATGATGACCACTGGTGGCGTATGA | 1042 |
| | 2 | MSHT* | 1043 | ATGAGTCATACATGA | 1044 |
| | 3 | MMNMCLEL* | 1045 | ATGATGAATATGTCTGGAACTCTGA | 1046 |
| | 4 | MHSYVIMGSMKE* | 1047 | ATGCATTCTTATGTTATTATGATTGGTCAATGAAAGAATGA | 1048 |
| hsa-mir-493 | 1 | MRRAL* | 1049 | ATGAGGAGGCATTGTAG | 1050 |
| | 2 | MRVIDPGCRSPKE* | 1051 | ATGAGGGTCATTGATCCTGGGTGCAGATCTCCAAAGAATGA | 1052 |
| | 3 | MTERKREWWKETIGWEKMKIEKRK* | 1053 | ATGACAGAAAGAAAGAGAGGAGTGGTGGAAAGAAACAATAGGATGGGAAAAATGA AAATAGAAAAGGAAGTGA | 1054 |
| | 4 | MCKNENRRKEVKEHPN* | 1055 | ATGGGAAAAATGAAAATAGAAAAGGAAGTGAAAGATATAATAATTAG | 1056 |
| hsa-mir-494 | 1 | MPNPGSMMTTGGV* | 1057 | ATGCCCAATCTGGATCGATGATGACCACTGGTGGCGTATGA | 1058 |
| | 2 | MSHT* | 1059 | ATGAGTCATACATGA | 1060 |
| | 3 | MMNMCLEL* | 1061 | ATGATGAATATGTCTGCTGGAACTCTGA | 1062 |
| | 4 | MHSYVIMGSMKE* | 1063 | ATGCATTCTTATGTTATTATGGTCAATGAAAGAATGA | 1064 |
| hsa-mir-495 | 1 | MPNPGSMMTTGGV* | 1065 | ATGCCCAATCTGGATCGATGATGACCACTGTGGCGTATGA | 1066 |
| | 2 | MSHT* | 1067 | ATGAGTCATACATGA | 1068 |
| | 3 | MMNMCLEL* | 1069 | ATGATGAATATGTCTGGAACTCTGA | 1070 |
| | 4 | MHSYVIMGSMKE* | 1071 | ATGCATTCTTATGTTATTATGGTCAATGAAAGAATGA | 1072 |
| hsa-mir-496 | 1 | MPNPGSMMTTGGV* | 1073 | ATGCCCAATCTGGATCGATGATGACCACTGGTGGCGTATGA | 1074 |
| | 2 | MSHT* | 1075 | ATGAGTCATACATGA | 1076 |
| | 3 | MMNMCLEL* | 1077 | ATGATGAATATGTCTGGAACTCTGA | 1078 |
| | 4 | MHSYVIMGSMKE* | 1079 | ATGCATTCTTATGTTATTATGATTGGTCAATGAAAGAATGA | 1080 |

Figure 1 (Continued)

| | | | | |
|---|---|---|---|---|
| hsa-mir-498 | 1 | METLYRVPFLALECPNLKLEKPPWLHMPLAMTMYALV VVSYFLTRGIVYDVTYEPPGVGSMTDEQGHQRPVAFL AYRVSGQYYYGRTWIQLPVYNGRFRFHNPGPIECTKYP KTQ* | 1081 | ATGGAGACTTTGTACCGTGTCCCGTTCTTAGCGCTTGAATGTCCCAACCTGAAGCTG AAGAAGCCCCCTGGCTGCACATCGTTGGCCATGACATGTATGCTCTGGTTGGTG GTGTCTTACTTCGTCTGGTCTTCCTCATCACCAGAGGAATCGTTTATGATGTTACG GTGTTGGCTCTATGACTGACAATATTATTGGAAGGACTTGGATCCAGCTTCTTGCC TACAGAGTAAGTGGACAATATTATTGGAAGGACTTGGATCCAGCTTCTCGTTTAC AATGGGAGGTTTAGGTTTCATAATCCTGACCGATGAATGCACCAAATATCCCAAA ACTCAATAG | 1082 |
| | 2 | MSQPEAEEAALAAHAVGHDYVCSGQGVLLPHHQRNRL* | 1083 | ATGTCCCAACCTGAAGCTGAAGAAGCCGCCCTGGCTGCACATGCCGTTGGCCATGAC TATGTATGCTCTGGTCAGGGAGTTCTTCCTCATCACCAGAGGAATCGTTTATGA | 1084 |
| | 3 | MLWWWCLTSSSPEESFMMLRLMRQYLAL* | 1085 | ATGCTCTGGTGGTGTGTCTTACTTCCTCATCACCAGAGGAGTTCTTCCTCTATGA CGGTTGAACCGCCACGGTTTGGCTCTATGA | 1086 |
| | 4 | MNKGIRGQ* | 1087 | ATGAACAAGGGCATCAGAGGCCAGTAG | 1088 |
| hsa-mir-506 | 1 | MPATWLPIKPEVL* | 1089 | ATGCCAGCAACATGGCTTCCTATAAAGCCTGAGGTCCTGTGA | 1090 |
| | 2 | MASYKA* | 1091 | ATGGCTTCCTATAAGCTGA | 1092 |
| | 3 | MQKWPNTKNWYQ* | 1093 | ATGCAAAAATGGCCTAATACAAAAATTGGTACCAGTAG | 1094 |
| | 4 | MRKQLWNQVMSRVWKSLEGSEADMKIKESLDFLQDC* | 1095 | ATGAGGAAGCAACTTTGAACCAGGTAATGAGCAGAGAGTTTGGAAGAGTTGGAGGG GTCAGACAGACATGAAGATAAAGGAAAGTTTAGATTTCTTCAAGACTGCTGA | 1096 |
| hsa-mir-507 | 1 | MPATWLPIKPEVL* | 1097 | ATGCCAGCAACATGGCTTCCTATAAAGCCTGAGGTCCTGA | 1098 |
| | 2 | MASYKA* | 1099 | ATGGCTTCCTATAAAGCCTGA | 1100 |
| | 3 | MQKWPNTKNWYQ* | 1101 | ATGCAAAAATGCCTAATACAAAAATTGGTACCAGTAG | 1102 |
| | 4 | MRKQLWNQVMSRVWKSLEGSEADMKIKESLDFLQDC* | 1103 | ATGAGGAAGCAACTTTGGAACCAGGTAATGAGCAGAGTTTGGAAGAGTTGGAGGG GTCAGACAGACATGAAGATAAAGGAAAGTTTAGATTTCTTCAAGACTGCTGA | 1104 |
| hsa-mir-508 | 1 | MPATWLPIKPEVL* | 1105 | ATGCCAGCAACATGGCTTCCTATAAAGCCTGAGGTCCTGA | 1106 |
| | 2 | MASYKA* | 1107 | ATGGCTTCCTATAAAGCCTGA | 1108 |
| | 3 | MQKWPNTKNWYQ* | 1109 | ATGCAAAAATGCCTAATACAAAAATTGGTACCAGTAG | 1110 |
| | 4 | MRKQLWNQVMSRVWKSLEGSEADMKIKESLDFLQDC* | 1111 | ATGAGGAAGCAACTTTGGAACCAGGTAATGAGCAGAGTTTGAAGAGTTGGAGGG GTCAGACAGACATGAAGATAAAGGAAAGTTTAGATTTCTTCAAGACTGCTGA | 1112 |
| hsa-mir-509-1 | 1 | MPATWLPIKPEVL* | 1113 | ATGCCAGCAACATGGCTTCCTATAAAGCCTGAGGTCCTGTGA | 1114 |
| | 2 | MASYKA* | 1115 | ATGGCTTCCTATAAAGCCTGA | 1116 |
| | 3 | MQKWPNTKNWYQ* | 1117 | ATGCAAAAATGCCTAATACAAAAATTGGTACCAGTAG | 1118 |
| | 4 | MRKQLWNQVMSRVWKSLEGSEADMKIKESLDFLQDC* | 1119 | ATGAGGAAGCAACTTTGGAACCAGGTAATAGCAGAGCAGAGTTTGGAAGAGTTGGAGGG GTCAGAAGCAGACATGAAGATAAAGGAAAGTTTAGATTTCTTCAAGACTGCTGA | 1120 |
| hsa-mir-510 | 1 | MPATWLPIKPEVL* | 1121 | ATGCCAGCAACATGGCTTCCTATAAAGCCTGAGGTCCTGA | 1122 |
| | 2 | MASYKA* | 1123 | ATGGCTTCCTATAAAGCCTGA | 1124 |
| | 3 | MQKWPNTKNWYQ* | 1125 | ATGCAAAAATGGCCTAATACAAAAATTGGTACCAGTAG | 1126 |
| | 4 | MRKQLWNQVMSRVWKSLEGSEADMKIKESLDFLQDC* | 1127 | ATGAGGAAGCAACTTTGGAACCAGGTAATAGCAGAGTTGGAAGAGTTGGAGGG GTCAGAAGCAGACATGAAGATAAAGGAAAGTTTAGATTCTTCAAGACGCTGA | 1128 |
| hsa-mir-512-1 | 1 | METLYRVPFLALECPNLKLEKPPWLHMPLAMTMYALV VVSYFLTRGIVYDVTYEPPGVGSMTDEQGHQRPVAFL AYRVSGQYYYGRTWIQLPVYNGRFRFHNPGPIECTKYP KTQ* | 1129 | ATGGAGACTTTGTACCGTGTCCCGTTCTTAGCGCTTGAATGTCCCAACCTGAAGCTG AAGAAGCCCCCTGGCTGCACATGCCGTTGGCCATGACATGTATGCTCTGGTTGGTG GTGTCTTACTTCGTCTGGTCTTCCTCATCACCAGAGGAGTTCATCTATGATGTTACG GTGTTGGCTCTATGACTGACAATATTATTGGAAGGACTTGGATCCAGCTTCTTGCC TACAGAGTAAGTGGACAATATTATTGGAAGGACTTGGATCCAGCTTCTCGTTTAC AATGGGAGGTTTAGGTTTCATAATCCTGACCGATGAATGCACCAAATATCCCAAA ACTCAATAG | 1130 |

Figure 1 (Continued)

| | | | | | |
|---|---|---|---|---|---|
| hsa-mir-512-2 | 2 | MSQPEAEEAALAAHAVGHDYVCSGGVLLPHHQRNRL* | 1131 | ATGTCCCAACCTGAAGCTGAAGAAGCCGCCCTGGCTGCACATGCCGTTGGCCATGAC TATGTATGCTCTGGTGGTGTTACTTCCTCATCACCAGAGGAATCGTTTATGATGTTA | 1132 |
| | 3 | MLWWWCLTSSSPEESFMMLRLNRQVLAL* | 1133 | ATGCTCTGGTGGTGGTGTCTTACTTCCTCATCACCAGAGGAATCGTTTATGATGTTA CGGTTGAACCGCCAGGTGTTGCTCTGA | 1134 |
| | 4 | MNKGIRGQ* | 1135 | ATGAACAAGGGCATCAGAGGCCAGTAG | 1136 |
| | 1 | METLYRVPPLALECPNLKLKKPPWLHMPLAMTMYALV VSSYPLJTRGIVYDVTVEPPGVGSMTDEQGHQRPVAFL AYRVSGQYYYGRTWIQLPVYNGRFRFHNPGPIECTKYP KTQ* | 1137 | ATGGAGACTTTGTACCGTGTCCGTTCTTAGCGTTGCACATGCCGTTGAATGTCCAACCTGAAGCTG AAGAAGCCGCCCTGGCTGCACATGCCGTTGAATGTTATGATGTATGCTCGGTGGTG GGTTCTTACTTCCTCATCACCAGAGGAATCGTTTATGATGTTACGGTTGAACCGCCA GGTGTTGGCTCTATGACTGATGAACAAGGCCATCAGAGGCCAGTAGCTTTCTGGCC TACAGAGTAAGTGACAATATTATTATGGAAGGACTGGATCCAGTTCCTCGTTTAC AATGGGAGGTTTAGGTTTCATAAATCCTGGACCGATCGAATGCACCAAATATCCAAA ACTCAATAG | 1138 |
| | 2 | MSQPEAEEAALAAHAVGHDYVCSGGVLLPHHQRNRL* | 1139 | ATGTCCCAACCTGAAGCTGAAGAAGCCGCCCTGGCTGCACATGCCGTTGGCCATGAC TATGTATGCTCTGGTGGTGTTACTTCCTCATCACCAGAGGAATCGTTTATGA | 1140 |
| | 3 | MLWWWCLTSSSPEESFMMLRLNRQVLAL* | 1141 | ATGCTCTGGTGGTGGTGTCTTACTTCCTCATCACCAGAGGAATCGTTTATGATGTTA CGGTTGAACCGCCAGGTGTTGCTCTATGA | 1142 |
| | 4 | MNKGIRGQ* | 1143 | ATGAACAAGGGCATCAGAGGCCAGTAG | 1144 |
| hsa-mir-514-1 | 1 | MPATWLPIKPEVL* | 1145 | ATGCCAGCAACATGCTTCCTATAAAGCCTGAGGTCCTGA | 1146 |
| | 2 | MASYKA* | 1147 | ATGGCTTCCTATAAAGCCTGA | 1148 |
| | 3 | MQKWPNTKNWYQ* | 1149 | ATGCAAAAATGGCTAATACAAAAATTGGTACCAGTAG | 1150 |
| | 4 | MRKQLWNQVMSRVWKSLEGSEADMKIKESLDFLQDC* | 1151 | ATGAGGAAGCAACTTTGGAACCAGGTAATGAGCAGAGTTTGGAAGAGTTTGGAGGG GTCAGAAGCAGACATGAAGATAAAGGAAAGTTTAGATTTCTTCAAGACTGCTGA | 1152 |
| hsa-mir-514-2 | 1 | MPATWLPIKPEVL* | 1153 | ATGCCAGCAACATGCTTCCTATAAAGCCTGA | 1154 |
| | 2 | MASYKA* | 1155 | ATGGCTTCCTATAAAGCCTGA | 1156 |
| | 3 | MQKWPNTKNWYQ* | 1157 | ATGCAAAAATGGCCTAATACAAAAATTGGTACCAGTAG | 1158 |
| | 4 | MRKQLWNQVMSRVWKSLEGSEADMKIKESLDFLQDC* | 1159 | ATGAGGAAGCAACTTTGGAACCAGGTAATGAGCAGAGTTTGGAAGAGTTTGGAGGG GTCAGAAGCAGACATGAAGATAAAGGAAAGTTTAGATTTCTTCAAGACTGCTGA | 1160 |
| hsa-mir-514-3 | 1 | MPATWLPIKPEVL* | 1161 | ATGCCAGCAACATGCTTCCTATAAAGCCTGA | 1162 |
| | 2 | MASYKA* | 1163 | ATGGCTTCCTATAAAGCCTGA | 1164 |
| | 3 | MQKWPNTKNWYQ* | 1165 | ATGCAAAAATGGCCTAATACAAAAATTGGTACCAGTAG | 1166 |
| | 4 | MRKQLWNQVMSRVWKSLEGSEADMKIKESLDFLQDC* | 1167 | ATGAGGAAGCAACTTTGGAACCAGGTAATGAGCAGAGTTTGGAAGAGTTTGGAGGG GTCAGAAGCAGACATGAAGATAAAGGAAAGTTTAGATTTCTTCAAGACTGCTGA | 1168 |
| hsa-mir-515-1 | 1 | METLYRVPPLALECPNLKLKKPPWLHMPLAMTMYALV VSSYPLJTRGIVYDVTVEPPGVGSMTDEQGHQRPVAFL AYRVSGQYYYGRTWIQLPVYNGRFRFHNPGPIECTKYP KTQ* | 1169 | ATGGAGACTTTGTACCGTGTCCGTTCTTAGCGTTGCACATGCCGTTGAATGTCCAACCTGAAGCTG AAGAAGCCGCCCTGGCTGCACATGCCGTTGAATGTTATGATGTATGCTCGGTGGTG GGTTCTTACTTCCTCATCACCAGAGGAATCGTTTATGATGTTACGGTTGAACCGCCA GGTGTTGGCTCTATGACTGATGAACAAGGCCATCAGAGGCCAGTAGCTTTCTGGCC TACAGAGTAAGTGACAATATTATTATGGAAGGACTGGATCCAGTTCCTCGTTTAC AATGGGAGGTTTAGGTTTCATAAATCCTGGACCGATCGAATGCACCAAATATCCAAA ACTCAATAG | 1170 |
| hsa-mir-515-1 | 2 | MSQPEAEEAALAAHAVGHDYVCSGGVLLPHHQRNRL* | 1171 | ATGTCCCAACCTGAAGCTGAAGAAGCCGCCCTGGCTGCACATGCCGTTGGCCATGAC TATGTATGCTCTGGTGGTGTTACTTCCTCATCACCAGAGGAATCGTTTATGA | 1172 |

Figure 1 (Continued)

| | | | | |
|---|---|---|---|---|
| hsa-mir-515-2 | 3 | MLWWWCLTSSPEESPMMLRLNRQVLAL* | 1173 | ATGCTCTGGTGGTGGTGTCTTACTTCCTCATCACCAGAGGAATCGTTTATGATGTTA | 1174 |
| | 4 | MNKGIRGQ* | 1175 | ATGAACAAGGGCATCAGAGGCCAGTAG | 1176 |
| | 1 | METLYRVPFLALECPNLKLKKPPWLHMPLAMTMYALV VVSYFLITRGIVYDVTVEPPGVGSMTIDEQGHQRPVAFL AYRVSGQYYYGRTWIQLPVYNGRFHNPGPIECTKYP KTQ* | 1177 | ATGGAGACTTTGTACCGTGCCGTTCTTAGCGTTGCCATGCGTTGGCTGAATGCTGAAGCTG AAGAAGCCGCCCTGGCTGCACATCGCTGGCCATGACTATGTTACGGTTGAACCGCCA GTGTCTTACTTCCTCATCACCAGAGGAATCGTTTATGATGTTACGGTTGAACCGCCA GGTGTTGGCTCTATGACTGATGAACAAGGCCATCAGAGGACTTGGATCGAGCTTCTTGGCC TACAGAGTAAGTGGACAATATTATTATGGAAGGACTTGGATCGAGCTTCTTGTTAC AATGGGAGGTTTAGGTTTCATAATCCTGGACCGATCGAATGCACCAAATATCCAAA ACTCAATAG | 1178 |
| | 2 | MSQPEAEEAALAAHAVGHDYYCSGGGVLLPHHQRNRL* | 1179 | ATGTCCCAACTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGATGTTA | 1180 |
| | 3 | MLWWWCLTSSPEESPMMLRLNRQVLAL* | 1181 | ATGCTCTGGTGGTGGTGTCTTACTTCCTCATCACCAGAGGAATCGTTTATGATGTTA CGGTTGAACAAGGGCCAGTAG | 1182 |
| | 4 | MNKGIRGQ* | 1183 | ATGAACAAGGGCATCAGAGGCCAGTAG | 1184 |
| hsa-mir-516a-1 | 1 | METLYRVPFLALECPNLKLKKPPWLHMPLAMTMYALV VVSYFLITRGIVYDVTVEPPGVGSMTIDEQGHQRPVAFL AYRVSGQYYYGRTWIQLPVYNGRFHNPGPIECTKYP KTQ* | 1185 | ATGGAGACTTTGTACCGTGCCGTTCTTAGCGTTGCCATGCGTTGGCTGAATGCTGAAGCTG AAGAAGCCGCCCTGGCTCTTCCTCATCACCAGAGGAATCGTTTATGATGTTACGGTTGAACCGCCA GTGTCTTACTTCCTCATCACCAGAGGAATCGTTTATGATGTTACGGTTGAACCGCCA GGTGTTGGCTCTATGACTGATGAACAAGGCCATCAGAGGACTTGGATCGAGCTTCTTGGCC TACAGAGTAAGTGGACAATATTATTATGGAAGGACTTGGATCGAGCTTCTTGTTAC AATGGGAGGTTTAGGTTTCATAATCCTGGACCGATCGAATGCACCAAATATCCAAA ACTCAATAG | 1186 |
| | 2 | MSQPEAEEAALAAHAVGHDYYCSGGGVLLPHHQRNRL* | 1187 | ATGTCCCAACTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGATGTTA | 1188 |
| | 3 | MLWWWCLTSSPEESPMMLRLNRQVLAL* | 1189 | ATGCTCTGGTGGTGGTGTCTTACTTCCTCATCACCAGAGGAATCGTTTATGATGTTA CGGTTGAACCAGGGCCAGGTGTTGGCTCAGTAG | 1190 |
| | 4 | MNKGIRGQ* | 1191 | ATGAACAAGGGCATCAGAGGCCAGTAG | 1192 |
| hsa-mir-516a-2 | 1 | METLYRVPFLALECPNLKLKKPPWLHMPLAMTMYALV VVSYFLITRGIVYDVTVEPPGVGSMTIDEQGHQRPVAFL AYRVSGQYYYGRTWIQLPVYNGRFHNPGPIECTKYP KTQ* | 1193 | ATGGAGACTTTGTACCGTGCCGTTCTTAGCGTTGCCATGCGTTGGCTGAATGCTGAAGCTG AAGAAGCCGCCCTGGCTGCACATCGCTGGCCATGACTATGTTACGGTTGAACCGCCA GTGTCTTACTTCCTCATCACCAGAGGAATCGTTTATGATGTTACGGTTGAACCGCCA GGTGTTGGCTCTATGACTGATGAACAAGGCCATCAGAGGACTTGGATCGAGCTTCTTGGCC TACAGAGTAAGTGGACAATATTATTATGGAAGGACTTGGATCGAGCTTCTTGTTAC AATGGGAGGTTTAGGTTTCATAAJCCTGGACCGATCGAATGCACCAAATATCCAAA ACTCAATAG | 1194 |
| | 2 | MSQPEAEEAALAAHAVGHDYYCSGGGVLLPHHQRNRL* | 1195 | ATGTCCCAACTGAAGCTGAAGAAGCCGCCCTGGCCTGCACATGCCGTTGGCCATGAC TATGTATGCTCTGGTGGTGGTGTCTTACTTCCTCATCACCAGAGGAATCGTTTATGATGTTA | 1196 |
| | 3 | MLWWWCLTSSPEESPMMLRLNRQVLAL* | 1197 | ATGCTCTGGTGGTGGTGTCTTACTTCCTCATCACCAGAGGAATCGTTTATGATGTTA CGGTTGAACAAGGGCATCAGAGGCCAGTAG | 1198 |
| | 4 | MNKGIRGQ* | 1199 | ATGAACAAGGGCATCAGAGGCCAGTAG | 1200 |

Figure 1 (Continued)

| | | | | |
|---|---|---|---|---|
| hsa-mir-516b-1 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVVNGRFRFHNPGPIECTKYP KTQ* | 1201 | ATGGAGACTTTGTACCGTGTCCCGTTCTTAGCGCTTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGCC TACAGAGTAAGTGGACAATATTATTATGGAAGGACTTGGATCGAGTCCTGTTTAC AATGGGAGGTTTAGGTTTCATAATCCTGGACCGATCGAATGCACCAAATATCCCAAA ACTCAATAG | 1202 |
| | 2 | MSQPEAEEAALAAHAVGHDYYCSGGGVLLPHHQRNRL* | 1203 | ATGTCCCAACTGAAGCTGAAGAAGCCGCCCTGGCTGCACATGCCGTTGGCCATGAC TATGTATGCTCTGGTGGTGTCGTTACTTCCTCATCACCAGAGGAATCGTTTATGA | 1204 |
| | 3 | MLWWWCLTSSSPEESFMMLRLNRQVLAL* | 1205 | ATGCTCTGGTGGTGGTGTCTTACTTCCTCATCACCAGAGGAATCGTTTATGATGTTA CGGTTGAACCGCCAGGTGTTGGCTCTATGA | 1206 |
| | 4 | MNKGIRGQ* | 1207 | ATGAACAAGGGCATCAGAGGCCAGTAG | 1208 |
| hsa-mir-516b-2 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVVNGRFRFHNPGPIECTKYP KTQ* | 1209 | ATGGAGACTTTGTACCGTGTCCCGTTCTTAGCGCTTGAAGCTG AAGAAGCCGCCCTGGCTGCACATGCCGTTGGCCATGACTATGTATGCTCTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGCC TACAGAGTAAGTGGACAATATTATTATGGAAGGACTTGGATCCAGCTTCCTGTTTAC AATGGGAGGTTTAGGTTTCATAATCCTGGACCGATCGAATGCACCAAATATCCCAAA ACTCAATAG | 1210 |
| | 2 | MSQPEAEEAALAAHAVGHDYYCSGGGVLLPHHQRNRL* | 1211 | ATGTCCCAACTGAAGCTGAAGAAGCCGCCCTGGCTGCACATGCCGTTGGCCATGAC TATGTATGCTCTGGTGGTGTCGTTACTTCCTCATCACCAGAGGAATCGTTTATGA | 1212 |
| | 3 | MLWWWCLTSSSPEESFMMLRLNRQVLAL* | 1213 | ATGCTCTGGTGGTGTCGTCTTACTTCCTCATCACCAGAGGAATCGTTTATGATGTTA CGGTTGAACCGCCAGGTGTTGGCTCTATGA | 1214 |
| | 4 | MNKGIRGQ* | 1215 | ATGAACAAGGGCATCAGAGGCCAGTAG | 1216 |
| hsa-mir-517a-1 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVVNGRFRFHNPGPIECTKYP KTQ* | 1217 | ATGGAGACTTTGTACCGTGTCCCGTTCTTAGCGCTTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGCC TACAGAGTAAGTGGACAATATTATTATGGAAGGACTTGGATCCAGCTTCCTGTTTAC AATGGGAGGTTTAGGTTTCATAATCCTGGACCGATCGAATGCACCAAATATCCCAAA ACTCAATAG | 1218 |
| | 2 | MSQPEAEEAALAAHAVGHDYYCSGGGVLLPHHQRNRL* | 1219 | ATGTCCCAACTGAAGCTGAAGAAGCCGCCCTGGCTGCACATGCCGTTGGCCATGAC TATGTATGCTCTGGTGGTGTCGTTACTTCCTCATCACCAGAGGAATCGTTTATGA | 1220 |
| | 3 | MLWWWCLTSSSPEESFMMLRLNRQVLAL* | 1221 | ATGCTCTGGTGGTGTCGTCTTACTTCCTCATCACCAGAGGAATCGTTTATGATGTTA CGGTTGAACCGCCAGGTGTTGGCTCTATGA | 1222 |
| | 4 | MNKGIRGQ* | 1223 | ATGAACAAGGGCATCAGAGGCCAGTAG | 1224 |
| hsa-mir-517a-2 | 1 | METLYRVPFLALECPNLKLKKPPWLIRMPLAMTMYALV VVSYFLITRGIVYDVTVEPPGVGSMTDEQGHQRPVAFL AYRVSGQYYYGRTWIQLPVVNGRFRFHNPGPIECTKYP KTQ* | 1225 | ATGGAGACTTTGTACCGTGTCCCGTTCTTAGCGCTTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGCC TACAGAGTAAGTGGAGGTTTAGGTTTCATAATCCTGGACCGATCGAATGCACCAAATATCCCAAA ACTCAATAG | 1226 |

Figure 1 (Continued)

| | | | | |
|---|---|---|---|---|
| | 2 | MSQPEAEEAALAAHAVGHDYVCSGGGVLLPHHQRNRL* | 1227 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGATGAC | 1228 |
| | 3 | MLWWWCLTSSSPEESFMMLRLNRQVLAL* | 1229 | ATGCTCTGGTGGTGGTGTCTTACTTCCTCATCACCAGAGGAATCGTTTATGATGTTA CGGTTGAACCGCCAGGTGTTGGCTCTATAG | 1230 |
| | 4 | MNKGIRGQ* | 1231 | ATGAACAAGGGCATCAGAGGCCAGTAG | 1232 |
| hsa-mir-517c | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFFHNPGPIECTKYP KTQ* | 1233 | ATGGAGACTTTGTACCGTGTCCCGTTCTTAGCGCTTGAATGTCCAACCTGAAGCTG AAGAAGCCGCCCTGGCTGCACATGCCGTTGGCCATGACTATGTATGCTCTGGTGGTG GTGTCTTACTTCCTCATCACTGACTGATGAACAAGGCATCAGAGGCCAGTAGTTTG TAGGTGTCTATGATGAACAAGGCATCAGAGGCATCAGAGGACTTGGATCCAGTTCTTGGCC TACAGAGTAAGTGGACAATATTATTACGAAGGACTTGGATCCAGTCCAGTTCTGTTTAC AATGGGAGGTTTAGGTTTCATAATCCTGGACCGATCGAATGCACCAAATATCCCAAA ACTCAATAG | 1234 |
| | 2 | MSQPEAEEAALAAHAVGHDYVCSGGGVLLPHHQRNRL* | 1235 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGATGA | 1236 |
| | 3 | MLWWWCLTSSSPEESFMMLRLNRQVLAL* | 1237 | ATGCTCTGGTGGTGGTGTCTTACTTCCTCATCACCAGAGGAATCGTTTATGATGTTA CGGTTGAACCGCCAGGTGTTGGCTCTATAG | 1238 |
| | 4 | MNKGIRGQ* | 1239 | ATGAACAAGGGCATCAGAGGCCAGTAG | 1240 |
| hsa-mir-518a-1 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFFHNPGPIECTKYP KTQ* | 1241 | ATGGAGACTTTGTACCGTGTCCCGTTCTTAGCGCTTGAATGTCCAACCTGAAGCTG AAGAAGCCGCCCTGGCTGCACATGCCGTTGGCCATGACTATGTATGCTCTGGTGGTG GTGTCTTACTTCCTCATGACTGATGAACAAGGCATCAGAGGCCAGTAGTTCTTGGCC TACAGAGTAAGTGGACAATATTATTAATCCTGAAGGACTTGGATCCAGTCCAGTTCTGTTTAC AATGGGAGGTTTAGGTTTCATAATCCTGGACCGATCGAATGCACCAAATATCCCAAA ACTCAATAG | 1242 |
| | 2 | MSQPEAEEAALAAHAVGHDYVCSGGGVLLPHHQRNRL* | 1243 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGA | 1244 |
| | 3 | MLWWWCLTSSSPEESFMMLRLNRQVLAL* | 1245 | ATGCTCTGGTGGTGGTGTCTTACTTCCTCATCACCAGAGGAATCGTTTATGATGTTA CGGTTGAACCGCCAGGTGTTGGCTCTATAG | 1246 |
| | 4 | MNKGIRGQ* | 1247 | ATGAACAAGGGCATCAGAGGCCAGTAG | 1248 |
| hsa-mir-518a-2 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFFHNPGPIECTKYP KTQ* | 1249 | ATGGAGACTTTGTACCGTGTCCCGTTCTTAGCGCTTGAATGTCCAACCTGAAGCTG AAGAAGCCGCCCTGGCTGCACATGCCGTTGGCCATGACTATGTATGCTCTGGTGGTG GTGTCTTGGCTCTATGACTGATGAACAAGGCATCAGAGGCCAGTAGTTCTTGGCC GGTGTTAAGTGGACAATATATTATTAATCCTGAAGGACTTGGATCCAGTCAGTTTCTGTTTAC TACAGAGTAAGTGGACAATATATTATTAATCCTGGACCGATCGAATGCACCAAATATCCCAAA ACTCAATAG | 1250 |
| | 2 | MSQPEAEEAALAAHAVGHDYVCSGGGVLLPHHQRNRL* | 1251 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGATGAC | 1252 |
| | 3 | MLWWWCLTSSSPEESFMMLRLNRQVLAL* | 1253 | ATGCTCTGGTGGTGGTGTCTTACTTCCTCATCACCAGAGGAATCGTTTATGATGTTA CGGTTGAACCGCCAGGTGTTGGCTCTATAG | 1254 |
| | 4 | MNKGIRGQ* | 1255 | ATGAACAAGGGCATCAGAGGCCAGTAG | 1256 |

Figure 1 (Continued)

| | | | | | |
|---|---|---|---|---|---|
| hsa-mir-518b | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVVNGRFRFHNPGPIECTKYP KTQ* | 1257 | ATGGAGACTTTGTACCGTGTCCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGGCC TACAGAGTAAGTGGACAATATTATTATGGAAGACTTGGATCGAATCCAGTTCCTGTTTAC AATGGGAGGTTTAGGTTTCATAATCCTGGACCGATCGAATGCACCAAATATCCCAAA ACTCAATAG |
| | 2 | MSQPEAEEAALAAHAVGHDYYCSGGGVLLPHHQRNRL* | 1259 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGA |
| | 3 | MLWWWCLTSSSPEESFMMLRLNRQVLAL* | 1261 | ATGCTCTGGTGGTGGTGTCTTACTTCCTCATCACCAGAGGAATCGTTTATGATGTTA CGGTTGAACCGCCAGGTGTTGGCTCTATGA |
| | 4 | MNKGIRGQ* | 1263 | ATGAACAAGGGCATCAGAGGCCAGTAG |
| hsa-mir-518c | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVVNGRFRFHNPGPIECTKYP KTQ* | 1265 | ATGGAGACTTTGTACCGTGTCCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGGCC TACAGAGTAAGTGGACAATATTATTATGGAAGACTTGGATCAGCTTCCTGTTTAC AATGGGAGGTTTAGGTTTCATAATCCTGGACCGATCGAATGCACCAAATATCCCAAA ACTCAATAG |
| | 2 | MSQPEAEEAALAAHAVGHDYYCSGGGVLLPHHQRNRL* | 1267 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGA |
| | 3 | MLWWWCLTSSSPEESFMMLRLNRQVLAL* | 1269 | ATGCTCTGGTGGTGGTGTCTTACTTCCTCATCACCAGAGGAATCGTTTATGATGTTA CGGTTGAACCGCCAGGTGTTGGCTCTATGA |
| | 4 | MNKGIRGQ* | 1271 | ATGAACAAGGGCATCAGAGGCCAGTAG |
| hsa-mir-518d | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVVNGRFRFHNPGPIECTKYP KTQ* | 1273 | ATGGAGACTTTGTACCGTGTCCCGTTCTTAGCGCTTGAATGTCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGGCC TACAGAGTAAGTGGACAATATTATTATGGAAGACTTGGATCCGAATCCAGTTCCTGTTTAC AATGGGAGGTTTAGGTTTCATAATCCTGGACCGATCGAATGCACCAAATATCCCAAA ACTCAATAG |
| | 2 | MSQPEAEEAALAAHAVGHDYYCSGGGVLLPHHQRNRL* | 1275 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGA |
| | 3 | MLWWWCLTSSSPEESFMMLRLNRQVLAL* | 1277 | ATGCTCTGGTGGTGGTGTCTTACTTCCTCATCACCAGAGGAATCGTTTATGATGTTA CGGTTGAACCGCCAGGTGTTGGCTCTATGA |
| | 4 | MNKGIRGQ* | 1279 | ATGAACAAGGGCATCAGAGGCCAGTAG |
| hsa-mir-518e | 1 | METLYRVPFLALECPNLKLKKPPWLIRMPLAMTMYALV VVSYFLITRGIVYDVTVEPPGVGSMTDEQGHQRPVAFL AYRVSGQYYYGRTWIQLPVVNGRFRFHNPGPIECTKYP KTQ* | 1281 | ATGGAGACTTTGTACCGTGTCCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGCCCAGTAGCTTTCTTGGCC TACAGAGTAAGTGGACAATATTATTATGGAAGACTTGGATCGAATCCAGCTTCCTGTTTAC AATGGGAGGTTTAGGTTTCATAATCCTGGACCGATCGAATGCACCAAATATCCCAAA ACTCAATAG | 1282 |

Figure 1 (Continued)

| | | | | |
|---|---|---|---|---|
| | 2 | MSQPEAEEAALAAHAVGHDYVCSGGGVLLPHHQRNRL* | 1283 | ATGTCCCAACCTGAAGCTGAAGAAGCGGCCCTGGCTGCACATGCCGTTGGCCATGAC TATGTATGCTCTGGTGGTGTCTTACTTCCTCATCACCAGAGGAATCGTTTATGATGAC | 1284 |
| hsa-mir-518f | 3 | MLWWWCLTSSSPEESFMMLRLNRQVLAL* | 1285 | ATGCTCTGGTGGTGGTGTCTTACTTCCTCATCACCAGAGGAATCGTTTATGATGTTA CGGTTGAACCGCCAGGTGTTGGCTCTAGAGGCCAGTAG | 1286 |
| | 4 | MNKGIRGQ* | 1287 | ATGAACAAGGGCATCAGAGGCCAGTAG | 1288 |
| | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1289 | ATGGAGACTTTGTACCGTGCCCGTTCTAGCGCTTGAATGTCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGACGTTACGGTTGAACCGCCA GGTGTGTCCTATGACTGGACACATATTATTATCCGGACCGATCAGAGGACTTGGATCAGCTTCTGGCC TACAGAGTAAGTGGACAATATTATTATCCGGACCGATCGAATGCACCAAATATCCCAAA AATGGGAGGTTTAGGTTTCATAATCCTGGACCGATCGAATGCACCAAATATCCCAAA ACTCAATAG | 1290 |
| | 2 | MSQPEAEEAALAAHAVGHDYVCSGGGVLLPHHQRNRL* | 1291 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGA | 1292 |
| | 3 | MLWWWCLTSSSPEESFMMLRLNRQVLAL* | 1293 | ATGCTCTGGTGGTGGTGTCTTACTTCCTCATCACCAGAGGAATCGTTTATGATGTTA CGGTTGAACCGCCAGGTGTTGGCTCTAG | 1294 |
| | 4 | MNKGIRGQ* | 1295 | ATGAACAAGGGCATCAGAGGCCAGTAG | 1296 |
| hsa-mir-519a-1 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1297 | ATGGAGACTTTGTACCGTGCCCGTTCTAGCGCTTGAATGTCCAACCTGAAGCTG AAGAAGCCGCCCTGGCTGCACATGCCGTTGGCCATGACTATGTATGCTCTGGTGGTG GTGTCTTACTTCCTCATGACTGATGAACAAGGCATCAGAGGCCAGTAGCTTCTTGGCC ACAGAGTAAGTGGACAATATTATTATCCGGACCGATCGAATGCACCAAATATCCCAAA AATGGGAGGTTTAGGTTTCATAATCCTGGACCGATCGAATGCACCAAATATCCCAAA ACTCAATAG | 1298 |
| | 2 | MSQPEAEEAALAAHAVGHDYVCSGGGVLLPHHQRNRL* | 1299 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGA | 1300 |
| | 3 | MLWWWCLTSSSPEESFMMLRLNRQVLAL* | 1301 | ATGCTCTGGTGGTGGTGTCTTACTTCCTCATCACCAGAGGAATCGTTTATGATGTTA CGGTTGAACCGCCAGGTGTTGGCTCAGTAG | 1302 |
| | 4 | MNKGIRGQ* | 1303 | ATGAACAAGGGCATCAGAGGCCAGTAG | 1304 |
| hsa-mir-519a-2 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1305 | ATGGAGACTTTGTACCGTGCCCGTTCTAGCGCTTGAATGTCCAACCTGAAGCTG AAGAAGCCGCCCTGGCTGCACATGCCGTTGGCCATGACTATGTATGCTCTGGTGGTG GTGTCTTACTTCCTCATGACTGATGAACAAGGCATCAGAGGCCAGTAGCTTCTTGGCC GGTGTGCCTATGACTGATGAACAAGGGCATCAGAGGCCAGTAGCTTCTTGGCC ACAGAGTAAGTGGACAATATTATTATCCGGACCGATCGAATGCACCAAATATCCCAAA AATGGGAGGTTTAGGTTTCATAATCCTGGACCGATCGAATGCACCAAATATCCCAAA ACTCAATAG | 1306 |
| | 2 | MSQPEAEEAALAAHAVGHDYVCSGGGVLLPHHQRNRL* | 1307 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGA | 1308 |
| | 3 | MLWWWCLTSSSPEESFMMLRLNRQVLAL* | 1309 | ATGCTCTGGTGGTGGTGTCTTACTTCCTCATCACCAGAGGAATCGTTTATGATGTTA CGGTTGAACCGCCAGGTGTTGGCTCAGTAG | 1310 |
| | 4 | MNKGIRGQ* | 1311 | ATGAACAAGGGCATCAGAGGCCAGTAG | 1312 |

Figure 1 (Continued)

| | | | | |
|---|---|---|---|---|
| hsa-mir-519c | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1313 | ATGGAGACTTTGTACCGTGTCCCGTTCTTAGCGCTTGAAATGTCCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGGCC TACAGAGTAAGTGGACAATATTATTACGGATCCAGTTGGATCCAGCTTCCTGTTTAC AATGGGAGGTTTAGGTTTCATAATCCTGGACCGATCGAATGCACCAAATATCCCAAA ACTCAATAG | 1314 |
| | 2 | MSQPEAEEAALAAHAVGHDYYCSGGGVLLPHHQRNRL* | 1315 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGA | 1316 |
| | 3 | MLWWWCLTSSSPEESFMMLRLNRQVLAL* | 1317 | ATGCTCTGGTGGTGTCTTACTTCCTCATCACCAGAGGAATCGTTTATGATGTTA CGGTTGAACCGCCAGGTGTTGGCTCTATGA | 1318 |
| | 4 | MNKGIRGQ* | 1319 | ATGAACAAGGGCATCAGAGGCCAGTAG | 1320 |
| hsa-mir-519d | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1321 | ATGGAGACTTTGTACCGTGTCCCGTTCTTAGCGCTTGAAATGTCCCAACCTGAAGCTG AAGAAGCCGCCCTGGCTGCACATGCCGTTGGCCATGACTATGTATGCTCTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGGCC TACAGAGTAAGTGGACAATATTATTATGGAAGGACTTGGATCCAGCTTCCTGTTTAC AATGGGAGGTTTAGGTTTCATAATCCTGGACCGATCGAATGCACCAAATATCCCAAA ACTCAATAG | 1322 |
| | 2 | MSQPEAEEAALAAHAVGHDYYCSGGGVLLPHHQRNRL* | 1323 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGA | 1324 |
| | 3 | MLWWWCLTSSSPEESFMMLRLNRQVLAL* | 1325 | ATGCTCTGGTGGTGTCTTACTTCCTCATCACCAGAGGAATCGTTTATGATGTTA CGGTTGAACCAGGTGTTGGCTCTATGA | 1326 |
| | 4 | MNKGIRGQ* | 1327 | ATGAACAAGGCATCAGAGGCCAGTAG | 1328 |
| hsa-mir-519e | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1329 | ATGGAGACTTTGTACCGTGTCCCGTTCTTAGCGCTTGAAATGTCCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGGCC TACAGAGTAAGTGGACAATATTATTATGGAAGGACTTGGATCCAGCTTCCTGTTTAC AATGGGAGGTTTAGGTTTCATAATCCTGGACCGATCGAATGCACCAAATATCCCAAA ACTCAATAG | 1330 |
| | 2 | MSQPEAEEAALAAHAVGHDYYCSGGGVLLPHHQRNRL* | 1331 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGA | 1332 |
| | 3 | MLWWWCLTSSSPEESFMMLRLNRQVLAL* | 1333 | ATGCTCTGGTGGTGTCTTACTTCCTCATCACCAGAGGAATCGTTTATGATGTTA CGGTTGAACCAGGTGTTGGCTCTATGA | 1334 |
| | 4 | MNKGIRGQ* | 1335 | ATGAACAAGGGCATCAGAGGCCAGTAG | 1336 |
| hsa-mir-520c-1 | 1 | METLYRVPFLALECPNLKLKKPPWLRMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1337 | ATGGAGACTTTGTACCGTGTCCCGTTCTTAGCGCTTGAAATGTCCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGATGAACAAGGGCATCAGAGGCCAGTAGCTTTCTTGGCC TACAGAGTAAGTGGACAATATTATTATGGAAGGACTTGGATCCAGCTTCCTGTTTAC AATGGGAGGTTTAGGTTTCATAATCCTGGACCGATCGAATGCACCAAATATCCCAAA ACTCAATAG | 1338 |

Figure 1 (Continued)

| | | | | |
|---|---|---|---|---|
| hsa-mir-520c-2 | 2 | MSQPEAEEAALAAHAVGHDYVCSGGGVLLPHHQRNRL* | 1339 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGATGAC | 1340 |
| | 3 | MLWWWCLTSSSPEESFMMLRLNRQVLAL* | 1341 | ATGCTCTGGTGGTGGTGTCTTACTTCCTCATCACCAGAGGAATCGTTTATGATGTTA CGGTTGAACCGCCAGGTGTTGGCTCTATAG | 1342 |
| | 4 | MNKGIRGQ* | 1343 | ATGAACAAGGGCATCAGAGGCCAGTAG | 1344 |
| | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFFHNPGPIECTKYP KTQ* | 1345 | ATGGAGACTTTGTACCGTGCCGTTCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTACTTCCTCATCACTGACTGATGAACAAGGCATCAGAGGCCAGTAGTTCTTGCC TACAGAGTAAGTGGACAATATTATTATCCTGGACCGATCGAATGCACCAAATATCCCAAA ACTCAATAG | 1346 |
| | 2 | MSQPEAEEAALAAHAVGHDYVCSGGGVLLPHHQRNRL* | 1347 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGATGTTA | 1348 |
| | 3 | MLWWWCLTSSSPEESFMMLRLNRQVLAL* | 1349 | ATGCTCTGGTGGTGGTGTCTTACTTCCTCATCACCAGAGGAATCGTTTATGATGTTA CGGTTGAACCGCCAGGTGTTGGCTCTATGA | 1350 |
| | 4 | MNKGIRGQ* | 1351 | ATGAACAAGGGCATCAGAGGCCAGTAG | 1352 |
| hsa-mir-520d | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFFHNPGPIECTKYP KTQ* | 1353 | ATGGAGACTTTGTACCGTGCCGTTCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTACTTCCTCATCACTGACTGATGAACAAGGCATCAGAGGCCAGTAGTTCTTGCC TACAGAGTAAGTGGACAATATTATTATCCTGGACCGATCGAATGCACCAAATATCCCAAA ACTCAATAG | 1354 |
| | 2 | MSQPEAEEAALAAHAVGHDYVCSGGGVLLPHHQRNRL* | 1355 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGATGAC | 1356 |
| | 3 | MLWWWCLTSSSPEESFMMLRLNRQVLAL* | 1357 | ATGCTCTGGTGGTGGTGTCTTACTTCCTCATCACCAGAGGAATCGTTTATGATGTTA CGGTTGAACCGCCAGGTGTTGGCTCTATGA | 1358 |
| | 4 | MNKGIRGQ* | 1359 | ATGAACAAGGGCATCAGAGGCCAGTAG | 1360 |
| hsa-mir-520e | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFFHNPGPIECTKYP KTQ* | 1361 | ATGGAGACTTTGTACCGTGCCGTTCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTACTTCCTCATCACTGACTGATGAACAAGGCATCAGAGGCCAGTAGTTCTTGCC TACAGAGTAAGTGGACAATATTATTATCCTGGACCGATCGAATGCACCAAATATCCCAAA ACTCAATAG | 1362 |
| | 2 | MSQPEAEEAALAAHAVGHDYVCSGGGVLLPHHQRNRL* | 1363 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGATGAC | 1364 |
| | 3 | MLWWWCLTSSSPEESFMMLRLNRQVLAL* | 1365 | ATGCTCTGGTGGTGGTGTCTTACTTCCTCATCACCAGAGGAATCGTTTATGATGTTA CGGTTGAACCGCCAGGTGTTGGCTCTATGA | 1366 |
| | 4 | MNKGIRGQ* | 1367 | ATGAACAAGGGCATCAGAGGCCAGTAG | 1368 |

Figure 1 (Continued)

| | | | | |
|---|---|---|---|---|
| hsa-mir-520f | 1 | METLYRVPFLALECPNLKLKKPPWLHMPLAMTMYALVVVSYFLITRGIVYDVTVEPPGVGSMTDEQGHQRPVAFLAYRVSGQYYYGRTWIQLPVVNGRFRFHNPGPIECTKYPKTQ* | 1369 | ATGGAGACTTTGTACCGTGTCCGTTCTTAGCGCTTGAATGTCCAACCTGAAGCTGAAGAAGCCGCCCTTCCTCATCACCAGAGGAATGTCTTGGTGGTGGTGTCTTACTTCCTCATCACCAGAGGAATCGTTTATGATGTTACGGTTGAACCGCAGTAGCTTTCTTGGCCGGTGTTGGCTCTATGACTGATGAACAAGGGCATCAGAGGCCAGTAGCTTTCTTGGCCTACAGAGTAAGTGGACAATATTATTAGGAAGGACTTGGATCCAGCTTCCTGTTTACAATGGGAGGTTTAGGTTTCATAATCCTGGACCGATCGAATGCACCAAATATCCCAAAACTCAATAG | 1370 |
| | 2 | MSQPEAEEAALAAHAVGHDYVCSGGGVLLPHHQRNRL* | 1371 | ATGTCCCAACCTGAAGCTGAAGAAGCCGCCCTGGCTGCACATGCCGTTGGCCATGACTATGTATCTCTGGTGGTGTCTTACTTCCTCATCACCAGAGGAATCGTTTATGA | 1372 |
| | 3 | MLWWWCLTSSSPEESFMMLRLNRQVLAL* | 1373 | ATGCTCTGGTGGTGGTGTCTTACTTCCTCATCACCAGAGGAATCGTTTATGATGTTACGGTTGAACCGCCAGGTGTTGGCTCTATGA | 1374 |
| | 4 | MNKGIRGQ* | 1375 | ATGAACAAGGGCATCAGAGGCCAGTAG | 1376 |
| hsa-mir-520g | 1 | METLYRVPFLALECPNLKLKKPPWLHMPLAMTMYALVVVSYFLITRGIVYDVTVEPPGVGSMTDEQGHQRPVAFLAYRVSGQYYYGRTWIQLPVVNGRFRFHNPGPIECTKYPKTQ* | 1377 | ATGGAGACTTTGTACCGTGTCCGTTCTTAGCGCTTGAATGTCCAACCTGAAGCTGAAGAAGCCGCCCTTCCTCATCACCAGAGGAATGTCTTGGTGGTGTCTTACTTCCTCATCACCAGAGGAATCGTTTATGATGTTACGGTTGAACCGCAGTAGCTTTCTTGGCCGGTGTTGGCTCTATGACTGATGAACAAGGGCATCAGAGGCCAGTAGCTTTCTTGGCCTACAGAGTAAGTGGACAATATTATTAGGAAGGACTTGGATCCAGCTTCCTGTTTACAATGGGAGGTTTAGGTTTCATAATCCTGGACCGATCGAATGCACCAAATATCCCAAAACTCAATAG | 1378 |
| | 2 | MSQPEAEEAALAAHAVGHDYVCSGGGVLLPHHQRNRL* | 1379 | ATGTCCCAACCTGAAGCTGAAGAAGCCGCCCTGGCTGCACATGCCGTTGGCCATGACTATGTATCTCTGGTGGTGTCTTACTTCCTCATCACCAGAGGAATCGTTTATGA | 1380 |
| | 3 | MLWWWCLTSSSPEESFMMLRLNRQVLAL* | 1381 | ATGCTCTGGTGGTGTCTTACTTCCTCATCACCAGAGGAATCGTTTATGATGTTACGGTTGAACCGCCAGGTGTTGGCTCTATGA | 1382 |
| | 4 | MNKGIRGQ* | 1383 | ATGAACAAGGGCATCAGAGGCCAGTAG | 1384 |
| hsa-mir-520h | 1 | METLYRVPFLALECPNLKLKKPPWLHMPLAMTMYALVVVSYFLITRGIVYDVTVEPPGVGSMTDEQGHQRPVAFLAYRVSGQYYYGRTWIQLPVVNGRFRFHNPGPIECTKYPKTQ* | 1385 | ATGGAGACTTTGTACCGTGTCCGTTCTTAGCGCTTGAATGTCCAACCTGAAGCTGAAGAAGCCGCCCTTCCTCATCACCAGAGGAATGTCTTGGTGGTGTCTTACTTCCTCATCACCAGAGGAATCGTTTATGATGTTACGGTTGAACCGCAGTAGCTTTCTTGGCCGGTGTTGGCTCTATGACTGATGAACAAGGGCATCAGAGGCCAGTAGCTTTCTTGGCCTACAGAGTAAGTGGACAATATTATTAGGAAGGACTTGGATCCAGCTTCCTGTTTACAATGGGAGGTTTAGGTTTCATAATCCTGGACCGATCGAATGCACCAAATATCCCAAAACTCAATAG | 1386 |
| | 2 | MSQPEAEEAALAAHAVGHDYVCSGGGVLLPHHQRNRL* | 1387 | ATGTCCCAACCTGAAGCTGAAGAAGCCGCCCTGGCTGCACATGCCGTTGGCCATGACTATGTATCTCTGGTGGTGTCTTACTTCCTCATCACCAGAGGAATCGTTTATGA | 1388 |
| | 3 | MLWWWCLTSSSPEESFMMLRLNRQVLAL* | 1389 | ATGCTCTGGTGGTGTCTTACTTCCTCATCACCAGAGGAATCGTTTATGATGTTACGGTTGAACCGCCAGGTGTTGGCTCTATGA | 1390 |
| | 4 | MNKGIRGQ* | 1391 | ATGAACAAGGGCATCAGAGGCCAGTAG | 1392 |
| hsa-mir-521-1 | 1 | METLYRVPFLALECPNLKLRMPLAMTMYALVVVSYFLITRGIVYDVTVEPPGVGSMTDEQGHQRPVAFLAYRVSGQYYYGRTWIQLPVVNGRFRFHNPGPIECTKYPKTQ* | 1393 | ATGGAGACTTTGTACCGTGTCCGTTCTTAGCGCTTGAATGTCCAACCTGAAGCTGAAGAAGCCGCCCTTCCTCATCACCAGAGGAATGTCTTGGTGGTGGTGTCTTACTTCCTCATCACCAGAGGAATCGTTTATGATGTTACGGTTGAACCGCCAGGTGTTGGCTCTATGACTGATGAACAAGGCCATCAGAGGCCATCAGAGCCAGTAGCTTTCTTGGCCTACAGAGTAAGTGGACAATATTATTAGGAAGGACTTGGATCCAGCTTCCTGTTTACAATGGGAGGTTTAGGTTTCATAATCCTGGACCGATCGAATGCACCAAATATCCCAAAACTCAATAG | 1394 |

Figure 1 (Continued)

| | | | | |
|---|---|---|---|---|
| hsa-mir-521-2 | 2 | MSQPEAEEAALAAHAVGHDYVCSGGGVLLPHHQRNRL* | 1395 | ATGTCCCAACCTGAAGCTGAAGAAGCCGCCCTGGCTGCACATGCCGTTGGCCATGAC TATGTATGCTCTGGTGGTGGTCTTACTTCCTCATCACCAGAGGAATCGTTTATGATGAC | 1396 |
| | 3 | MLWWWCLTSSSPEESFMMLRLNRQVLAL* | 1397 | ATGCTCTGGTGGTGGTGGTGTCTTACTTCCTCATCACCAGAGGAATCGTTTATGATGTTA CGGTTGAACCGCCAGGTGTTGGCTCAGTCTTATAG | 1398 |
| | 4 | MNKGIRGQ* | 1399 | ATGAACAAGGGCATCAGAGGCCAGTAG | 1400 |
| | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1401 | ATGGAGACTTTGTACCGTGTCCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTACTTCCTCATCACTGACTAATGAACAAGGGCATCAGAGGCCAGTGAACCGCCA GGTGTTGGCTCTATGATGGACAAGTAAGTGGACAATATTATTATGGAAGGACTTGGATCGACTTCTTGGCC TACAGAGTAAGTGGACAATATTAGGTTTCATAATCCTGGACCGATCGAATGCACCAGCTCCTGTTTAC AATGGGAGGTTTAGGTTTCATAATCCTGGACCGATCGAATGCACCAAATATCCCAAA ACTCAATAG | 1402 |
| | 2 | MSQPEAEEAALAAHAVGHDYVCSGGGVLLPHHQRNRL* | 1403 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGATGA | 1404 |
| | 3 | MLWWWCLTSSSPEESFMMLRLNRQVLAL* | 1405 | ATGCTCTGGTGGTGGTGTCTTACTTCCTCATCACCAGAGGAATCGTTTATGATGTTA CGGTTGAACCGCCAGGTGTTGGCTCAGTGA | 1406 |
| | 4 | MNKGIRGQ* | 1407 | ATGAACAAGGGCATCAGAGGCCAGTAG | 1408 |
| hsa-mir-522 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1409 | ATGGAGACTTTGTACCGTGTCCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTACTTCCTCATGACTGATGAACAAGGGCATCAGAGGCCAGTGAACCGCCA GGTGTTGGCTCTATGATGGACAAGTAAGTGGACAATATTATTATGGAAGGACTTGGATCGACTTCTTGGCC TACAGAGTAAGTGGACAATATTATTATGGAAGGACTTGGATCAGCTTCCTGTTTAC AATGGGAGGTTTAGGTTTCATAATCCTGGACCGATCGAATGCACCAAATATCCCAAA ACTCAATAG | 1410 |
| | 2 | MSQPEAEEAALAAHAVGHDYVCSGGGVLLPHHQRNRL* | 1411 | ATGTCCCAACCTGAAGCTGAAGAAGCCGCCTTGGCTGCACATGCCGTTGGCCATGAC TATGTATGCTCTGTGGTGGTGTCTTACTTCCTCATCACCAGAGGAATCGTTTATGA | 1412 |
| | 3 | MLWWWCLTSSSPEESFMMLRLNRQVLAL* | 1413 | ATGCTCTGGTGGTGGTGTCTTACTTCCTCATCACCAGAGGAATCGTTTATGATGTTA CGGTTGAACCGCCAGGTGTTGGCTCAGTAG | 1414 |
| | 4 | MNKGIRGQ* | 1415 | ATGAACAAGGGCATCAGAGGCCAGTAG | 1416 |
| hsa-mir-524 | 1 | METLYRVPFLALECPNLKLKKPPWLHMPLAMTMYALV VVSYFLITRGIVYDVTVEPPGVGSMTDEQGHQRPVAFL AYRVSGQYYYGRTWIQLPVYNGRFRFHNPGPIECTKYP KTQ* | 1417 | ATGGAGACTTTGTACCGTGTCCCGTTCTTAGCGCTTGAATGTCCCAACCTGAAGCTG AAGAAGCCGCCCTGGCTGCACATGCCGTTGGCCATGACTATGTATGCTCTGGTGGTG GTGTCTTGGCTCTATGATGACAAGGGCATCAGAGCCAGTGAACCGCCAGGTGTTGGCC GGTGTTGGCTCTATGATGGACAAGTAAGTGGACATTATATTATGGAAGGACTTGGATCAGCTTCTTGGCC TACAGAGTAAGTGGACAATATTATTATGGAAGGACTTGGATCAGCTTCCTGTTTAC AATGGGAGGTTTAGGTTTCATAATCCTGGACCGATCGAATGCACCAAATATCCAAA ACTCAATAG | 1418 |
| | 2 | MSQPEAEEAALAAHAVGHDYVCSGGGVLLPHHQRNRL* | 1419 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTTATGATGAC | 1420 |
| | 3 | MLWWWCLTSSPEESFMMLRLNRQVLAL* | 1421 | ATGCTCTGGTCGTGGTGTCTTACTTCCTCATCACCAGAGGAATCGTTTATGATGTTA CGGTTGAACCGCCAGGTGTTGGCTCAGTAG | 1422 |
| | 4 | MNKGIRGQ* | 1423 | ATGAACAAGGGCATCAGAGGCCAGTAG | 1424 |

Figure 1 (Continued)

| | | | | | | |
|---|---|---|---|---|---|---|
| hsa-mir-526a-1 | 1 | METLYRVPFLALECPNLKLKKPPWLHMPLAMTMYALV VVSYFLJTRGIVYDVTVEPPGVGSMTDEQGHQRPVAFL AYRVSGQYYYGRTWIQLPVYNGRFRFHNPGIIECTKYP KTQ* | 1425 | ATGGAGACTTTGTACCGTGTCCGTTCTTAGCGCTTGAATGTCCAACCTGAAGCTG AAGAAGCCGCCCTGGCTGCACATGCCGTTGGCCATGACTATGTATGCTCTGGTGGTG GTGTCTTACTTCTGTTCTGGTGGTGTCTTACTTCCTCATCACCAGAGGAATCGTTTATGATGTTA GGTTGTTGGCTCTATGACTGGACAATATTATTGAAGGACTTGATCCAGCTTCTGTTAC ACAGAGTAAGTGGACAATATTCATAATCCTGACCGATCGAATGCACCAAATATCCCAAA ACTCAATAG | 1426 |
| | 2 | MSQPEAEEAALAAHAVGHDYVCSGGGVLLPHFQRNRL* | 1427 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGA | 1428 |
| | 3 | MLWWWCLTSSSPEESFMMLRLNRQVLAL* | 1429 | ATGCTCTGGTGGTGTCTTACTTCCTCATCACCAGAGGAATCGTTTATGATGTTA CGGTTGAACCGCCAGGTGTTGGCTCTATGA | 1430 |
| | 4 | MNKGIRGQ* | 1431 | ATGAACAAGGCATCAGAGGCCAGTAG | 1432 |
| hsa-mir-526a-2 | 1 | METLYRVPFLALECPNLKLKKPPWLHMPLAMTMYALV VVSYFLJTRGIVYDVTVEPPGVGSMTDEQGHQRPVAFL AYRVSGQYYYGRTWIQLPVYNGRFRFHNPGIIECTKYP KTQ* | 1433 | ATGGAGACTTTGTACCGTGTCCGTTCTTAGCGCTTGAATGTCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGGACAATATTATTGAAGGACTTGATCCAGCTTCTGTTAC ACAGAGTAAGTGGACAATATTCATAATCCTGACCGATCGAATGCACCAAATATCCCAAA ACTCAATAG | 1434 |
| | 2 | MSQPEAEEAALAAHAVGHDYVCSGGGVLLPHFQRNRL* | 1435 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGA | 1436 |
| | 3 | MLWWWCLTSSSPEESFMMLRLNRQVLAL* | 1437 | ATGCTCTGGTGGTGTCTTACTTCCTCATCACCAGAGGAATCGTTTATGATGTTA CGGTTGAACCGCCAGGTGTTGGCTCTATGA | 1438 |
| | 4 | MNKGIRGQ* | 1439 | ATGAACAAGGCATCAGAGGCCAGTAG | 1440 |
| hsa-mir-527 | 1 | METLYRVPFLALECPNLKLKKPPWLHMPLAMTMYALV VVSYFLJTRGIVYDVTVEPPGVGSMTDEQGHQRPVAFL AYRVSGQYYYGRTWIQLPVYNGRFRFHNPGIIECTKYP KTQ* | 1441 | ATGGAGACTTTGTACCGTGTCCGTTCTTAGCGCTTGAATGTCCAACCTGAAGCTG AAGAAGCCGCCCTGGCTGCACATGCCGTTGGCCATGACTATGTATGCTCTGGTGGTG GTGTCTTACTTCCTCATCACCAGAGGAATCGTTTATGATGTTACGGTTGAACCGCCA GGTGTTGGCTCTATGACTGGACAATATTATTGAAGGACTTGATCCAGCTTCTGTTAC ACAGAGTAAGTGGACAATATTCATAATCCTGACCGATCGAATGCACCAAATATCCCAAA ACTCAATAG | 1442 |
| | 2 | MSQPEAEEAALAAHAVGHDYVCSGGGVLLPHFQRNRL* | 1443 | ATGTCCCAACCTGAAGCTGAAGAAGCCGCCCTGGCTGCACATGCCGTTGGCCATGAC TATGTATGCTCTGGTGGTGTCTTACTTCCTCATCACCAGAGGAATCGTTTATGA | 1444 |
| | 3 | MLWWWCLTSSSPEESFMMLRLNRQVLAL* | 1445 | ATGCTCTGGTGGTGTCTTACTTCCTCATCACCAGAGGAATCGTTTATGATGTTA CGGTTGAACCGCCAGGTGTTGGCTCTATGA | 1446 |
| | 4 | MNKGIRGQ* | 1447 | ATGAACAAGGCATCAGAGGCCAGTAG | 1448 |
| hsa-mir-539 | 1 | MFPNPGSMMTTGGV* | 1449 | ATGCCCAATCTGGATCGATGATGACCACTGGTGCGTATGA | 1450 |
| | 2 | MSIIT* | 1451 | ATGAGTCATACATGA | 1452 |
| | 3 | MMNMCLEL* | 1453 | ATGATGAATATGTCTGGAACTCTGA | 1454 |
| | 4 | MHSYVIIMIGSMKE* | 1455 | ATGCATTCTTATGTTATTATTGGTCAATGAAAGAATGA | 1456 |
| hsa-mir-541 | 1 | MFPNPGSMMTTGGV* | 1457 | ATGCCCAATCTGGATCGATGATGACCACTGGTGCGTATGA | 1458 |
| | 2 | MSIIT* | 1459 | ATGAGTCATACATGA | 1460 |
| | 3 | MMNMCLEL* | 1461 | ATGATGAATATGTCTGGAACTCTGA | 1462 |

Figure 1 (Continued)

| | | | | | |
|---|---|---|---|---|---|
| hsa-mir-543 | 4 | MHSYVIEMIGSMKE* | 1463 | ATGCATTCTTATGTTATTATATGATTGGTCAATGAAAGAATGA | 1464 |
| | 1 | MPNFGSMMTTGGV* | 1465 | ATGCCCAATCTGGATCGGATGATGACCACTGGTGGCGTATGA | 1466 |
| | 2 | MSHT* | 1467 | ATGAGTCATACATGA | 1468 |
| | 3 | MMNMCLEL* | 1469 | ATGATGAATATGTCTTGAACTGA | 1470 |
| | 4 | MHSYVIEMIGSMKE* | 1471 | ATGCATTCTTATGTTATTATATGATTGGGTCAATGAAAGAATGA | 1472 |
| hsa-mir-544 | 1 | MPNFGSMMTTGGV* | 1473 | ATGCCCAATCTGGATGGATGATGACCACTGGTGCGTATGA | 1474 |
| | 2 | MSHT* | 1475 | ATGAGTCATACATGA | 1476 |
| | 3 | MMNMCLEL* | 1477 | ATGATGAATATGTCTGGAACTGA | 1478 |
| | 4 | MHSYVIEMIGSMKE* | 1479 | ATGCATTCTTATGTTATTATATGGTCAATGAAAGAATGA | 1480 |
| hsa-mir-548a-2 | 1 | MARFRLTATSASRVQAILLPQSPEKLGLQAPATTPS* | 1481 | ATGGCACGATTCGGTCACTGCAACCTCTGCCTCCGGGTTCAAGCGATTCCTG CCTCAGTTCCCGAGAAGCTGGGATTACAGGCACCGCACCCGCCAGCTAA | 1482 |
| | 2 | MLVRLVLNS* | 1483 | ATGTTGGTCAGGCTGGTCTTGAACTCTGA | 1484 |
| | 3 | MSTGKQRHKEA* | 1485 | ATGTCAACTGGAAAACAGAGGCACAAGAGGCTTAG | 1486 |
| | 4 | MVLGWNSEGLVLNSLLFTIFCQ* | 1487 | ATGGTGCTGGGTTGGAACTCAGAAGGTCTTGTTCTAAATTCCTACTTTTCACCATTT TTTGCCAATAA | 1488 |
| | 1 | MQPRIPELE* | 1489 | ATGCAGCCTCGAATTCCTGAGTCGAGTGA | 1490 |
| | 2 | MFSRDGVSPCWPDWS* | 1491 | ATGTTTAGHAGAGATGGGGTTTCACCATGTGCCGGACTGGTCTTGA | 1492 |
| hsa-mir-548a-3 | 3 | MGFFHHVGRTGLELLTSGDPACLGLPKCWDDTCEPLCPA KKKKNSFFRDRVFLYCPDWS* | 1493 | ATGGGGTTTCACCATGTTGGCCGGACTGGTCTTGGCCCTGAACTCTGGACCTCAGGTGATCCT GCCTGCCTGCGCTCCCAAAGTGCTGGGATGATACATGTGAGCCACTGTGCCCAGCC AAAAAAAAAAAATTCTTTTTAGAGATAGAGTCTTCCGTATTGCCCAGAC TGGTCTTAA | 1494 |
| | 4 | MLAGLVLNS* | 1495 | ATGTTGCCGGACTGGTCTTGAACTCTGA | 1496 |
| | 1 | MVFHQRGFVVENGREGMNKQPRLLVSRKEVEQGLLCL F* | 1497 | ATGGTCTTTCATCAAAGGGGTTGTTGTTGAAAACGGCAGAGAAGGGATGAATAA GCAGCCAAGGCTCTTGGTTTCCGAAAAGAGGTTGAACAGGACTGCTGTGTCTCTT TTAG | 1498 |
| hsa-mir-548d-2 | 2 | MKVQI* | 1499 | ATGAAAGTACAGATTTAG | 1500 |
| | 3 | MKPVSNTKGCPEAHTAPISFQYSKSNIY* | 1501 | ATGAAGCCTGTTTCTAACACCAAAGGCTGCCCAGAGGCCACACAGCCTTCATTTCA TTCCAATATTCCAAATCCAAACATCTACTGA | 1502 |
| | 4 | MPSLSTGRTQRQPTGLTW* | 1503 | ATGCCATCACTCTCAACAGGAAGGACCCAGAGGACCAGCCCAGGCCTGACTTGGTGA | 1504 |
| | 1 | MWRIDYFAFPSAMIVVYLGQHQPS* | 1505 | ATGTGGAGGATAGTGTTTGCTTTCCCTTCTGCCATGATTGTAGTTACCTGGGACAA CACCAGCCATCCTGA | 1506 |
| hsa-mir-548m | 2 | MCLLSLLP* | 1507 | ATGTGTTTGCTTCCCTCTGCCATGA | 1508 |
| | 3 | MSLLAM* | 1509 | ATGTCTTTATTAGCAATGTGA | 1510 |
| | 4 | MWKQIWK* | 1511 | ATGTGGAAGCAAATTTGGAAGTGA | 1512 |
| | 1 | MAPEELR* | 1513 | ATGGCTCCGGAGGAGCTGAGGTAG | 1514 |
| hsa-mir-548h-2 | 2 | MGYGRVFFLMSFAVDHS* | 1515 | ATGGGCTACGGCCGTGTTTTCTTTTTGATGTCCTTTGCAGTGGATCACAGCTAG | 1516 |
| | 3 | MALCTCTVAKAYLLSV* | 1517 | ATGGCTTTATGTACATGCACAGTAGCAAAGGCGTACTTGCTGTCAGTGTAA | 1518 |
| | 4 | MYMHSSKGVLAVSVNVNTFTLYRRA* | 1519 | ATGTACATGCACAGTAGCAAGGCGTACTTGCTGTCAGTGTAAATGTTAATACGTTT ACTCTTTATCGGAGAGGCCTGA | 1520 |
| | 1 | MGAAHQHVTCIHM* | 1521 | ATGGGTGCAGCACACCAACAGTGCACATGTCAATGTATACATATGTAA | 1522 |
| hsa-mir-548i-4 | 2 | MSHVYICNRKPACHAHVP* | 1523 | ATGTCACATGTATACATATGTAACAACCTGCATGTCATGCACATGTGCCTAG | 1524 |
| | 3 | MYTYVTNLHVMHMCPRT* | 1525 | ATGTATACATATGTAACAAACCTGCATGCACATGTGCCTAGAACTAAGTGTATAA | 1526 |
| | 4 | MSCTCALELNV* | 1527 | ATGTCATGCACATGTGCCTAGAACTAAGTGTATAA | 1528 |

Figure 1 (Continued)

| | | | | |
|---|---|---|---|---|
| hsa-mir-548q | 1 | MHSKGLLPELMAPVFLSSLQFCNIQEGLRVAVLGLAWEPVKYHLHRVLCRIGESHCS* | 1529 | ATGCACAGCAAAGGCCTTCTCCATTCTTATGGCCCCGTGTCCTGTCTCACTACAGTTCTGCAACATACAAGGAGGGCTGAGAGTAGCAGTCCTGGGGTTGGCATGGAACCAGTGAAGTATCATTTGCAGTGTTTTATGTAGAATTGGGAATCTCATTGTTCCTAG | 1530 |
| | 2 | MGTSEVSFASCFM* | 1531 | ATGGAACCAGTGAAGTATCATTTGCATCGTGTTTATGTAG | 1532 |
| | 3 | MEAEKLQPWTCPCTAAWALNTKRSLHFPFSEELLDLMTPGFHMVTIYHGGRRCQGLSSLLLSRNVHPPG* | 1533 | ATGGAGGCTGAGAAGCTACAGCCTTGGTCCTTGCACTGCCTGCGTGGGCCTTGAACACAAAGAGGAGCCTACATTTTTTTTTCTGAAGAGCTGCTGGACTTGATGACTCCTGGGATTCATCATCATGGGATTTATCACGGGGAGACTGTCAAGGACTGTCATCTCTGCTGTTGTCCAGGAATGTCCACCCTCCAGGATAA | 1534 |
| | 4 | MSRTVISAVVQECPPSRIILTQ* | 1535 | ATGTCAAGGACTGTCATCTCTGCTGTTGTCCAGGAATGTCCACCTCCAGGATAATCCTCACCCAGTGA | 1536 |
| hsa-mir-549_os | 1 | MGHTPLPAYLSPRLTGKSKCLJ* | 1537 | ATGGGAACAATAACACCACTCCCTGCTATCTCTCACCAAGGCTTACTGGGAAGAGTAAATGCTTGATTTGA | 1538 |
| | 2 | MLDLSHFSAPGRQNNDLEIKPG* | 1539 | ATGCTTGATTGAGCCATTTCTCTGCCCCTGGTAGACAAAATAATGATCTTGAAATCAAGCCTGGGTGA | 1540 |
| | 3 | MILKSSLGELGEGGQESPSPSSFLVVREASMPPPSFVT* | 1541 | ATGATCTTGAAATCAAGCCTGGGTGAGCTTGGGGAGCTGGAAGGTGGGCAAGAATCCCTCCAGCTTCTGTGGTGTCAGGAGAAGCTTCTATGTTCCCCCTTCCTTGTGACCTAG | 1542 |
| | 4 | MPWLLEDWIACTGSTIKILFWLRTQKSIFVDTRNHRNRKAELRGLVPMGQKSSLTNCIDAETLL* | 1543 | ATGCCGTGCTCCTGGAGGACTGGATTGCCTGCACAGGGTCCACTAAGATCCTTTCTGGCTAAGGACCCAAAGTCTATCTTTGTGGACCACCAGAACCACAGAAACAGGAAGCAGAGCTCAGAGTTCTGTTCCATGGGACAGAAATCTTCCCTGACAAATTGTGATGCAGAAACCCTTCTCGA | 1544 |
| | 1 | MHAACLPSLLWL* | 1545 | ATGCACGCAGCATGCCTTCCCAGCCTCGTGGTTGTAG | 1546 |
| | 2 | MPSQPVVVECIEGSWITMDSG* | 1547 | ATGCCTTCCCAGCCTCGTGGTTGTAGAGGTGTATAGAAGGCAGTTGGATCACTATGGACAGCGGGTAA | 1548 |
| hsa-mir-552 | 3 | MEDPEGJKKGLLLVGSPVKSTYKLIRHNAISR* | 1549 | ATGGAGGACCCTGAAGGTAAGAAGGTCTTACTTGTTGTGAGCCTAGTTAAATCCACTTACAAATTAATTAGACACAATGCCATTTCCAGATGA | 1550 |
| | 4 | MPPPDESSGKATVVRACSRSS* | 1551 | ATGCCCCATTTCCAGAATGAGAGTTCTGAAGGCTACTGTCGTGGTTAGGGCTTGTGTTCTCGTTCCTCCTAG | 1552 |
| | 1 | MELGELLYNKSFYIKTASGNKVSLQSVLCGSQNHLLNRKTMW* | 1553 | ATGGAGTTAGGTGAGCTGCTCTACAACAAGTCTGAGTATATCAAGACGGCATCGGGAACAAAGTCAGTCTCCAGTGAGTTGTGTGGAAGCCAGAACATACTTCTCAATCGCAAGACCATGTGGTGA | 1554 |
| hsa-mir-557 | 2 | MTVLSEGIWKT* | 1555 | ATGACTGTATTATCTGAGGGGATCTGGAAAACATAA | 1556 |
| | 3 | MDSIVL* | 1557 | ATGGACTCCATTGTGTTGTGA | 1558 |
| | 4 | MSLLRKSVWSTQLRLVLAPMLARTA* | 1559 | ATGTCTTTATTGAGGAAGAGTGTGGTCAACGCAGCTCAGATTGGTTCTTGCATTCATGTTGGCAAGAACTGCGTGA | 1560 |
| | 1 | MGEPDLHVEKA* | 1561 | ATGGGCGAGCCGGACTTGCACGTGGAGAAAGCGTGA | 1562 |
| hsa-mir-563 | 2 | MCPWVWGGWGAKEWDERWSRNGGRCCPPRGLQAETG* | 1563 | ATGTGCCCCTGGGTTTGGGGAGGCTGGGGAGCCAAGGAGTGGGATGAGAGGTGGTCACGGAATGGGGGGCGCTGCTGTCCTCCCGGGGCTGCAGGCCGAGACGGGTGA | 1564 |
| | 3 | MRGGHGMGGAAVLPGGCRPRPGEGRG* | 1565 | ATGAGAGGTGGTCACGGAATGGGGGGCGCTGCACGGAGGGCGGGGCTGA | 1566 |
| | 4 | MLALWTEGRRLRSRTGCGRPIVFLPVVPIRS* | 1567 | ATGCTGGCACTCTGGACCGAAGGGCGTCGTCTTCGCAGCGAACAGGTTGTGGACGCCAATCGTTTTCTGCCCGTAGTCCAATCCGAAGCTAA | 1568 |
| | 1 | MPPEPAVHEESA* | 1569 | ATGCCTCCTGAGCTGCAGTGCATGAAGAGAGTGCTTGA | 1570 |

Figure 1 (Continued)

| | | | | |
|---|---|---|---|---|
| hsa-mir-568 | 2 | MKRVLELTQPPGLLGLDITSHWNSSSLFPLFVFS* | 1571 | ATGAAGAGAGTGCTGGAGCTGACCCAGCCACCAGGCCTTCTGGGGCTAGACATAAC TTCCCACTGGAACAGCAGCAGCCTCTTCCCCTCTTTGTTTTCAATGA | 1572 |
| | 3 | MKKTAVLLGSQEIDYMGQTFKSMLYPGAQATYRGIRKG ARKSPCS* | 1573 | ATGAAGAAAACGGCTGTTCTTCTAGGTAGCCAGGAAATAGATTACATGGGGCAAAC TTTCAAAAGCAATCTCTACCCTGGTGCTCAGGCTACATACAGAGGCAGAAAAGGGG CACGGAAGAGCCCTTGCTCTGA | 1574 |
| | 4 | MWKLLIQSHSSTEYQDDQPDQNIAKSPLSL* | 1575 | ATGTGGAAACTACTAATCCAAAGCATCATTTCTAGCACTGAGTATCAAGACGATCAG CCTGACCAAAATATTGCAAAGAGTTTCTAAGTCTCTGA | 1576 |
| hsa-mir-572 | 1 | MRWKVG* | 1577 | ATGCGGTGGAAGGTCGGCTGA | 1578 |
| | 2 | MIDRARWPSSV* | 1579 | ATGGACCGAGCACGGTGGCCGAGCTCAGTTGA | 1580 |
| | 3 | MGYPRGADTGRLRLLEEKRGVGFLS* | 1581 | ATGGGTTACCCAGAGGGGCGGATACGGGAAGATTAAGGTTGTTGGAGGAGAAACG TGGAGTAGGCTTTTTGTCTGA | 1582 |
| | 4 | MNCA* | 1583 | ATGAACTGTGCCTGA | 1584 |
| hsa-mir-573 | 1 | MRKNILRRSMLSTNLKFSYKPGL* | 1585 | ATGAGGAAGAACATTCTGAGGCGCAGCATGTTAAGCACAAATTTAAAGTTTCATAC AAGCCTGGCTATAG | 1586 |
| | 2 | MKNRFYNLIVVLIKNSLLNMLQH* | 1587 | ATGAAAAATAGAITTTATAACTTGATTGTGGTACATAATAAAAACAGCCTTTTAAAC ATGTTACAGCACTAA | 1588 |
| | 3 | MVNDFKFLAIKKG* | 1589 | ATGGTTGAACGATTTCAAGTTTTTAGCAATCAAGAAGGTTGA | 1590 |
| | 4 | MQHFI* | 1591 | ATGCAACATATATTATATGA | 1592 |
| hsa-mir-583 | 1 | MCSHCSTPTYE* | 1593 | ATGTGTTCTCATTGTTCAACTCCACTTATGAGTGA | 1594 |
| | 2 | MSENMRCLLF* | 1595 | ATGAGTGAGAACATGCGTGTTTGCTTTTCTGA | 1596 |
| | 3 | MVSSFHVPAKDMNSSFFMAA* | 1597 | ATGGTTTCCAGCTTCATCATTGTCCCTGCAAAGGACATGAACTCATCCTTTTTTATGG CTGCATAG | 1598 |
| | 4 | MSLQRT* | 1599 | ATGTCCCTGCAAAGGACATGA | 1600 |
| hsa-mir-587 | 1 | MQRQMQEECDLYYNESKNIFK* | 1601 | ATGCAGCGACAGATGCAAGAATGTGACTTATATTATAATGAAAGCAAAAATAT TTTCAAATAG | 1602 |
| | 2 | MKAKIFSNRFRGLJNRRSGYECQPKGEQRKRS* | 1603 | ATGAAAGCAAAAATATTTCAAATAGATTCAGGGGGTAATAAACAGAAGGTTCTGG CTATAGTGTCAGCCTAAAGGAGAGCAGAAGAAAAGATCCTAG | 1604 |
| | 3 | MSVSLKESREKDPRVLSQAR* | 1605 | ATGAGTGTCAGCCTAAAGGAGAGCAGAGAGAAAAGATCCTAGAGTTCTCAGCCAGGC AAGATGA | 1606 |
| | 4 | MIAYNTQLSYRE* | 1607 | ATGACTGCTTACAATACACAGTTTCATATAGGGAGTGA | 1608 |
| hsa-mir-596 | 1 | MAAAALRRPTRPIPGCCLGHCPCVFLFYFRTLIKTQTDE* | 1609 | ATGGCAGCTGCTGTTGTTCCGCCTCGAGGCTGCCTGGGCCATCCTGGGTGTCTAGGT CACTGTCCTTGTGTTTTACTTTAGAACTCTTATAAAGACACAAAACGGATG AGTAG | 1610 |
| | 2 | MSRDKLTLGNGLGVVCKAGSAVCVRNPLSSGSVLGCFL GQRPQPSYLQSILLSWRASAMAPRLYCSL* | 1611 | ATGAGTAGAGACAAACTCACACTAGGAAATGGACTGGGTGTGGTTTGCAAAGCGGG GAGCGCGGTCTGTGTCCGGAACCCTCTGTCTAGCGGCAGCGTCCTGGGCTGTTTCCT GGGGCAGCGGCCGCCACAGCCGTCTACTCTGCAGAGCATCGTCTGTTTCTCAGCCAG GCTGCGATGGCCCCAGGCTGTACTGTTCCCTAA | 1612 |
| | 3 | MDWVWFAKRGARSVSGTL* | 1613 | ATGGACTGGGTGTGGTTTGCAAAGCGGGGAGCCGGGTCTGTGTCCGGAACCCTCTGA | 1614 |
| | 4 | MCCPREPGRVMPRGDWGRQEGGEGRARSSEVGSFFPA LVDTPASSATSGVA* | 1615 | ATGTGTTGCCCAGGAGCCCGGCCGGGTGATGCCTCCGGGTGACTGGGGACGGCA GGAGGGAGGGGAAGGGGAAGGCAGGGCGCGGAGCCAGTGAGGTCGGCAGCCTTCCCAGCG CTCGTCGACACTCCAGCCTCTTCAGCCGCCACGTCTGGGGTTCGTGA | 1616 |

Figure 1 (Continued)

| | | Protein Sequence | SEQ ID | Nucleotide Sequence | SEQ ID |
|---|---|---|---|---|---|
| hsa-mir-607 | 1 | MSLWRHESSSCRKPRLSTEHCCRLHTLAIFCRPPGPASA AAPRTPSRVARGRARTRGPGVAPPAGGGAGPASPHR GPGVARGRPGPAHPPRAPPAGLRSRRPSTRLJPPPLAARD GAFPQPEVSPAGPAPPSHCPPRPRLPPPSPGLFVFYASPIY HFQPAYRPAPTVASSVJTAAMNFSVETAPPQSLFKKQK* | 1 | ATGAGCTTGTGGCGCCACGAATCCAGTTCTTGCCGAAAGCCGCGTCTCTCAACGGAG CATTGCTGCCGCCTACACAACCCTCGCCATTCTGCCGCCTACACAACCTCGCGCCAGCTCC CCCGGGCGTCGCCCCCGCACGCCAGCCCTGCAGCCTTGGCGTGCGGGGCGGCCGGCACCGCGG ACCGTGGCCCGGCTGGCGGTGCGCTCTGGACGCGCTGGCCGGCCGGCTCGTCACCGGCG CGCCCCGTCCGGCTGGTGCGATCGCGCTCCTTCTACGGGGCCTCTGGCC GCCGGACGGCGCCTCCCACAGCCGGAAGTCAGTCGCGCCCTCCGGAGTCAGAGGCCGCT TGCACTGTCCCCAAGGCACGGCTGCCCCCGCACCTGCCCCCGGGCTTTTTGTTTTT ACGCCAGCCCATTTATCACTTCCAACCTGCTATGCGGCCTATGCGGCCACCAACTGTTGCAA GTTCCGTAATAACTGCTGTAACTTCTCCGTTGAAAACTGCTCTCCCCAGAGCC TGTTTAAGAAGCAGAAATAA | 1617 1618 |
| | 2 | MPVDALTSKIFKGEVDTRY* | 1619 | ATGCCGGTTGGATGCACTGACCTCTAAGGATTTTCAAAGGTGAAGTGGATACACGTTAT TAA | 1620 |
| | 3 | MSKPLGHESP* | 1621 | ATGAGCAAGCCTCTTGAATAATTGAATCACCTTAA | 1622 |
| | 4 | MGNERRKGKEMGWKEKSRDRPIPVGLVP* | 1623 | ATGGGAAACGCAAGAGGAGAAAGGGAAAGAAATGGGTGAAAGAAAAAGCAGAA GAGATCGCCCTATACCAGTAGGCCTAGTACCCTAG | 1624 |
| hsa-mir-610 | 1 | MSKGPKKNVPMVVFCMTHPEYAL* | 1625 | ATGTCGAAGGGACCAAAAAAAAAATGTGTTATGGTGGTTTCTGTATGACACATCCT GAATATGCTCTATAA | 1626 |
| | 2 | MCLWWFSV* | 1627 | ATGTGTTTATGGTGGTTTTCTGTATGA | 1628 |
| | 3 | MLYKYGHTSVRAERDLKDYSHTLPARF* | 1629 | ATGCTCTATAAATATGGAATCACCAGTGTCAGAGCTGAAAGGGACCTGAAAGATTAT TCTCACACTCTCCAGCCAGATTTAA | 1630 |
| | 4 | MESPVSELKGTSKIHLTLSQPDFKWINLIS* | 1631 | ATGGAATCACCAGTGTCAGAGCTGAAAGGGACCTCAAAGATTCATTCTCACACTCTCC CAGCCAGATTTAAGTGGATAAACTGATAACTGATTAGCTGA | 1632 |
| hsa-mir-612 | 1 | MAVPAHANPFASLCIDLNSDFVNFQRCG* | 1633 | ATGGCAGTGCCAGCAATTATTGCTAATCCGTTTGCATCCTATGCATAGATCGAAT TCAGACTTTGTGAATTTCCAGAGGTGTGGGTAA | 1634 |
| | 2 | MHRSEJFRLCEFPEVWVJ* | 1635 | ATGCATAGATCTGAATTTGAATTCAGACTTTGTGAATTCCAGAGTGTGGGTAATATAA | 1636 |
| | 3 | MADLVQIKSYGA* | 1637 | ATGGCTGATCTTGTGCAAATTAAAAGTTATGGGGCATAA | 1638 |
| | 4 | MGHKNSKS* | 1639 | ATGGGGCATAAGAATAGCAAAAGTTGA | 1640 |
| hsa-mir-614 | 1 | MPAIADNRRAPGIAAREMEQGEPFSLKEFFPALPVYVYR VTPYLLITASFVLLWVRLKVFVCFFWFYWHRKL* | 1641 | ATGCCTGCAATTGCTGATAATAGACGTGCCCAGGAATCGCTGCAAGGAAATGGA GCAAGGTGAGCCATTCTTCTTTGAAGGAGTTTTTCCAGCTCCACCGGTTATGTGTAT AGGGTCACACCTCACCTCTTCTATAACTGCCATTATTTGTTCTCTTTGGGTCAGGCTGA AAGTGTTGTTGTCGTTTTTCGGTTTATTGGCATAGAAAACTCTAG | 1642 |
| | 2 | MCIGSHPTFL* | 1643 | ATGTGTATAGGTCACACCTCACCTCTATAA | 1644 |
| | 3 | MASAFLEGAG* | 1645 | ATGGCATCTGCATTCCTGGAAGGTGCAGGCTGA | 1646 |
| | 4 | MGGAEEF* | 1647 | ATGGGTGGAGCGGAGGAGTTTTGA | 1648 |
| | 1 | MAAAPALKHWRTTLERVEKFVSPLYFTDCNLRGRCCGP WSPAAGRPQPCASSFPSGEKPKLQPPGPRDKVPAAGRA GAGEEGVGNGLCRGAARQPSWRRIOQGHKCGPTGQLAPR RKRGGLQHVPTGPSHAGFLGPAALWLCSPAS* | 1649 | ATGGCGGCTGCGCCGCCGCCCTTGAAGCACTGGCGCACCACGCTGGAGCGGGTGGAGAA GTTCGTGTCGCCGCTGTACTTTACCGACTGTAACCTCCGCGCAGGTGTGGGCCCTG GTCCCCGAGCCGGCGCTGGCGACCGCCAACCGTGCGCCTCAAGTGCCGCCGCAGCCAG ACCTAAGCTGCAGCCACCGGCGCCGGGACAAAGTCCGGGGGCCGCCAGCAGCAG GGGCCGGGGAGGGAATGGACTGTGCCGCGGAAGCGCCACCGGCCAGCTGGCCCAGCC CTCTTGCGGAGGAATCCAGCATGTCGGCCGCCACCGGCCGGCCGCTGGCCCCAGGC GGAAACGGGCGGCGCGGCTCCAGCATGCCGCCGCCGCGTGCCGCCGTCCAGCTTCCGGCC GGGCCAGCTGCCCGTGCGTGCTCTCCAGCTTCCTGA | 1650 |

Figure 1 (Continued)

| | | | | |
|---|---|---|---|---|
| hsa-mir-631 | 2 | MDCAAERPGSPLGGSRESAAPPASWPPGGNGAASSM CPPARPTQAFWGQLPCGCALQLPDAGETSLPGGSPAGL PPRAGRRQLRTHVGNAQRVGGATGLGEVPTQLPATPSL SALCRRQLRGHEQHPLLGAAPSAGNSSLVPGSSGDGFHS HVAASGHPLGRAP* | 1651 | ATGGACTGTGCCGCGGAGCGGCCAGGAGGTGGTCCAGGAGGATCCAGGGAAAG TGCGGGCCCAGCCAGTGGCCCAGGTGGCCAAACGGCGCGCTCCAGCATGT GCCCACCGGCCCGTCCACCGAGGTCTTTGGGGCCAGCTGCCCTGTCTGCTC TCCAATGCCTTCCTGACGCCGGAGAGACTTCCTACCAGGAGACTTCAGCGGACTTC CGCCCCGCGCAGGTCGCGCGACAGCTTCGGACCGCACGTAGGCCCAGGGGTG GGCGGGGCACAGGCTAGGGGAAGTCCAACCAGCTCCAGCCACACCTTCGTT AGCACCTCTGCCTGCTGGAACAGCTCTGGGATCGGAGCAGCACCCCTGCTGGAGC TTCCCACGTGGCGCGCTCCTTAGGAAGGGCACCCTAG | 1652 |
| | 3 | MVFIPTWPPLDIP* | 1653 | ATGGTTTCATTCCACGTGGCCGCCTCTGGACATCCCTTAG | 1654 |
| | 4 | MLGFFQAPADTLSKEGYQDRTSTSRPITTALLQMVDLL VPGGADHPRGMGGPGSSPLLGK* | 1655 | ATGCTTGGAGAGTTTCAAGCCTGCGACACTTTATCCAAGGAAGGATATCAGGAT AGGACTTCTACCTCTAGGCCTATCACAACAGCTCTCTTGCAGATGGTGGACCTGCTG GTTCCGGGTGAGCTGACCATCCCAGAGGCATGGGTGGCCCAGGAAGTTCACCTTT GCTGGGAAAGTGA | 1656 |
| hsa-mir-633 | 1 | MLSSLJSHQ* | 1657 | ATGCTCTCGAGTCTCATTCCACCAGTGA | 1658 |
| | 2 | MCQKIKSGNLALWSLCSLQKFSEY* | 1659 | ATGTGCCAGAAGAAATAAAAGTGGAAATCTTGCTTTGTGGTCTCTTTGCTCGCTGCAA AAATTTTCTGAGTACTAA | 1660 |
| | 3 | MNRVNQILIEF* | 1661 | ATGAATCGTGTAAATCAAATCTTATTAATTGAATCTAA | 1662 |
| | 4 | MEENASSV* | 1663 | ATGGAGAAAATGCTTCATCAGTGTGA | 1664 |
| hsa-mir-645 | 1 | MSFWGTVEGVRGSTWGHQ* | 1665 | ATGTCATTCTGGGAACAGTGGAGGAGTGCGGCAGCACCTGGGGGCACCAGTGA | 1666 |
| | 2 | MWSGAPGLCGWGGICFWVTPCLPFSSTTF* | 1667 | ATGTGGAGTGGGAGGCTCCAGGCTGTGTGGCTGGGATCTGCTTCTGGGTTAC CCCATGCTCCCCTTCCAAGTACTACTTTTAA | 1668 |
| | 3 | MPPLLKYYFLHMAPAIHFIVDVSQYRWLTSLIPALGEAE ARRITRGQEFKTSLGNIYRPPSLQKNKNS* | 1669 | ATGCCTCCCCTTCTCAAGTACTACTTTTTAATCATCATGGCTCCTGCCATTCATTCA HAGTTGATGTAAGCCAGTGCCAGTGCGTGGCTCACGTCTTAATCCAGCACTTGGGAGG CTGAGGCCAGGAGGATCACTTGAGGCCAGGAGTTCAAGACCAGCTGGGCAACATA GTGAGACCCCGTCTCTACAAAAAACAAAAACAGTTAG | 1670 |
| | 4 | MLAPLHSSLGBDRARPCLKNK* | 1671 | ATGCTTGCACCACTGCACCTCTAGCCTGGGTGACAGAGCAAGACCCTGTCTCAAAAT AAATAA | 1672 |
| hsa-mir-654 | 1 | MPNPGSMMTTGGV* | 1673 | ATGCCCAATCCTGGATCGATGATGACCACTGGTGGCGTATGA | 1674 |
| | 2 | MSHT* | 1675 | ATGAGTCATACATGA | 1676 |
| | 3 | MMNMCLEL* | 1677 | ATGATGAATATGTGTCTGGAACTCTGA | 1678 |
| | 4 | MHSYVHMIGSMKE* | 1679 | ATGCATTCTTATGTTATTATGATTGGTCAATGAAAGAATGA | 1680 |
| hsa-mir-655 | 1 | MPNPGSMMTTGGV* | 1681 | ATGCCCAATCCTGGATCGATGATGACCACTGGTGGCGTATGA | 1682 |
| | 2 | MSHT* | 1683 | ATGAGTCATACATGA | 1684 |
| | 3 | MMNMCLEL* | 1685 | ATGATGAATATGTGTCTGGAACTCTGA | 1686 |
| | 4 | MHSYVHMIGSMKE* | 1687 | ATGCATTCTTATGTTATTATGATTGGTCAATGAAAGAATGA | 1688 |
| hsa-mir-656 | 1 | MPNPGSMMTTGGV* | 1689 | ATGCCCAATCCTGGATCGATGATGACCACTGGTGGCGTATGA | 1690 |
| | 2 | MSHT* | 1691 | ATGAGTCATACATGA | 1692 |
| | 3 | MMNMCLEL* | 1693 | ATGATGAATATGTGTCTGGAACTCTGA | 1694 |
| | 4 | MHSYVHMIGSMKE* | 1695 | ATGCATTCTTATGTTATTATGATTGGTCAATGAAAGAATGA | 1696 |
| hsa-mir-668 | 1 | MPNPGSMMTTGGV* | 1697 | ATGCCCAATCCTGGATCGATGATGACCACTGGTGGCGTATGA | 1698 |
| | 2 | MSHT* | 1699 | ATGAGTCATACATGA | 1700 |
| | 3 | MMNMCLEL* | 1701 | ATGATGAATATGTGTCTGGAACTCTGA | 1702 |

Figure 1 (Continued)

| | | | | | |
|---|---|---|---|---|---|
| | 4 | MHSYVIMGSMKE* | 1703 | ATGCATTCTTATGTTATTATGATTGGGTCAATGAAAGAATGA | 1704 |
| hsa-mir-659 | 1 | MLSSIRMGYIVRAMSSACICSPCLLIWGWGGEWYWVK* | 1705 | ATGCTCTCATCCATTCCATTCTGCTTGTTACATCGTGAGGCAATGGCCAGCGCATGCATCTGCTCATTCTGCTTGTAATCTGGGATGGGGTGGAGAGTGGTACTGGGTCAAATGA | 1706 |
| | 2 | MBLLLLVNLGMGWRVVLGQMRRTS* | 1707 | ATGCATCTGCTCATTCTGCTTGTTAATCTGGGATGGGGTGGAGAGTGGTACTGGGH CAAATGAGACGGACTTCCTGA | 1708 |
| | 3 | MTTEI* | 1709 | ATGACGACAGAAATATAG | 1710 |
| | 4 | MCRATAFQSTTGHGPHRGW* | 1711 | ATGTGCCGTGCAACAGCGTTTCAGTGACAACAGGCCATGGCCACATATAGGAATGGTGA | 1712 |
| | 1 | MGAASATHSSPCLAGHSRLL* | 1713 | ATGGGGCGTGCCAGCGCACGCACGCACTCCTTTCTGCCTGGCCGGCCACTCCCGTCTGCTGTGA | 1714 |
| | 2 | MESAPSIWRTGAAPGRASSTRAMVRLQLDADFTPQGTRRPICLEAAVLRQCRCLHGPSPALLQV* | 1715 | ATGGAATCTGCACCTTCCATCTGAGAACTGGGCGCCGCCCCAGGCGGGCGGGCTTCCAGCACCAGAGCGATGGTCAGCTTCAGCTGGACGCAGATTCACCCGCAGGGCACACGCAGACCCCATTTGTTTGGAAGCGGCAGTCTAAGGCAGTGCAGGTGCCTCACGCGCCCAGCCCAGCTCCTGCAGGTGTAA | 1716 |
| hsa-mir-662 | 3 | MQIPGHPMACRGPSEGCGPGSRGAPHGAEVLGSHGAGVGSAQVPCDPMATFFSWLHAPQGLGVPLTARFLAVGGVCFLPPSGGVQSLRGLPTSSGAWGSRVGHPEAVCLPATFPSGRADQAGSACGWGC* | 1717 | ATGCAGATTCCAGGGCGCCCCATGGCCTGCAGAGGGCCCTCAGAGCAAGGAAGGGCCGGGCTCTGGGGAGCCCTCAGCATCCCAGGTGCTGAGGTCCTTGGGTCACATGGAGCTGGGGTGGGGAGTGCGCCAGGTCCCCATTTCTGGGAGCTGTCTCCTGGCTTCGCCACCCCAAGGGCTGGGGTCCGGGGTCTCAGAGCCTCACTGCCCATTTCTGGCTGTGGGGAGGGGTGTGTTTTCTTGCACCCTAACCTCTAGAGTCTGTTCACCCGGAGGCTGTTGCCTGCCCCGGACAATTCCCCAGTGCCTGTGGGGAGTAGAGTTCGTCAGCAGGCAGGCTCTGCCTGTGGGATGGGGTGTAA | 1718 |
| | 4 | MELGWGVPRSPVIRWPRFPPGFTHPKGWGSHSLPIFWLWGGSVFFHLLKVFRASGASPLPLGPGGVESVTRRLCASPRHSPVAGPTRQALPVDGAAEHERYTPISELWVDPPGLGQGHQEAALPYSAMYASLKGVSVEASSLFCEPHPYPRRTILYQGGSSPHPLPHPTYAHRPHPREYKGLPRLLTGPAPPHLDCT* | 1719 | ATGGAGCTGGGTTGGGGTGCCCGAGCTCCCGTGATCCGATGGCCACGTTTCCCTCCTGGGCTTCACGCACCCCAAGGGCTGGGGGTCCCAACTCCCTGCCCATTTTCTGGCTGGGGAGTGGCGAGCTCAGCCTCAGGGGCTCTCCACTTCTCTGGGGCTGGGGGGAGTAGAGCTGCGCGAGCTCAGCTGGTCGTGGCCTCCCGACATTCCCCAAGTGCCCACGTGCCGGGCAACCCTGGGAGTCGTCCAGTGCAGGCTCTGCCTGTGATGGGCTGCTGAGCATGATAGCCTGTGATCGCCGTCTTGAGCGGTCAGGACCGGGGCTCCAAGGTTTCAGGAGGCAGCTCTATTCTACTCGCATGATGGCCCTGCTGAAAGGGTGAGTGTAGAAGCCAGTCCCTCTTCTGGAGCCGCATTGCATGGGGCGGCCATCTACCCCAGGAGGACAATTCTGTTCAGGGAGGAGGTACCAAGGGGCTCCCCAGCCGAGTCTCCGACCACCACTGGCCCGGGCCACGCGCCCCACCTGACTGCACCTGA | 1720 |
| | 1 | MRRAL* | 1721 | ATGAGGAGGGCATTGTAG | 1722 |
| | 2 | MRVIDPICRSPLE* | 1723 | ATGAGGGTCATTGATCCTCGGTGCAGATCTCAAAGAATGA | 1724 |
| hsa-mir-665 | 3 | MTERKREWWKETGWEKMKIERRK* | 1725 | ATGACAGAAGAAAGAGAAGGAGTGGTTGGAAAGAACAATAGGATTGGAAAATGA | 1726 |
| | 4 | MGKNENRKKEVKHPN* | 1727 | ATGGGAAAAAATGAAAATAGAAAAAAGAAGTGAAAGATAATAAATAG | 1728 |
| hsa-mir-758 | 1 | MPNPGSMMTTGGV* | 1729 | ATGCCCAATCTGGATCGATGATGACCACTGGTGGTGTATGA | 1730 |
| | 2 | MSHT* | 1731 | ATGAGTCATACATGA | 1732 |
| | 3 | MMNMCLEL* | 1733 | ATGATGAATATGTGTCTGGAACTCTGA | 1734 |
| | 4 | MHSYVIMGSMKE* | 1735 | ATGCATTCTTATGTTATTATGGGTCAATGAAAGAATGA | 1736 |
| hsa-mir-759 | 1 | MVKPRLY* | 1737 | ATGGTGAAACCCGTCTACTAA | 1738 |
| | 2 | MVACACSPSYLGG* | 1739 | ATGGTGGCGTGTGCGTGTAGTCCCAGCTATTTGGGAGGCTGA | 1740 |
| | 3 | MFFLHSV* | 1741 | ATGATCACCACCTGCACTCTGCTCTAG | 1742 |

Figure 1 (Continued)

| | | | | | |
|---|---|---|---|---|---|
| | 4 | MVKPGLY* | 1743 | ATGGTGAAACCTGGTCTCTACTAA | 1744 |
| hsa-mir-760 | 1 | MCAGKCCKIYFLYVGIKISLKVINLINVCKEERKVKNRVLGFLNI* | 1745 | ATGTGTGCTGGGAAATGCTGCAAATATATTTTATAGTGGGATCAAATAAGTTTGAAAGTTCATAAACCTAATAAATGTAGCAAAGAAGAGGAAGGTCAAGAACAGAGTGCTAGGGTTTCTAAATATTGA | 1746 |
| | 2 | MLQNIFFICRJDQNKFESHKPNKCMQRREEGQEQSARVSKYLSLGS* | 1747 | ATGCTGCAAATAATATTTTTATGTATGCAAAGAAGAGGAAAGGTCAAGAACAGAGTGCTAGGGTTTCCTAATAAATGTATGCAAAGAAGAGGAAAGGTCAAGAACAGAGTGCTAGGGTTGA | 1748 |
| | 3 | MYAKKRGRSRTEC* | 1749 | ATGTATGCAAAGAAGAGGAAGTCAAGAACAGAGTGCTAG | 1750 |
| | 4 | MAKKNQPRGRKRTKKPSPGNQVKKCSMKESMVRRVNCVSNYYCI* | 1751 | ATGGCAAAGAAGAATCAGCCCAGAGGTAGGAAGGAGAAGACCAAGAAACCAAGCCCTGGCAACCAGGTTAAAAAGTGTTCTATGAAGGAAAAGCAATGTCCGTAGGGTCAACTGTGTGTCCAATTACTACTGTATTTAG | 1752 |
| hsa-mir-802 | 1 | MSYFFLJSFPLJGSLCYAQVGVHNHSSLQSQTCGLK* | 1753 | ATGTCCTATTTCTTCCTTTTCTTTTTCTTATAGGTTCTCTGTGTTGCACAGGTTGGAGTGCACAATCATAGCTCATTGCAGTCTCAGACTTGTGGCTCAAGTGA | 1754 |
| | 2 | MPPCQAEF* | 1755 | ATGCCACCATGCCAGGCTGAATTTTAA | 1756 |
| | 3 | MLSSRPPKLLGL* | 1757 | ATGCTCTCATCTGGCCTCCAAATTGCTGGGTTATAG | 1758 |
| | 4 | MKCCVNTRRKVSPQRCLSLSRMSNIWADNKTLNSHEVWQYHLMNWQYYKCLRHKMLRFHLFSRTLRSCVGF* | 1759 | ATGAAATGTGTTGTGAACACAAGAAGAAGGTTAGCCCACAGAGATGTCTCTCACTTTCCAAGAATGTCAAATATTTGGGCTGAACAAAACTTTGAACAGTCATGAAGTATGGCAATATCATCATCTAATGAACTCTAATATATAAATGTCTAAGAATCATAAAATGTTAAGCTCAGAAGCTGTGTTGAATTCTAA | 1760 |
| | 1 | MPNPGSMMTTGGV* | 1761 | ATGCCCAATCTGGATCGATGATGACCACTGGTGGCGTATGA | 1762 |
| | 2 | MSHT* | 1763 | ATGAGTCATACATGA | 1764 |
| | 3 | MMNMCLEL* | 1765 | ATGATGAATATGTGTCTGGAACTCTGA | 1766 |
| | 4 | MHSYVIEMGSMKE* | 1767 | ATGCATTCTTATGTTATTATGGTCAATGAAAGAATGA | 1768 |
| hsa-mir-889 | 1 | MLLGHHLPGPPSR* | 1769 | ATGCTTCTGGCCACCATTGCCAGGGCTCCGCTGAGGTAA | 1770 |
| | 2 | MGTLTWAIQMIKMERGWDAGEGVLQPEGRGPRG* | 1771 | ATGGGCACCCTTACCTGGGCTATTCAAATGATCAAAATGGAACGGGGATGGGATGGAGGTGAGGGAGTGCTCCAGCGGAGGCCCGGAGGGCCCAGAGGATGA | 1772 |
| | 3 | MGCG* | 1773 | ATGGGATGCGGTGA | 1774 |
| | 4 | MRVRECSSRRARGHEDDVRLEAWTPGSCPWAPCASSQGSERLRGAPAIRFPFLSRAFDSSLLYTPACK* | 1775 | ATGCGGGTGAGGGAGTGCTCCAGCCGGAGGGCCCGGGGCCACGTTGCCTCCAGCGAAGGCCTTCCGAGCGACTGCGTGCGGGCTCCAGCTATCCGATTCCCTTCCTAAGTCGCGCGTTCGACAGCTCCTCCTTTACACACCGCGTGCAAATGA | 1776 |
| hsa-mir-9-2 | 1 | MKKGRKPTCASDSRWRNDCCHFRCHR* | 1777 | ATGAAAAAGGGAGGAAGCCACTGTGCGAGGACTGCGTTGGAGAAATGATTGTGGTTTCGTTGCATCCACCGCTGA | 1778 |
| | 2 | MIVVFYASTADS* | 1779 | ATGATTGTGGTTTTCGTTTGCATCCACCGCTGA | 1780 |
| | 3 | MAPLSSSGLWAAITTLVTMVEREGSGFILRPFPPSLPPACLPGLSSSDPACSLVSDL* | 1781 | ATGGCGCCCTTCTCTTCGGGCTTCTGGGCTGCCAAATCACCCTGGTAACAATGGTGGAAAGGAAGGGGTCCGGCTTCATTTGCACCCCTTCCTCCTTGCCCCCGCTTGGCCTTCCAGGGCTTTCCTCCGACCCAGCGTGCCTCACTGGTCTCTGATTTGTAA | 1782 |
| | 4 | MLNSILIVRLKLRHHFILQSAVGLWP* | 1783 | ATGCTTAATTCGATTTGATTGTCGTCTTAAACTAAGACATCATTTATTCTACAGAGCGCTGTCGGGCTTGGCCTTGA | 1784 |
| hsa-mir-92b | 1 | MAMCCHLSWG* | 1785 | ATGGCAATGTGTGTCATCTTCCTGGGGTTAG | 1786 |
| | 2 | MDPKAKGSKILNSESGGLLLTPFPGAAASGMAQSPQALCLKKGK* | 1787 | ATGGACCCCAAGGCCAAAGGGTCAAAATTCTGAATTCTGAATTCTGAATCGTGTGGCCTCCTCCTCACACCCTTCCCCGAGCAGCTGCCCGGAATGCCTCAAAGTGCTCAAAGTCCTCAGGCACTGTGTCTGAAGAGGGAAATAA | 1788 |
| | 3 | MRWLSHKA* | 1789 | ATGTGGCTCTCCCACAAGGCATGA | 1790 |

Figure 1 (Continued)

| | | | | |
|---|---|---|---|---|
| hsa-mir-920 | 4 | MFSWEKQNTPRRPPRMDVSMITPESATSWGPS* | 1791 | ATGTTTTCTTGGGAGAAGCAGAATACACCAAGACGCCCCCTCGCATGGATGTGTCA ATGATCACCCCAGAATCCGCCACAAGCTGGGGTCCCTCATAG | 1792 |
| | 1 | MTGRVSQDNQKGEFNLIFKNK* | 1793 | ATGACTGGGAGAGTCAGTCAAGTAATCAGAAGGAGAATTAACCTTATCTTTAAG AATAAGTAG | 1794 |
| | 2 | MVKS* | 1795 | ATGGTTAAGTCATAA | 1796 |
| | 3 | MSKLEKNLHEC* | 1797 | ATGAGTAAAATTAGAGAAGAACCTACACGAATCTGA | 1798 |
| | 4 | MLRNCSEENGKSSKPLHKPQS* | 1799 | ATGCTGAGAAATTGTTCTGAAGAAATGGAAAGTCATCAAAGCCTTTACACAAGCCA CAATCTTAA | 1800 |
| hsa-mir-924 | 1 | MKLIRLG* | 1801 | ATGAAGCTGATTAGGTTGGGGTAG | 1802 |
| | 2 | MERARMQ* | 1803 | ATGGAGAGGGCAAGGATGCAGTAA | 1804 |
| | 3 | MFKFGVLKREKIRIYELKNHMI* | 1805 | ATGTTTAAATTTGTGTTCTGAAAAGAGAAAATTAGGATATATGAGTTGAAGAAT CACAATATATAG | 1806 |
| | 4 | MLFKAMGLDDVEGKGKSMLREEMGIYIHL* | 1807 | ATGCTCTTTTAAAGCAATGGACTAGATGATGTGGAGGGTAAGGGAAAGAGCATGTT GAGGGAAGAGATGGGAATCTACATTCATTTATAA | 1808 |
| hsa-mir-9-3 | 1 | MRSPGQGRPEGG* | 1809 | ATGCGCTCGCCCGGGCAGGGCAGGGCCTGGAGGGGCGGCTAG | 1810 |
| | 2 | MRGALPLRVGGRTQSSRAKGCGAVGSAQR* | 1811 | ATGAGAGGTGCGCTCCACTGCGGGTGGGAGGCAGGACTCAGTCATCCGGGCAAA GGGTTGTGGGCAGTGGGAAGCGCCAGAGTGA | 1812 |
| | 3 | MHHTAPALDKIYDVFPPLKWEVVGKSYSLCSPLRAPEQ ASLICLWASLQPPPA* | 1813 | TGCACCACACAGCACCGCTCTAGACAAGATTTATGCGTTTTCCCCTCTGAAA TGGAAAGTTGTTGGAAATCCTATTCACCTCCGTGCCCAGAACAG GCCTCTTGATCTGTCTGTGGCGTCTTGCAGCTCCTCCAGCCTAG | 1814 |
| | 4 | MTPFPL* | 1815 | ATGACGTTTTCCCCTCTGA | 1816 |
| | 1 | MRLFPNRGRFCLASLVWTPRGAERRLCAQPGAGAGECL GPGAGGRAGRSQSGAQ* | 1817 | ATGCGGCTCTTTCCAAACCGGGGCCGTTTTGCCTGGCTTCTCGTGTGGACTCCG CGCGGGAGCTGAGAGCGCGCTGTGCGCCAGCCTGGAGCCGCGCAGTGAGTGTCT GGGCGGGAGCGGGGGGCGGCCGGAGCGAGGCCAGAGGGGTCAGTAG | 1818 |
| hsa-mir-96 | 2 | MTRQCLLALPRLQAEAPTGRLGPGSASGVCPAPSAVPG RGRGREKLRSECGRCLRGAYPRGVWLGSGCVSPPWWA QAEAPGWEGAAAESAGAPELAPPASCQGCAAGSRLLFWP GAAPPSLWGKAALRPPVCLHFAATHPGNPGARE* | 1819 | ATGACGCGGCAGTGCCTACTGCGCCTTCCGCGCCTTGCCCAGGCGGAGGCGCCCACGGG GCCCTGGGTCCCGGGTCCGCGAGCGGGCCCAGCCTGCCCAGGCCCAGCCCGTGTCCGG GCGGGGGCGCGGGGCGGAGGAGTTTGGCTGCGGTCCAGTGCGGCCTGCGCCTTGCGAGTT GCCTACCCGGAAGCGCCAGCTCGGAGGCCTGCGAGGGCTGCGGCCTGGTCGAGAGCGCCGAGC CAGGGGGCCCTGCAGCGTCTGTCAGGGCTGCGCCAGGGCTGGTTCGAGGCTGCTTCCGTGGC TGGCCCCGCGCCCCAGTCTCTGGCGAACCCCGGCGCACGGAATGA TCCACTTCGCGGCCACTCATCCGGGAACCCCGGCGCACGGAATGA | 1820 |
| | 3 | MRHRSPPSTAPFLLIALVAPRFPALPQDRRLDGLPLAPH RSAHPRTMGSEGVTRGQGSPDSTVSSRLSHSFALPTRAP GHRVQ* | 1821 | ATGAGACACCGTTCCCCGCTCAACTGCCCTCAATGCCCCATTCCTGTTAATAGCGCTAGTGGCA CCCAGGTTCCCAGCCGCATCCCAGGACTATGGCAGTGAGGGTGTCACCCGGGGTCAGGG CACCGGTCAGCGCATCCAGGACTATGGCAGTGAGGGTGTCACCCGGGGTCAGGG GTCGCCCGATTCCTCCAGGCTGAGCCATTCGTTTGCTCTTCCAACCCG GGCTCCCGGACACCGTGTACAGTAA | 1822 |
| | 4 | MGTESADL* | 1823 | ATGGGCACCGAGTCGGCGGATCTCTGA | 1824 |

Figure 1 (Continued)

| | | | | |
|---|---|---|---|---|
| hsa-mir-99b | 1 | MGIDTDNAPQAEKEDGDRERAKGRTDVQRQKGGQTER DTERQQKQPRMTGAERRRERGRERERERERGGREG ERERESTHRARRRRREEGGRPARDRTGRRGGGELGKA GEERDWFPRRRAGHERERPRRLPASFVPSLLCVRLLWPG LPLPLPPPPRGWMEFFPLDLGQLRGRGEARPDWAGRW GGAGAGGPLLGRGLVRRPRSRRGPGRGSPGPQSRGGGD GRRESGRREGGWRGRREEGERPPCGEGGERMESARRR WGPACGPGAAEKTPSLRRGSRGSRESAEREGGGLGPAL LGP* | 1825 | ATGGGAGACACAGATAATGCCCACAGGCAGAGAAAGAGGATGGAGATAGGGAGA GGGCGAAAGGAAGGCAGACAGATGTGCAGAGACAGAAGGGAGGACAGAGAGGAAAAGAGA CACAGAGAGAGGCAGCAAAAGCAACCAAGAATGACAGGAGCAGGAGACGAGAGGGAA AGAGGGAGAGAGCGAGAGAGCACGCACGAGAGAGGAGAGGAGAGGAGAGAGAGAG GGAGAGGAGGCCAGCGAGGCCAGGGCCAGGGCGGAGGAGGAGGCGCAGGAGAAGAGAG AAAGCCGGGAGGAGAGCGAAGACGGGGAGCGGCCGAGGGGAGGGAGGGGAGCTAGGG GCCCCGCGGCCTCCCCCTCCGGCTCCTTTGTCCCTCCTCCCCGGGCTGATGGAATTTTTCCC CTGGACCTGGGCAGCTCCGGGCAGTCCGGGCAGGGGGGAAGCCAGGCCGGACTGGCCTGGCC GCGCCAGCCGGCGGGTCAGHAGGGGGTCAAGHAGGGGGAAGGGGAAGGGGAAGGGGAAGGAGGATCGGCGCGAGGACGGCGGG GGTGACGGGCCGGAGGGAGAGGCCGGTGCGGGCAGAAGGGAGAAGGGGAAGGATGCGGGGACGGCGCTCG GCGCGGTGGGCCCGGCTGCGGGCCCGGGCCCGGCGGAGAAGGACCCCTTCCCCTGC GCGCGGAGGCCGCGAGGCCGTGAGTCGGGAGCCGGGAAAGGAGGGTGGGGGCTGGG GCCCGCACTCCTGGGTCCCTGA | 1826 |
| | 2 | MPHRQRKRMEIGRGRKEGQMCRDRREDRRKFTQRGSK SNQE* | 1827 | ATGCCCCACAGGCAGAGAAGAGGATGGAGATAGGGAGAAAGAGGAAAGGAAGGAC AGATGTGCAGAGACAGAAGGGAGGACAGAGACGAAAGAGAACACAGAGAGGCAGCAA AAGCAACCAAGAATGA | 1828 |
| | 3 | MAGTAGGRGEAAVRRRGHEDGERSAAVGPGLRARGG GEDFPATREPREP* | 1829 | ATGGCGGGGACGGCGGGAGAAGGGGAGAAGGGGAGAAGGGGCGCCGTGCGGCGGAGGGGAGAG AGGATGGAGAGCGCTCCGGCTGCGACGGAGGCCCCGCGGCCCGGGAGCCGTGA AGAAGACCCCTTCCCTGCGACGGAGAGCCCGCGGGAGCCGTGA | 1830 |
| | 4 | MGAGAGRIVAGRD* | 1831 | ATGGGGCTGGAGCTGGTAGGATCGGCTGAAGAGACTAG | 1832 |
| hsa-mir-940 | 1 | MGCNGGPLRGGDTFAAEFTRMEGRARRGNSRRRGSLEAAG KGGPGTGSQARASFAAAARSY* | 1833 | ATGGGGTGCAACGGCGGCCTCTCCGGGAGGTGACACTGCCGCTGAGACCGGAAT GGAAGGCGCGCCCGGGGGAACAGCAGGCGGCGAGGTTCGTGGAAGCAGGG AAGGGAGGCCCGGTACCGGCTCGCAGCGCCGCGAGCTTCGCGCAGCGGCACG GAGCGTGTGA | 1834 |
| | 2 | MLARLVEMS* | 1835 | ATGTTGGCCAGATGGTCGAGAACTCCTGA | 1836 |
| | 3 | MTWRL* | 1837 | ATGACTTGGAGACTTTAG | 1838 |
| | 4 | MSEQRTGCSLVTRSGWVGEWMDR* | 1839 | ATGTCAAGAGCAAAGGACAGGGTGCAGCTTGGTGACCGGAGTGGGTGGGGTGA ATGGATGGATAGATAG | 1840 |
| hsa-mir-1184-3 | 1 | MVSCRTR* | 1841 | ATGGTTTCTTGCAGAAACGAGGTGA | 1842 |
| | 2 | MASVSFSWVAMTKDWSSRKSSSGSWPLLSCPWLSKAS QEYSRVWACSGSSLAGGGCRRSSSSTRIDTSQRTSTSEK APRAAGHGAAEPEFGGSSAAGRAGVAPGPGWGAGGGG GGSDCTGWLPCSRARRCMRVKTARAPV* | 1843 | ATGGCTTCCGGTCCTGTCCTTTCGTGGGTAGCCATGACCAAAGACTGGAGCAGCAGAAAG AGCTCCTCGGGAAGCTGGCCCTGCCTCTCGGCCCGTGCCTGCAGCAGCTTGGCGCGGTTGTG GAGTACTTCTCCAGGGTCTGGGCGTGCAGCGGCAGCACTTCGCAGCCAGCACGTCCGAGA CAGGAGGAGCAGCAGCAGCACGGGAGAAGTGCGCCCAGGTTCGAGGAAGCAG AGGCGGCCAGGTGCGGGAGCAGTCGCCCGGTCGCCCCGGGTGGGGTGCCGGCGGGG GCGGCGGCAGTGACTGCACCGGGTGCTGCACGGGGCCTGCTCCTCCGCCAGCGCTGCAT CGCGCGTGAAGACGGCCAGGGGCCGGTGTAG | 1844 |
| | 3 | MLAAPSTSRRAAAAGRAGAGRRALRPPRRAAVPAP APQPEPAPCPGEVQRAGSEAGPGRAVSGVCKSRVSGMR HQDPGKVRGAWRGTSCC* | 1845 | ATGCTCGCCGCCCCAAGCACTTCCGACGCGCCGCCGCCGGCTGGCGGCGGGGGCCGT GCGGGGCGACGTGCCCTGCCCCTGCCCCTGCCCTGCCCTGTCGCGCCGCTGCCGCCGCCGCCGCCG CTCCCCAGCCGCCCAACCCTGCCCTTGCCCCTGTGAGCGCGGATGCAAGAGCGGGATCGGAG GATCCAAGACCCTGCGAAGGTACGCGGGCTGGCGGGCGGGGCCGGGCACCAGCTGCTGTAG | 1846 |

Figure 1 (Continued)

| | | | | |
|---|---|---|---|---|
| | 4 | MQIEGLGIDADPRPWEGTRGLAGHQLLLARLQCKWSRL LKASHSLSI* | 1847 | ATGCAAATCGAGGGTCTCGGGATCGGAATCCAAGACCCTGGGAAGGTACGCGGGG CCTGGCGGGCACCAGCTGCTGCTAGCTCGGCTGCAATGCAAGTGGTCTAGGTTGCT AAAGGCATCCCACAGCCTCTCCATCTGA | 1848 |
| hsa-mir-1302-8 | 1 | MGLTLLPNSSTPAHYFLQHLEQLLFLALDTHSVRPYPSG LSQALPQ* | 1849 | ATGGGGCTCACCCTGCTCCTCCAAACAGTTCAACTCCTGCACATTATTTCTTCAACATC TGGAGCAGTTACTTTTTTATTGCCCTAGACACACTCTGTCCGCCATATCCTTCAGG CCTTTCTCAAGCATTACCCTTTCAATGA | 1850 |
| | 2 | MTVDTYSNMSTSFLDFPYPHSQPYPSLAPI* | 1851 | ATGACAGTGGACACAGTCTCAACATGTCAACCTCCTTCCTTGACTTCCCTATCCCC ATTCTCAACCTTATTTCTTCCTTAGCACCTATCTAG | 1852 |
| | 3 | MYFTYAFIVCYPSKIKAL* | 1853 | ATGTATTTTTACTTATGCTTTTATTGTCTGTATCCTTCTAAAATTAAAGCTCTGTGA | 1854 |
| | 4 | MLLLSAILLKLKLCEHHKDFCLVP* | 1855 | ATGCTTTTATTGTCTGCTATCTTCTAAAATTAAAGCTCTGTGAGCACAAGGATTTTT GTTTGGTTCCTTAA | 1856 |
| | 1 | MQGCEGGGWEGWGEAGSAEMWGAQRWGGSAGPPGT AQPRALCPGPRGLTREGDARPCCSAAARAPPAAILIGPT EARPQKPLPQ* | 1857 | ATGCAAGGTTGTGAGGGTTGTGATGGAGGGCTGGGGCGAGGCGGGCGGTCCGCAG AGATGTGGGGGGCGCAGAGATGGGGGGAGCTGGGGCCCCCGGGGACGCGCA GCCTCCGGCTCGTGTCCCGGGCCGCGGGTTAACTAGAGAAGGTGACGCGCGCC CCTGTCCTGCTCAGCCGCGCGTGCCTCCGGCGCGGATCCTAATTGGCCGACAG AAGCCGCCCCAGAAGCCCTCCACAGTAG | 1858 |
| | 2 | MGGLGRGGVRRIDVGGAEMGGVRGPAGDRAASGSVPG AARYN* | 1859 | ATGGGAGGGCTGGGGCGAGGCGGGGTCCGCAGAGATGTGGGGGGCGCAGAGATGG GGGGGGTCCGCGCCGGGGACCGTGCGCGGAGCTCCGGCTCGTGTCCCGGGGCC GCGCGGGGTTAACTAG | 1860 |
| hsa-mir-3178 | 3 | MTVSRAHAPNAVSGLIDVLGAHEVQRLGRRKG#G* | 1861 | ATGACGGTCTCCGTGCCCAGCCCAAAGGCAGTTCTGCCTGGATGTGCTGGA GCCAGCGAGGTGCAGAGGCTCGAGAGACTCGGCGAAAGGACCTGGCTGA | 1862 |
| | 4 | MCSEPTRCRGSDGERDLAEIWVLNRGLGPASRQRAPTS DTRPGAVCGLAGAGSHLQFTHGTKRAJPTSSESMHLQL HPSPHARPPNP* | 1863 | ATGTGCTCTGGAGCCCACGAGGTGCAGAGGCTCGAGAGGGACCTGGCTGA GATCTGGGTTCTTAAACCGCGGACTGGGCCGCGGCCAGCGCCTCCCACA GTGACACCGCGGCCGGTCTGCGGGATCTCGCAGGCGCGGGTCTCATCTCCAG TTCAACACACGGACGAAAACGGGCACCTACCAGTCTGAGAGCATGCAACCTCCAA CTCCATCCCTCCCCACATGCCACCACCCCCCCAAACCGTAA | 1864 |
| | 1 | MVTHDKEGQSCHLSREDCASF* | 1865 | ATGGTGACCATGATAAGGAAGGACAGTCATGTCATTCCGGGAAGACTGTGCC AGTTTTTAA | 1866 |
| | 2 | MIRKDSHVIFPGKTVFVFNFAT* | 1867 | ATGATAAGGAAGGACAGTCATGTCATTCCGGGAAGACTGTGCCAGTTTTTAAC TTTGCAACTTGA | 1868 |
| hsa-mir-3179-2 | 3 | MSSFPGRLCQFLTLQLECQDFCSFYLY* | 1869 | ATGTCATCTTTCCCGGGAAGACTGTGCCAGTTTTTAACTTTGCAACTTGAATGTCAA GATTTTTGTTCCTTTATCTGTATTAA | 1870 |
| | 4 | MSRFLFLSVLMFLRFQKYY* | 1871 | ATGTCAAGATTTTTGTTCCTTTATCGTATTAATGTTTCTAGAATTCAGAAATACA TATATTGA | 1872 |
| | 1 | MVTHDKEGQSCHLSREDCASF* | 1873 | ATGGTGACCATGATAAGGAAGGACAGTCATGTCATTCCGGGAAGACTGTGCC AGTTTTTAA | 1874 |
| | 2 | MIRKDSHVIFPGKTVFVFNFAT* | 1875 | ATGATAAGGAAGGACAGTCATGTCATTCCGGGAAGACTGTGCCAGTTTTTAAC TTTGCAACTTGA | 1876 |
| hsa-mir-3180-2 | 3 | MSSFPGRLCQFLTLQLECQDFCSFYLY* | 1877 | ATGTCATCTTTCCCGGGAAGACTGTGCCAGTTTTTAACTTGCAACTTGAATGTCAA GATTTTTGTTCCTTTATCTGTATTAA | 1878 |
| | 4 | MSRFLFLSVLMFLRFQKYY* | 1879 | ATGTCAAGATTTTTGTTCCTTTATCGTATTAATGTTCTTAGAATTCAGAAATACA TATATTGA | 1880 |
| | 1 | MFPRVSTFLFLRPLSRHPLSSGSPETSAAAIMLLTVRHGT VRYRSSALLAR* | 1881 | ATGTTTCCTAGAGTCTGGACGTTCCTACCTCTTCGCCCCTTTCCGCACCCTTGT CCTCTGGAAGCCCGGAGACATCAGCGGCTGCGATTATGCTACTCACTGTTCGGCACG GAACAGTCAGGTTACCGCAGTTCAGCGCTGTCCGGTCTTAG | 1882 |
| hsa-mir-3204-1 | 2 | MLPPAGS* | 1883 | ATGTTACCACCTGCTGGGTCTTAG | 1884 |

Figure 1 (Continued)

| | | | | | |
|---|---|---|---|---|---|
| | 3 | MTCPRS* | 1885 | ATGACTTGCCCAAGGTCATAG | 1886 |
| | 4 | MNEYLLG* | 1887 | ATGAATGAGTACTTGCTGGGATAG | 1888 |
| hsa-mir-769 | 1 | MGHSSCQVLRSRSLECSFFFPFETEFRSCSPGWSAMAR3WLTETSTSQRGNYRRPPHPANCLYF* | 1889 | ATGGGACATTCATCCTGCCAGGTACTTGCTCTTGAGACAGAGTTCGCTCTTGTAGCCCAGGCTGGAGTGCAATGCGCGATCTTGCCTCACTGCAGATCCTCACTTCCCAGATTCAAGGAATTACAGGCGCCCGCCACCACCCAGCTAATTGTTTGTATTTTTAG | 1890 |
| | 2 | MLARLVLNS* | 1891 | ATGTTGGCCAGGTTGGTCTGAACTGTGA | 1892 |
| | 3 | MPHQLLCYHSGLSLSPALTWFVAVAFQVGSLPLTVRGILVEQKSGQVVSPFKPSPGSSHITLQKSSPYPRGPMLLGSSSSLPSTPITSLIPLAHSAAATLASPLSFEHSEHRAISGPLYSLSLNALPPQGLCTRCPVLLDQVFSGVCVASSTPLSGLRSDVSFTTRHLLKYYSS* | 1893 | ATGCCTCACCAGCTCCTTGCTACCACTCGGCCTCAGTTGTCTCCTGCTCTTACTGTTTGTTGCAGATCTCCAGGTGGGCTCCTGCTCCTCACTGTTAGGGRGATACTAGTAGAACAGAAGTCAGGTCAGTTGTTCTCCTTCAAACCCTCCTGCGCTCCCACATTACACTGCAAAAGTCTTCACCATATCCACGAGGCCCAACCTATTGGGTTCCTCCTCCTCCACTCCAACTCCCATCACTTCTCTACTTCCTGGTCACTCTGCTGCAGCCACCCTGGCTCCCCGCTGCTCCGTCATTTGAACATAGCGAACACATTGCCATCTCAGGGCCTTTGTACTCGCTCCCTGAACGCCACCTCAGGGCTGTGTGGCTTTCTTCCACACCTCTTCTGTCCTTGGATCAGGTCTTTCAGGTGTCTAGGTGTCAGTGAGCCACCTCTTTCAGGTCTCCGCTCAGCGTCAGCTTCACAACCAGCATTTGCTAAAGTACTACTCAAGCTAA | 1894 |
| | 4 | MALHLALFFFITPLPDIDYYYFF* | 1895 | ATGGCCCTTCACTTGGCTTTATTTTTCATAAACACCACTACCTGATATAGATTATTATTATTATTTTGA | 1896 |
| | 1 | MTVPLFSGGEQNICLLS* | 1897 | ATGACAGTCCACTTTCAGTGGAGAGAACAAATATCTGTCTACTCTCTTGA | 1898 |
| | 2 | MQADECHSCN* | 1899 | ATGCAGGCAGATGAGTGTCACAGTCGTAACTGA | 1900 |
| hsa-mir-1251 | 3 | MSVTAVTEAQSSTHSGADFRDGERGHRR* | 1901 | ATGAGTGTCACAGCTGTAACTGAGGCACAGAGCAGTACACAGTGGAGCCGATTTCGGCGATGGCGAGAGGGGCACCGGAGGTGA | 1902 |
| | 4 | MARGGTGGDNNNNKTVLRTSFR* | 1903 | ATGGCGAGAGGGGCACCGGAGGTGACAACAATAACAAGAGACTGTCCTTGGACAAGTTTTAGGTAA | 1904 |
| | 1 | MSDTGTTLPSQSPFQCWGSSVFSRPFPGFNASSRQRDGILGEC* | 1905 | ATGTCTGACACTGGCACCACTCTGCCATCCAGAGTCCATTCCAGTTCATTCAATGCTGGGGGTCATCCGGTTTCAGCAGGTTCTTCCCTGGGTTCAACGCGTCTTCCCGCCAGAGGGATGGAATCTTGGGTGAGTGTTGA | 1906 |
| | 2 | MLGVIGFQQVLPWVQRVFPPEGWNLG* | 1907 | ATGCTGGGGGTCATCGGTTTCAGCAGGTTCTTCCTGTGGGTTCAACGCGTCTTCCCGCCAGAGGGATGGAATCTTGGGTGA | 1908 |
| | 3 | MESWVSVEMRQKQKRKVELEHVTDLGPEVACEALEETPPCELMVTQLEDHKAQARESHPQS* | 1909 | ATGGAATCTTGGGTGAGTGTTGAAATGCGTCAGAAGCAAAAGCGAAAGTGGAACTGGAGCACGTCACAGACCTTGGACCAGAAGTGGCCTGTGAGGCACTGGAAGAGACGCCACCGTGCAGCTGATGGTCACAGCAGCTTGAGGAGACCACAAAGCCCAAGGCAAGAGAGAGCACCCCCAAAGCTAA | 1910 |
| | 4 | MQQSEAITGQGIDALKREEQPGPPAAV* | 1911 | ATGCAGCAGAGCGAGGCCATAACTGGCCAGGGAGACGGCACTCAAGAGAGAGAACAGCCAGGGCCGCCAGCAGCCGTCGGGGTCTAG | 1912 |
| hsa-mir-3179-3 | 1 | MMNVSLGLSEPLVICGLLIDRLLILLIDHVSGS* | 1913 | ATGATGAATGTTCTCTTGGGTCTGAGTCTGAACCCTGTCATTTGTGGGCTGCTAGATCGATTATTAATATTGCTGATTGATCATGTTAGTGGTTCTTAG | 1914 |
| | 2 | MPFLLVCLNPLSFVGC* | 1915 | ATGTTTCTTCTGGTCTGCCTGAACCCTTGTCATTTGTGGCTGCTAG | 1916 |
| | 3 | MLVVLSD* | 1917 | ATGTTAGTGGTTCTTAGTGATTAA | 1918 |
| | 4 | MWRLPDLTSQWSMTA* | 1919 | ATGTGGCGCCTTCCAGACTTGACTTCACAGTGGAGCATGACAGCTTGA | 1920 |
| hsa-mir-3180-3 | 1 | MMNVSLGLSEPLVICGLLDRLLILLIDHVSGS* | 1921 | ATGATGAATGTTTCTCTTGGTCTGTCTGAACCCTGTCATTTGTGGGCTGCTAGATCGATTATTAATATTGCTGATTGATCATGTTAGTGGTTCTTAG | 1922 |
| | 2 | MFLLVCLNPLSFVGC* | 1923 | ATGTTTCTTCTGGTCTGTCTGAACCCTTGTCATTTGTGGGCTGCTAG | 1924 |
| | 3 | MLVVLSD* | 1925 | ATGTTAGTGGTTCTTAGTGATTAA | 1926 |

Figure 1 (Continued)

| | | | | | |
|---|---|---|---|---|---|
| | 4 | MWRLPDLTSQWSMTA* | 1927 | ATGTGGCGCCTTCCAGACTTGACTTCACAGTGAGCATGACAGGTTGA | 1928 |
| | 1 | MWSECKKTSILK* | 1929 | ATGTGGGTCAGAGTTGAAGAAACTTGAAGAAAACTAGTAATCTTAAGGTAG | 1930 |
| hsa-mir-3159 | 2 | MVGRLHFLPSYQFCPFSHVYCVRESCDKIKSTVLHGEITRVH* | 1931 | ATTGTGGGAAGACTTCATTTTTACCCTGTACAGTTTTGTTTTTCAGTCATGTTATTGTGTTAAGAGAAAGTTGTGACAGTTGTATCAAAATAAAAAGTACTGTGTTAATAATTATAGGCGAAATTACAAGAGTCCATTGA | 1932 |
| | 3 | MFIV* | 1933 | ATGTTTATTGTGTAA | 1934 |
| | 4 | MKTWGKIIL* | 1935 | ATGAAGACTTGGGGAAAAATAATTCTGTAA | 1936 |
| | 1 | MKRHIATRATEHKKERGQRREARWHLLPAGGGASEERLPGLSGTPILTLHLRKGRLWRK* | 1937 | ATGAAAATAAAACACATGCAACCAGAGCACTGAACACTGAAAAGGAGGAGGACAGAGAAGAGAGGGAGGTGGCATCTGCTCCGGCTGCCGGCGCTTCGGAGAGGCTCCCCTGGCTGCGGCGGACCCGCATTTGACCCTGCATTTGAGGAAGGGCGACTGTGGAGAAATGA | 1938 |
| hsa-mir-4323 | 2 | MRREGVRAGGGSACFFFFLSLSLFLEVWGPV* | 1939 | ATGAGGCGAGAGGGGGTCAGGGCTGTGGGGGTCCGCCTGTTTTTTCTCTCTTCCTGGAGGTGTGGGGGCCGGTTAG | 1940 |
| | 3 | MMVRLVGDAV* | 1941 | ATGATGGTGAGGATATTGGTCGTGATGCTGTCTGA | 1942 |
| | 4 | MLSEAPKQAGCNGGGEVRGHRERERAGWWE* | 1943 | ATGCTCTGTCTGAAGCTCCCGAAGCAAGCAGGGTGCAATGCGGGGGAGAGGTAAGAGGCACAGGGGAACGAGAAAGGGCTGGGTGGGTGGGAATGA | 1944 |
| | 1 | MGDPHRLESQGLLSSAVKGLSLAGTGLNRREMHYLVSCDLGQQLGRVIWDAGSFPLSPPFHSSRFTTAQ* | 1945 | ATGGGCGACCGCACAGACTTGAATCCAGGGCTCCTCAGCAGTCTGTGAAGGGCTGTCCGCTGGACTGGCTTAACAGAAGGGAAATGCACTATCTCGTGTCTGCGATCTGGGTCAGCTCGTCCTTCATCGGATGCAGCCAGCCTCCCTTCCTCTTCCTCCTCCATTCATAGCTCCAGTTCACCACTGCACAGTAA | 1946 |
| hsa-mir-4267 | 2 | MQAPFLFLLLHFIAPGSPLHSNGQSKKGTIVPCAPFSGTR* | 1947 | ATGCAGGCTCCTTCCCTCTTTCCTCTTCCTCTCTATAGCTCCAGTTCACCACTGCACAGTAATGGCCAGAGCAAGAAAGGGACCATTGTGCCCTGTGCCCCTTCTCAGGCACCAGGTAGCCAGGTAG | 1948 |
| | 3 | MARARKGPLCPVPPSQAPGRLSLCLVDQD* | 1949 | ATGGCCAGAGCAAGAAAGGGACCATTGTGCCCTGTGCCCCTTCTCAGGCACCAGGTAGACTTTCCCTCGTCTCGTTGACCAGGACTAA | 1950 |
| | 4 | MSLMAWAVTSPYW* | 1951 | ATGAGCCTAATGGCATGGCAGTGGACATCCCTTACTGGTGA | 1952 |
| | 1 | MWISKREYESSPSAVRCKCL* | 1953 | ATGTGGATCAGCAGCGAATACGAGTCCAGCCGTCCGTGTCCGCTGCAAATGCCTCTAG | 1954 |
| | 2 | MPLGRLLSCVIPFLAKTYLWAKMKIGKAFVLFCFWIDSGFKKTRPMKVTAVSWSEHPPKPCNVSEDFD* | 1955 | ATGCCTCTAGGCAGCTGTTACTTAGTTGCGTATACGCTTCTTGCCAAAACCTATCTATGGCAAAAACAAGATTGGCAAGGCTTTGTTTTGTTTTTGGATTGACTCAGGATTTAAAAAACCGATGAAGGTGACAGTCAGTTGGAGTGAGCATCCCCAAAGTTCTGCAATGTCTGTGAGGACTTTGATTAA | 1956 |
| hsa-mir-1246 | 3 | MGKKQDWQQGFCFVLFLD* | 1957 | ATGGGCAAAAAGCAAGATTGGCAAGGCTTTTTTTAAGTCATTCAAATATCGTGAGATGCATTGTTACAGGAGACGCTTGCCATCCGAATGA | 1958 |
| | 4 | MCLRLTLINLFLSHSKYREMHCYRKTLAIPKTPLLSKENGPVLSRVPHMGGIDSSAFNVMKVM* | 1959 | ATGTGTCTGAGGACTTTGATTAACTTTTTTAAGTCATTCAAATATCGTGAGATGCATTGTTACAGGAAGACGCTTGCCATCCCAAAACCACCCCACTTCTCTTAAGCAGGACCCAGTCCTCTCCGAGTCCCACACATGGAGGTGATAGCAGTGTTTCAATGTAAATAAGGTAATGTAA | 1960 |
| | 1 | MIGLRPRHARRTVFVY* | 1961 | ATGATTGGTCTAAGGCCCCGGCACCGTCGGCGCACAGTATTCGTGGTGGTGTAG | 1962 |
| | 2 | MLTIEN* | 1963 | ATGTTGACAATTGAGAATTGA | 1964 |
| | 3 | MDFLLSAL* | 1965 | ATGGACCTCCTCCTCCTCAGCATTATAG | 1966 |
| hsa-mir-1274b | 4 | MEEGVGHASFYPYSNWISIDLKSDKKHLQSISLKLATCRLHLYDKTWYSNQGDH* | 1967 | ATGGAAGAAGGGGTTGGACATGCCAGTTTTTACCCTTACCCCTACAGCAATAACATCAGATAGGACCTTAAGTCTGATAAGAAACATTTACAATCTATTTCTGAAACTTGCTACCTGCAGGCTTCATCTGTATGATAAACCTGGGTCTCCAACCAAGGTGATCATAA | 1968 |
| | 1 | MGAERLGVRGNSLTRGALAGPAAASETF* | 1969 | ATGGGTGCTGAAGCGTTTAGGGGTGCGGGCAACTCCCTAACTCGTGGGGCCCTGGCCGGCCCCTGCCGCGGCGTCGGAGACCTTCTGA | 1970 |

Figure 1 (Continued)

| | | | | | |
|---|---|---|---|---|---|
| hsa-mir-1247 | 2 | MRRWPLFSISQSRDFSAVWGRGAHPRNLLRRGKPAWSLPLASVLLSCPSPLWVGGVFQVG* | 1971 | ATGAGAAGGTGGCCCTCCTTCTCCAATCTCCAGTCAGGCGATTTCTCTGCTGTGGGGCAGGGGCGCACACCCAGGAACTTACTACGTAGAGGGAAGCCAGCCTGGTCTCTCCCCCTTGCGTCAGTGCTCCTAAGCTGCCCCTCACCACTCTGGGTAGGGGTCTTTCAGGTGGGCTAG | 1972 |
| | 3 | MGWFPKPFSHS* | 1973 | ATGGGATGGTTCCCAAGCCCTTTCCACAGCCCTTTCCACAGTAG | 1974 |
| | 4 | MVPQALFPQLVSENA* | 1975 | ATGGTTCCCAAGCCCTTTCCACAGTTAGTTCAGAAAATGCATAA | 1976 |
| hsa-mir-1253 | 1 | MRAALDGRHCQAGLVQTPRFFLGPLPTLCSGAAALTWATRSKP* | 1977 | ATGAGGGCTGCGTTAGATGGGAGACACTGCCAGGCTGGGCTGTGCAAACCCCAGATTCTTCCTGGGCCCCCTGCCAGGCAGCCCTAACCTGGGCCACAAGGAGCAAACCCTGA | 1978 |
| | 2 | MGDTARLGSCKPPDSSWAPCQRSAQEQP* | 1979 | ATGGGAGACACTGCCAGGCTGGCTCGTGCAAACCCCAGATTCTTCCTGGGCCCCCTGCCAACGCTCTGCTCAGGAGCAGCCCTAA | 1980 |
| | 3 | MMPQGDDAAGR* | 1981 | ATGATGCCGCAGGGCGATGATGCCGCAGGCAGATGA | 1982 |
| | 4 | MMPQADEQ* | 1983 | ATGATGCCGCAGGCAGATGAACAGTGA | 1984 |
| hsa-mir-3158-2 | 1 | MEAWPLLHHFLHNGNNNTYLVGSL* | 1985 | ATGGAAGCTTGGCCTTCATATTCACTTTCTGCACAATGGAATAATAATATCTATCTTGTBGCTCATTGTGA | 1986 |
| | 2 | MGHISLWAHCEM* | 1987 | ATGGGAATAATAATATCTATCTTGTGGGCTCATTGTGAGATGTGA | 1988 |
| | 3 | MCARPF* | 1989 | ATGTGCGCACGCCCTTTCTAA | 1990 |
| | 4 | MTMGIREWGGGQEWLQVVGSS* | 1991 | ATGACCATGGGAATAAGGAGTGGGGGTGGGGGCAGGCGCGGGGTCGCATGGCTGA | 1992 |
| | | | | GGAGTAGTTGA | |
| hsa-mir-1285-2 | 1 | MGAGAERRGAARGRHG* | 1993 | ATGGGCGCGGCGGCGAGGCGAGCAGCGGAGCAGGAGGCGGTGAGTCCATGTGAAGAG | 1994 |
| | 2 | MAELQQLRVQEAVESMVKSLERENIRKMQVAGLGPNQDPLLSGWVPGPSLSHHATPCTAAASPQTGCGRPWGRRGGLGQDFGSFGGSDEIRVFLPCARLFSAPSSPGQERPRKQVGSPWWQALAPPPSFLTRPLPQVSGPRPSRGAANVKDQKGEDFRPPRWPGHACPSCAQPRFTQRGFLHCSSLSPAMPLCVSVLLSRSSMRFPDSAP* | 1995 | ATGGCTGAGCTGCAGCAGCTCCGGGTGCAGGAGGCGGTGGAGTCCATGTGAAGAGTCTGAAAGAGAGAAACATCCGGAAGATGCAGGTAGCGGGGCTGGGGCCGAACCAGGACCCCCTTCTCAGCGGATGGGTTCCCAGCCGGTCCCTGAGCCATCATGCCACACCGACGCCTTGCACTGCAGCGCTGCAGCAGACGTTTGGCGGATCCGGGAAGATCCGTGTGCCCTTCGGCCTGCGCGAGGCTGTTTCGGCCCCTTCCAGCCGGGCAGGAGCTCCTGGCGGGCGGTGGGAAGCCCCCGTGGCCAAGCCCTTACGGGGCCCGCTGGCGGCCAGGCGCTCCAGGCCCTGCCTCTTACGCGGGTTTCCTCTCAGATAGCAGGAGTATGCGTTTCCAGATAGTGCCCCTTGA | 1996 |
| | 3 | MKSVCPCRARGCPPPLPARGRSVLGGRWEAPGGRRSPHHLPLLRGPFRR* | 1997 | ATGAAATCGGTGTGCCCGTGCCGTGCGCGGGGCTGTTTTCCGCCCCTTCCAGCCGGGGCAGGAGCGTCCTCGGCGGCAGGTGGAAGCCCCTGGTGGCCAGGCGCTCGCCCA | 1998 |
| | 4 | MPASLAPNLASHSAGFYTVLL* | 1999 | ATGCCTGCTTCTCTTGCGCCCAACCTGCTTCACACAGCGCGGGTTTCACACTGTTCTTCTCTGA | 2000 |
| hsa-mir-1285-2 | 1 | MGSCCCLFGDAAILASAREG* | 2001 | ATGGGCTGCGTGCCTGCGTGTGTCTTCGGAGACGCTGCTATCTTAGCGTCAGCGAGGGAAGGTTGA | 2002 |

Figure 1 (Continued)

| | | | | |
|---|---|---|---|---|
| hsa-mir-3168 | 2 | MQSREDAPRSRRLASPRGGKRPKKJHKPTVSAFFTCGPEE LKDTAHSAALLAQLKSFYDARLLCDVTIEVVTPGSGPG TGRLPPCNRNYLAAACPYFKSMFTGRMYESQQASVFM HDVDAESFEVLVDYCYTGRVSLSEANVERLYAASDML QLEYVREACASFLARRLELTNCTAILKFADAFGHRKLRS QAQSYIAQNFKQLSHMGSIREETLADLTLAQLLAVLRL DSLDYESEQTVCHVAVQWLEAAPKERGPSAAEVFKCV RWMHFTEEDQDYLEGLLTKPIVKKYCLDVIEGALQMR YGDLLYKSLVPVPNSSSSSSNSLVSAAENPPQRLGMC AKEMVIFFGHPRDPFLCCDPYSGDLYKVPSPLTCLAHTR TVTTLAVCTSPHDIYLAAQPRTDLWVYKPAQNSWQL ADRLLCREGMDVAYLNGYIYILGGRDPITGVKLKEVEC YNVKIRNQWALVAPLPHSFLSFDLMVIRDYLYALNSKR MFCYDPFSHNMWLKCVSLKRNDFQEACVFNEERYCICDI PVMKVYNPVRAEWRQMNNIPLYSETNNYRIKHGQKLL LIFTSRITPQWKKNRVTVYEYDIRGDQWINGTTLLGLLQFD SNFFCLSARVYPSCLEPGQSPLTBEEIPSESSTEWDLGG FSEPDSESGSSSSLSDDDFWVRVAPQ* | 2003 | | 2004 |
| | 3 | MRGCCVM* | 2005 | ATGCGCGCTGCTGTGTGATGTGA | 2006 |
| | 4 | MCWPRHVPTSRACSQVACTRASRPA* | 2007 | ATGTGCTGGCTGCTGGCATGTCCTACTTCAAGAGCATGTTCACAGGTGGCATGTACG AGAGCCAGCAGGCCAGCGTGA | 2008 |
| hsa-mir-1973 | 1 | MLSPKL* | 2009 | ATGCTTAGCCCTAAACTCTAA | 2010 |
| | 2 | MRWQEMGYIFYIRQSQQPL* | 2011 | ATGAGGTGGCAAGAATGGGCTACATTTTCTATATCCGGCAAATCTCACAACAACCT TTATGA | 2012 |
| | 3 | MKSKGSRRI* | 2013 | ATGAAAATCAAGGGCTCAAGGAGGATTTAG | 2014 |
| | 4 | MKHAHTAHHPPQLL* | 2015 | ATGAAGCATGCACACGCTCATCACCTCTCAAATATTACTCTAG | 2016 |
| | 1 | MFAYTLAPGRR* | 2017 | ATGTTTGCTTACACGTTAGCTCCTGGAGGAGATAG | 2018 |

Figure 1 (Continued)

| | | Protein | SEQ ID | Nucleotide | SEQ ID |
|---|---|---|---|---|---|
| hsa-mir-4309 | 2 | MKRVLPSHFPAGHKLLQFSKVSKPRQSQA* | 2019 | ATGAAGCGGGTACTGCCATCCACTTTCAGCAGGCACAAGCTCTCCAATTCTCCAAGGTCAGCAAGCCACGGCAGAGCCAGGCCTAG | 2020 |
| | 3 | MPCAGTRGAPGGLRKVRPHVTGQSHGRGS* | 2021 | ATGCCCTGTGCGCTGGCACGCGTGGGGCGCCGGGGCGCTCGGGCGCGGTTACGTAAAGTTCGGCCTCCCCACGTCACCGGGCAGAGTCACCGCCGCGGCTCGTGA | 2022 |
| | 4 | MGGGAGATGCRASPPLPRTGARAVPRGRIAGRRCRRRRRAAGGGRRAGATAARARRSRALSRRGRIAGRRCRRRRRAAGGGRRAAQCGPGQAGQRDRPPPPLARAAGPRHHPLAAALJHCYVTGRRAGRTAGPAENFGET* | 2023 | ATGGGGGGCGGGGGCGCACAAGCCGGGGCCGTCCCGCCCGCTGCCGCCGGACCGGAGCGGGCGCGTCCCCGCGGCGAGCGGGCCAAAGGTCCCACGACGACGCACGGAGGGACCACCGCGGCGCCGCCGCCGCGCGTGGGCGGCAAGCCCATCCCGAGCGGCCGGGGAGCGGCGGCGGCACCGCGGGGCAAGGAACGGCAACGCACCCAGCTGCGCGCCGCCCCATTGGTACGTCTGGCCCGGCCGCCACCACGCTGAACGCTGGAAAACCTTGTGAGAAACTGA | 2024 |
| | 1 | MGTRGLPGSRAGAAPGGFAGRASLGRGGSPLQKGRVPPSASCARPSLGJGSGRGWRCFAFPPFS* | 2025 | ATGGGGAGGGCCTTCCCGGCTCTCGGGAGAGGCCTCCCGGCTCTCCCTGGGAGTGAGCCCCTCTGGGAATAGGAAGCCGGAGAGGCTGGAGATGTTCGCAATTCTTTCCGTTTTCCTGA | 2026 |
| | 2 | MFRILSVFLRSFSWVQSLLKVC* | 2027 | ATGTTTCGCATTCTTTCCGTTTTCCGTTGGTCCGTTAAAGTCTGTAA | 2028 |
| | 3 | MRAGRWVLQTARRGLPALGPSTAGSGAAHSPPGVRQEARRLPFRRTLRVT* | 2029 | ATGCGTGCGGGCAGGTGGGTCTGCAGATCGCGGCGCCCTGCCTCCGAGTGAGGCAGGAGGCACTTAG | 2030 |
| | 4 | MGVSLSWNVWGLVQRWGLGSCWEGGAPKDNGGPFSSCSQVDGSLPCPSELSLAGPRAAARGSPAEVAAAGTYGLSWPGDSWVLLLLSCHQANVVSFLSLYSIVPDIAVGTKVGTSHFASP* | 2031 | ATGGGGGTGCTTGGAGGGAGGCAAAGGACAATGGTGGCCCCTTCAAGTTGCAGTCAAGTGACGGCTCACTTCCTGCCAGGGCTGGCAAGTGGCCTGTGCAGCAGAGGCAGCCTGGGCTGCAGCTGCAGGGACCTGCAGGGAGGCCACCAGCTAACGTTGTCTCCTTCTTTCTCCTCTACAGCATTGTCCCCAGATAGCCGTTGGTACAAGGTAGGCACTTTAA | 2032 |
| hsa-mir-3187 | 1 | MPHSKEKKTCKKCKNDNRKTILFRAPQ* | 2033 | ATGTTCATTATAATCTCAAAGGAGAAAAAAACTTGTAAAAATGCAAAATGACAACAGAAAAACCATCTTATTCGAGCATTCCAGTAA | 2034 |
| | 2 | MTTIEKPSYSEHSSMPFVYVLSCTISSSWFV* | 2035 | ATGACAACAGAAAAACCATCTTATTCGAGCATTCCAGCATTCCAGTAACTTTTGTGTATGTACTTAGCTGTACTATAAGTAGTTGTTTGTATGA | 2036 |
| | 3 | MYLAVL* | 2037 | ATGTACTTAGCTGTACTATAA | 2038 |
| | 4 | MRWLKRPKIKGFFFLFCL* | 2039 | ATGAGATGGTTAAAAGGCCAAAGATAAAAGGTTCTTTTTCTTTTGTCTATGA | 2040 |
| hsa-mir-1244-3 | 1 | MAPPALRAGELGRERGGERDTRAGTKPCYRVVGQAGWLASLVSIGERPPAVAPTCESAGAGMVLGVMAAGWGSRCPPCRSRRPALSHQLGPIPPAPVGAGRVPIAAAAAILASATPRHRARPCGPLALSSLPARASRG* | 2041 | ATGGCCCCGCCTGCCTGAGAGCTGGAGAACTCGGGAGGGAGGAGGAGAGAGAGACACGCGTGCGGGGACGAAACTTGTTCGTCGTCATGGGGGCAGGCTGGATGGCTCGGCCAGCCTGGTGGATATGCGGGACGTATCGGAGGAGCGCCCCTGCCGTTGGAGCGTCTCCGGCGATGTCTCGGCATGCGGGGCCTACCGCGCATCCGCCCTGCTGCCTGCCGGCGAGCCGTCGTCCGCCTCGTCCACCAGCTCGGCGCTGCCCCATCCTTGCCTTGCCACACCGGCACCGCGCACCGAGCGTCCTGCGCCGCCTGCCGTCTCCAGCCTTCTCCGCGTAGGCGGTCTCGAGGGTAG | 2042 |
| hsa-mir-1826 | 2 | MARQPGEYRGAPPCRGPYM* | 2043 | ATGGCTCGCCAGCTCGGTGAGTATCGGGGAGTATCGGGGAGCGCCCCTGCCGTGGCCCCTACATGPGA | 2044 |

Figure 1 (Continued)

| | | | | |
|---|---|---|---|---|
| | 3 | MGRVRWARGGVRSGGARPSLASPADSIPSASRGRASLSSRR* | 2045 | ATGGGTCTGGTGCGGTGGCCCGCGTGGCCCGACTCCATCCCTTCGGTTCGGAGGGCCCGCCCTCCCTCCCCTCCCGCCGACTCCATCCCTTCGGCCAGCCGGGGCGCTGCCTCACTTTCAAGTCGCTGCTGA | 2046 |
| | 4 | MACAPCCGGGNPRAPYGCCQCSPSAPVVDTASLCCETFLPLSGVWSRCCLTGFHEGNPLADVLCQEGLLVLGAPFLPNPPCMTFSGGSLGFCVDEERS* | 2047 | ATGGCCTGTGCACCTGCCTGCCCGGGAATCCCGGCGCCCGTGGGTGCTGCTACCCCCTCTCTGGAGTCTGTTGCCCCCGTGGTCTGTTGCTGTTGACTGGCGCCTCCTGTGTGTGAAACCTTCCTACCCCTCTCTGGAGTCTGTTGCCCCCGTGGTTGTGACTGGCGCCTCCTGTGAAGGAAACCCTTGGCCGACCTGCTGTGCCAGGAGGCCTCTGGTTGGAGCGCCCTTGCCAAATCCACCTTGTATGACTTTAGCGGTGAGTCACTGGCGTTCTGTGTCGATGAAGAACGCAGCTAG | 2048 |
| | 1 | MSLPGEHSSLRPHSQKLCLDSPGVGELAARIPKRYRGDVRASGCKPQARRALARSTGSLGSALQGG* | 2049 | ATGTCACTGCCTGGTGAGCACTCTTCCTCAGACCCATTCCAGAAGCTCTGCCTGATTCCCCAGGGTAGCGAGCTGGCTGCCAGGATTCCTAAGCGTACCGGGGAGAGTGTGAAGGGCTCCGGCGGCTGGGAAACCCTAGGCCAGCGCTGCCTGCGCTCGACGGGTCTCCGGGAGTGCTTTGCAGGCGGATGA | 2050 |
| hsa-mir-3149 | 2 | MTTDGPATCLPEPAEINSLSSLCTQAPRAGRSPSAAQLPQARRSHLPEGSLPTRPSLSRSSSDSHQGTPEARRLAATRRRLPEALRDVRKQRKPCPPKPRLPLGPSTLYVVSSLAAPDPGLTGS* | 2051 | ATGACTGACGGCCAGCTACCGCTCCTTCCTGAGCCTGCAGAGATAAACAGCCTATCCTCCCTGTGCACACAGGCCCGGAGGGCGGAGTCTCAAGCGCAGCACAACTGCCCAGGCCCGACGCAGCCAGGTCCCCGAGGGCTCCACCCAGGCCATCCCTCAGCCGGTCCCTCGGACAGCGAACAAGGAACCCGGAGGCGCCGAGGCGTCTGCCGCACACCGTGGCGGCTGCCCCAGAGGCCCTTCGCGATGTCGGAAGCAGAGAAAGCCCGGCCCTGTCAAGCCCGGCTCCCTAGGCCCTCGACGTGTAGTGCCTCACTTGCCCTTGACCCGCGGGCTGACCGCGGTTCGTGA | 2052 |
| | 3 | MSASRESPALPSPGFP* | 2053 | ATGTCCGCAAGCAGAGAAAGTACGGAGCCTGCCTTCCCAAGCCCTGCCTAG | 2054 |
| | 4 | MFQRKLRGAWAFRRLRSVSALESRSANPRSCFQLGGRGVSRPCNCRRLLPPCLLASCLPGKGKSKLLNFGKGSEANLNS* | 2055 | ATGTTTCAGAGAAAGTTACGTGGAGCGTGGGCGTTTCGCAGACTCTCAGGTCAGTGTCTGCCCTAGAGAGCCGGAGTGCAAACCCGGAGTGCAAACCCCGAGTCCTGTGCACTGGCTCCCTGGCGTGGAGGTCGTGGAGTTTCACGACCTTGTAATTGTGCCGCGGTTGCTTTTTCCCGTGTTATTGGCTTCCTGTCCCCTGAAAAGGCAAATCAAGCTGCTGAATTTGGGAAAGGCAGTGAAGCAAACCTAAACTCCTAA | 2056 |
| | 1 | MWPQRLPPRPAMSEETRQSKLAAAKKKVKCTGSRPPDPAPAPLRWQDHGQSLCHS* | 2057 | ATGTGGCCCCAACTCCGCTCCCCGCCCGGATTCGGAAGAAAACCCGACAGAGCAAATTGGCCGCAGCGAAAGAAAAAGTAAAGTGCACTGGGCTCGCGGTCCGCACCTCTGCCACTCCTGA | 2058 |
| | 2 | MAGPWPESLPLLRHTGLGSPRRVRAPSTKVLSASPAPSAAQPPPSPVAPG* | 2059 | ATGGCAGGACCATGGCCAGAGTCTGCAGAGTCCTGCACTCCTGAGGCACACCGGGCTGGGTCCCCACGGCGCGTCCGGGCTCCCAGCACCAAAGTGTTGTCAGCCAGCCCGCCCCCCCTCAGCCGCCCAGCCCTGCGCTGGCGCCCCGGGTGA | 2060 |
| | 3 | MARVSATPEAHRAGLPTARPGSLHQSLVSQPRRLSRPAPALASRPRVTLGWCSRGSPLQTRPSPPAPRSPTSLGSLGWRLQGPRTPAIQPLPSPVTLGP* | 2061 | ATGGCCAGAGTCAGTGCTCCACTCGAGGCACACAGGGCTGGCTTCCCACGGCGCGTCGGGGCTCCCTCCACCAAAGCCCAGCCGGCCTCAGCGCCCCGCCCGGGGCCAGTTTCCAGGGCGCCCGACTTTGGGGCTGTCCCCCGAAGTCGACTTCCCCGGAAGTCCAGACTGCTCAAGACTGCGAAGCCCTGCTCCAAGGACGTCCAAGGAGCTCCAAGGACCTAGGAACCCAGCAATTCAGCGCCTCAGCCCCTCGCCAGTGACTTTGGCCCCTGA | 2062 |
| hsa-mir-3154 | 4 | MPPLGVFCSDVTIPLGTVISCARPVFDLRTQSPKCSHPASGSSGHSINFQLEGDWGLWDLCGRGFRLPYTLNIDIDSVKSLHFTRELKTLAVSLGGNVRTGLVWFSPRLLLSRETLTFFSDFSTSYSNSPWFWDQSALQWSLE* | 2063 | ATGTTCCCCCTAGGAGTGGAATGGAATGTAGTGACGTCACAATTCCCGTGACTTCACAATTCCCGTGAACCGTAATTAGTTGCGGAGACCAGTCTTGATCTTAGGACCGCAGTCCTTAGGCGCCAGTCCCTAAGTGCTTCTCATCCTTCCTGGTTTCCTTCGGTCACAGCATAAATTCAGCAGGGATTGGGTACTAGGGACTATGGGACCTTAGGAGGAGGAGGTTTCACCCTGCCTTAACACATAGACATTGACAGTGTGAAAAGCCTACACTTCACCCTGAACTGAAAACATTGGCAAGTATCTCTGGGTGGCAATGTGAGAACGGGATTGGTTTGGTTTTCCCCAGGTTTCTACTCTCCAGAGAGACTTTAACATTTTTTCGACTTCTGACTTCTGCACTCTATTCGAATTCGAATTCGAATTCTACGAATTCGAAT CCATATTCGAATTCGAATTCGAAGATTCGAATATTCGAATTCGACATATTCGAATTCGAATTCGAATTCGAAGCCCCCAAAGCAAATTCGCAAATTCGCAAAGCCAAAGGTCTCCAATTCGAAGCAGGTTCAGGTTCTACTCCTCCAGAGAGACTTTAACATTTTTTCGACTTCTGACTTCTGCACTCTATTCGAATTCGAATTCTACTCCTCCATGGTCTCGGAATGA | 2064 |

Figure 1 (Continued)

| | | | | |
|---|---|---|---|---|
| hsa-mir-1184-2 | 1 | MAAVGITKRRSGNDVPLFLPRRKRGCMRFGNRQSHLV NVTDAKSPGLGKKKSLGEWDGSDSLS* | 2065 | ATGGCGGCAGTAGGAATAACAAAACGCAGAAGCGGGAACGATGTCTTTTATTCCT CCCAGACGCAAACGTGGATGCATGAGGTTTGGTAACAGGCAAAGTCATCTGGTTA ACGTGACTGATGCAAAAAGTCCCGGCCTGGGCAAAAGAAGTCACTGGGTGAATGG GATGGATCAGACTCCCTGTCCTGA | 2066 |
| | 2 | MSPYSSPDANVDA* | 2067 | ATGTCTTTTATTCCTCCCAGACGCAAACGTGGATGCATGA | 2068 |
| | 3 | MHEVW* | 2069 | ATGCATGAGGTTTGGTAA | 2070 |
| | 4 | MQKYPAWAKRSHWVNGMDQTPCPEGEMVSCRTR* | 2071 | ATGCAAAAAGTCCCGGCCTGGGCAAAAGAAGTCACTGGTGAATGGGATGGATCA GACTCCCTGTCCTGAGGGGGAGATGGTTCTGCAGAACGAGGTGA | 2072 |
| hsa-mir-1827 | 1 | MVSFVEFVYYCLFVLRWSPAPSPRWKCSVMISAHCNL GLPGSSDSPASAS* | 2073 | ATGGTCTCATTTGTTTTTTGTTTGTTTGTTTGTTGTTTGAGATGGAGTCC AGCTCCGTCACCTAGGTGGAAATGCAGTGTCAGTGATCTCAGCTCACTGCAACCTCGG CCTCCCAGGTTCAAGCGATTCTCCTGCCTCAGCCTCCTGA | 2074 |
| | 2 | MESSSVT* | 2075 | ATGGAGTCCAGCTCCGTCACCTAG | 2076 |
| | 3 | MQCHDLSSLQPRPPRFKRFSCLSLLSSWNLQVPTTTPS* | 2077 | ATGCAGTGTCATGATCTCAGCTCCGTCACCTGCAACCTCGGCCTCCCAGGTTCAAGCGATTC TCCTGCCTCAGCCTCCTGAGTAGCTGGAATTACAGGTGCCCACCACCACCCAGC TAA | 2078 |
| | 4 | MIRPPRPPKVRD5KYEPPRPVSLICF* | 2079 | ATGATTCGCCCGCCTAGGCCTCCCAAAGTGCGGGATTCCAAGTATGAGCCACCGCGC CCAGTCAGTCTCATTTGTTTTTAA | 2080 |
| hsa-mir-4283-2 | 1 | MITPS* | 2081 | ATGACACCCTGTGA | 2082 |
| | 2 | MVMRGAGARVVACAGSSTNGSGAGQLVKAGGAGLGC GSARRTLGALARLSTGSGGLFLEPGVLLGSRAKGVLGT SSVGFPSSRVAALSAKQNR* | 2083 | ATGGTGATGAGGGGTGCTGGGGCCAGGGTGGTGCAGGAGAGCTGCAGCTCCACAAA TGGCTCGGGGCGCTGGGCAGCTGGTGAAAGGCGGGGTGGTGCGGGACTGGCTGCGGCA GTGCCCGGCGCACCTGGGGGCCTTGACTCGCTTGTCCACAGCCTCTGGGGGCTCT TCTTGGAACCTGGAGGTGCTGCTCGGGCTCCAGGGTACGGGGTACTGGGGACTTCG TCTGTTTGGGTTCCCTTCCTCCAGGGTAGCAGCTCTGTCTGCAAAACAAACAGATGA | 2084 |
| | 3 | MARVLGSW* | 2085 | ATGGCTCGGGTCCGGGTCTGGGCAGCTGGTGA | 2086 |
| | 4 | MRGWGGGFLAEMSCGPHQKGLLL* | 2087 | ATGAGAGGCTGGGGCGGGGGCTTCCTGGCAGAGATGAGCTGTGGCTTTCATCAGAA AGGCCTGCTTCTGTGTA | 2088 |

Figure 1 (Continued)

| | | | |
|---|---|---|---|
| hsa-mir-3195 | 1 | MLMLAAVLAGPLAARVCAAGGAACTTLLGDSALTPGA GAAAJAAPGPGWPLTPAGPPAAGAGAGAGAAPALPPFWAA AGGTAGAAVGPAGWPGGRARVAGAGGGGGAAA GAAGAGAAGGEGAAGAGGAAAAPTKGGYWMTVPGAA GLGSGSSAAGPLLTRLTAGAAAWCEFSSAALPFKVCAA PGFAGLPGPGPGPGPGQAQGPGPARAASAAGPAGLAGP AGAGSGPAATAAAAGTIGAQDPALPSGGGLSFAAGGAG PAGTRGRGREGGPGRCGPPPPGRALPAGGGSGAAPGAP SAGAAGPAPAAPAGLPLTTWFPSAPAAAARTSGVRGAR WWWWAALAASCDSSEPTRSLTTFSSTSLLKKTSSSRSEP AAIFFPRPPPPPLGPSAPGRGGGSDWGGRWAGGGRRA AGGGRGRAAGGRGSGGGPAQARRPRAPGDWLRRAL KRRGQWLRALEAGARAVGRGAAAAGSAGAQGRG RRGGGRGGGRRAAGRGMRERCAGPGRGGRGAATGPR SLSRLAPKWLRRR* | ATGACCATGCTGGCCGCCGTGCTGGCCGGCCCTGGCCGCCGGCCGC CGGGGGCCGCCCCTGCTACCACCCTCTTGGGCGACTTGGGGCGG CCGCGGCAGCCGTCCGCGGACCCGGAGTTGCCCCGTGCCGGC CGGGCCGGCGGACGGCGGCGGCGGCGGGCCGGGAGGTGGCTGGGGCCG GGGGCCAGAGTGCGTCAGTGGCGGCCGTCTGAATACAGTGCCGGAG GGCCACGAGCAGCGGCGGCTCGGGCCGTCTGACCAGCTGGGCAGC GGCAGCAGCGCGGCGGCGGCCGTCGATGGCCCGGCAGGTGCGGCGCCCC CCGCGCGCGCTGGGCCTGCCGAAGCCTCCTGGCCTTGCCCGGGCCGCGG CCGGCGGCAGCAAGCCCGGCGGCGCCGACTGCGAGCGGGCCGCGG GGGACAAGGCGGCGGCTCTACCTGCGGGGGCCGCTCGACGCCCCCTTCG CCGGCCGCGGTCGGCCGTCCTCGCGCCCGCAGCCGCCGCCGCTCACAACATG GCGGGGGGCTCGAGCGCGGCCGCCGCCGCACCTCGAGCGTCGTGCGGCGAGT GTTCCGAGCGCTGGCCGCGAGCTGCTGACCTGCGACTCGAGAAGACCTCGTCCAGCAGGGAGCCCACCAGGTTCG GGTGGTGGTGGGCCCGGGCCCGGCCGCGCCGGGCGCGCCCGGGAGGCGCTACCAGTATCGAG CGCGCGCCGCATCTTTTTCCTGGGCGGCCAGGAGGGCCGAGCTCAGCGGAG CCTGGGCTGCAGGAGGGTTCCCGACCGGACTGGGAGAAGCGCTGAGCGTGGGGAC CGGGGTGCGGGAGCAGCAGCGCGGACGGGGAGGGCGCGCGCCGGCGTGAGCTCAGGGGCGCGGCC ACGGTGCTGGGCCGTGGCGGACGGCGGAGGCCGAGGCGGCGACGGGACCTCGCTT TGTCTCGGCTCGCTCCAAATGGCTGCGGCGGCTGA | 2089, 2090 |
| | 2 | MVPERAGGRGPHLGRARREVVVGRAGRQLRLQRAH QVAHHFLVHLAVEEDLVQQIRARRHLFSSAAAAAARA ERAWARRRFRLGRALGGRGAARGRRGAGARGRGAGE RGWRPCAGAETAGARRLAAARA* | ATGGTTCCCGAGCGCGCCGGCCGCGGCCGCACCTGGGCGTGCGCGGCGA GGTGGTGGTGGGCCGCGCTGCGCTGCAGCTGCGACTCAGCGAGCCCAGG TCGCTCAACCACTTTCTGCTTGAAGAGAGACCTCGTCAGAGATCC GAGCCCGCCGCCATCTTTTTCCTGCCGCCGCCCTGGGCCGAGC GCCCTGGGCGAGGAGGAGGTTCCGACTGGGCGCGCCGCTGGCGCTGCGGGCGGC GGCGCGGGAGCGCGGCCGGCGGCGCCGGCGCCGGCGGAGCGGGG GTGGCGGGCCGGGACCGGAGAGACCGCGGGACCGCGGGATTGGCTGCCGGCC GCGCTTAA | 2091, 2092 |

Figure 1 (Continued)

| | | | | | |
|---|---|---|---|---|---|
| | 3 | MAASARGRGAGGRPGCGSSGGKRGGWSSGARAPGRW RTGRGPPGGGARDAGTVRWAGPRRARGIDGASLFVSAR SKMAAAALTGAPGGRRARWQRRRKRARPRPGEQRAGM PGRRRAARRPW8GWAWEAGNGNGEGTVAARPGDGDRR PAPPSRRGEAGSASGSAGPGRWGGVLRARLFSPSNRDH PWPFPFLNKPSRPGLTVPAPSCLGDRSVV* | 2093 | ATGGCTGCGAGCGCTAGAGGGCGCGGGGCGCCGGGGGCGCGGGGCGGGTCGCGGGGGTGCGGCAGCA GCGGCGGGAAGCGCGGGGCGCCCGGAGCTGGAGCTCAAGGGGCGCTGAAGGCCGTAGGCGGTGGCG GACGGGGAGGGGGGCGCCCCGGCGGGATGCGGGAAGCGGTGCGCTGGGCG GGGCCGAGGGCGGCGGCGCGCGGGAGGCGGACGGGAGCGCCTCGCTCTTTGTCTCGGCTCGCTC CAAATGGCTGCCGGCGCTGACGGGAGCCCGGGAGCCGGGAACAGCGCGCTGCCGCGTGG AGCGGCGGCGCAGGGCCCTGCGAGCGCAGGATGGGATGGGCGGGGATGCCGGG ACCGGCGGAGGAGGACTGTCGCAGAGCTGTGTCGCCTCTGCTCAGCCGTCGGGCGGT GGGGAGGGGTCCTGCGCGAGGRTCCTGCGACTCTCTTCTGGTACCAGTGTACCACCCTCTGC TCCCCTGCCATTTTAATCAATAAACCAGCGCCCGGGCTGACTGTCCCGACCC CAGCTGCCTTGGAGACAGGAGTGTCGTATAA | 2094 |
| | 4 | MGLGGGRERGGDCRSAPWGRGPAPGPSKPPRGSWVRL WLSRSRAVGRGPARTALLALQS* | 2095 | ATGGGCTGGAGAGGCGGGGCGGGAACGGGAGGGGACTGTCGCAGCGGGACCTGGG GACGGGGACCGGCGGCGCCCGCCCTCCAAGCCGCGCGGGAAGCTGGGTCGCCTC TGGCTCAGCGCGGTCCGGGGCCGGTGGGGAGGGGCTCTGCGCGCACGGCTCTCTGCG CCTCCAATGTGTGA | 2096 |
| hsa-mir-1538 | 1 | MGLASCRRKGPGCCS* | 2097 | ATGGGCCTGCTTCTGCGGCGCCGGGCTGCTGTCCGA | 2098 |
| | 2 | MANRIPKTSSY* | 2099 | ATGGCAAACCGTATCCCAAAACCTGAGTATTGA | 2100 |
| | 3 | MEEERI* | 2101 | ATGGAGGAAGAACGCATTTAA | 2102 |
| | 4 | MPVATWAWFLSYSNGFVFYLQG* | 2103 | ATGCCAGTAGCCACGTGGGCATGTTTTAAGCTATTCGAATGGTTTCGTTTTTATC TACAAGGATAG | 2104 |
| hsa-mir-4283-1 | 1 | MRKRRRRRKRRRKTKRKRRRRRRRGRRRPVRPPW SWQRCSYGPRRHGPRRRSPRPRSCRLPPPLLSPSHCCCC CCSRTLRPRPAQPGPCPGSWGSQSPRT* | 2105 | AGGAAGAGAAGAGGAAGAGGAAGAGGAAGACGAAGACGAAGACGAAGAGGAGG AGGAGGAGGAGGAAGGAGGAGGCCAGGGTGGCCTGTGGAAGGCCGTGAAGGCCGCCT GGAGCTGGGCAGCGCTGCAGTTACGGCCCGTCCCCGAGCCGCCGAGC CCCGTTCCCGTCGTTCTTGCCTTCCTCCTTCTCGGCCCGTCTCCGAGCCACTGCTGCT GCTGCTGCTCTCCGGCGACTCTTCCGGCCCGCCCGTTGTCCGGCCCTCCAGCCTGGGGCCTGTCCGG GCTCTTTGGGGTTCCAGAGTCCTCGAAGCGTGA | 2106 |
| | 2 | MTPP* | 2107 | ATGACACCACCCCGTGA | 2108 |
| | 3 | MVMRGAGARVVAGAGSSTNGSGAGQLVKAGGAGLGC GSARRTLGALARLSTGSGGLFLEPGVLLGSRAKGVLGT SSVGFPSSRVEALSAKQNR* | 2109 | ATGGTTGATGAGGGGTGCTGCGGCCAGGGTGGTGGCAGGAGCTGGCAGTCCACAAA TGGGCTGCTCTGGGCAGGCCAGTCTGGTGAAGGCGGGTGGTGGCCTGGGGCTGCGCA GTGCCGGCGGCACCTTGGGAGCCTTGGCGCTCTTGGCTCCAGGCTCTGAGGCGGCTCT TCTTGGAACCTGGGGTGCTCTTCCGCAGGGCGTAAGGCGGTACTGGGACTTCGT CTGTTGGGTTCCCTTCCTCCAGGGTAGAAGCTCTGCTGCAAAACAGATGA | 2110 |
| | 4 | MARVLGSW* | 2111 | ATGGCTCGGGTGCTGGGCAGCTGGTGA | 2112 |
| hsa-mir-4256 | 1 | MGDGQAGGAGRGCGHFPPVPnLQ* | 2113 | ATGGGTGACGCCAGGCTGGCGACGAGCGGGAAGGGAATGCGGGCACTTCCCTCCTGT CCCAACCTACAGTGA | 2114 |
| | 2 | MRALPSCPQPFTVTPALSTEDALISSILALL* | 2115 | ATGCGGGCACTTCCCTCCTGTCCCAACCTACAGTGACACCGGCGCTGAGCACGGAG GATGCCACTCATTTCCTCCATCCTTGCGCTTCGTGAAATGGTAGAGTCCCTGCCACC TGCGCTTCTGTGA | 2116 |
| | 3 | MHSFPPSLRFCEMGRVPATGSWRS* | 2117 | ATGCACTCATTTCCTCCATCCTTGCGCTTCGTGAAATGGTAGAGTCCCTGCCACC GGGAGTTGGAGGTCTTAA | 2118 |
| | 4 | MLSARAHRPCFF* | 2119 | ATGCTTTCAGCTAGAGCTCATGCCCCTGCTTCTCTGA | 2120 |
| | 1 | MAGERPR* | 2121 | ATGGCCGGTGAAAGGCCGTTGA | 2122 |
| | 2 | MNGNADL* | 2123 | ATGAATGGCAATGCTGACCTCTGA | 2124 |

Figure 1 (Continued)

| | | | | | |
|---|---|---|---|---|---|
| hsa-mir-3166 | 3 | MAMLTSEQLGGGNTEHFHTHSTGNQLTRRTTGPKMPR ALVTFSLFPYPKNSELHRKTVLHGQHTNNNGKHLLST RYMPEGL* | 2125 | ATGGCAATGCTGACCTCTGAGCAGCTTGGAGGTTGGGAACACTGAGCACTTTCACACC CATTCAACTGGTAATCAGTTAACAAGGAGGACAACTGGTCGAAAATGCCAAGGGC ACTGGTGACTTTTAGCCTCTTCCCATATCCTAAAAACTCAAAAATCAGAGCTGCACAGAAAGAC AGTTTTAACAATGGTCAGATTATTACAAATAATAATAATGGCAAACATTTATTGAG CACTCGCTATATGCCAGAGGGTTTATAA | 2126 |
| | 4 | MANIY* | 2127 | ATGGCAAACATTTATTGA | 2128 |
| | 1 | MSLASQ* | 2129 | ATGTCTTGGCTTCAGTGA | 2130 |
| | 2 | MVVGHGGATCPITPA* | 2131 | ATGGTGGTAGGTCACGtAGGCGCCACTGCCCATGCCTCCTAG | 2132 |
| | 3 | MLHSWEFPSPPTEPGRRR* | 2133 | ATGCTTCACTCCTGGGAATTCCCGtCACCTCTCACCTGAGCCCGGGCGCCCGCAGGTAG | 2134 |
| hsa-mir-320b-1 | 4 | MRVARGTGPGGQGWRVGRAARQVNQGFTPRLRGRRR DVQALPKAQLATHNLGSRRHRSSSFLLEIKTKPFGDLN LFTKWNPILHFTLG* | 2135 | ATGAGGGTGGCCCGGAGTGGCCGGGCAGGACTGGGCAGGACTCCGGGCGCCGGCGAGAT CAGCCCCGGCAAGTTAATCAGGGCTTCACACCCAGACTTCACGGGGCCGCCGGCGAGAT GTACAGGCCCTTCCCAAAGCCAGCTGGCCACCCATAACCTGGGAAGCCGGCGCA CAGAAGCTCGTCTTCCTCCTCTGAAACAAAACAAAAGCCCTTTGGAGACTTGAATCT GTTTCACGAAGTGAACCCCATATTGCACTTCACTCTGATAA | 2136 |
| | 1 | METLYRVPFLALECPNLKLKKPPWLHMPLAMTMYALV VVSYFLJJTRGHVYDYVTVEPPGVGSMTDEQGHQRPVAFL AYRVSGQYYYGRTWIQLPVYNGRFRHNPGPIECTKYP KTQ* | 2137 | ATGGAGACTTTGTACCGTGTCCCGTTCTTAGCCCTTGAATGTCCAACCTGAAGCTG AAGAAGCCGCCTGGCTGCACATGCCGTTGGCCATGACTATGTATGCTTGGTTGGTG GTGTCTTACTTCCTCATCACCAGAGAATCGTTATGGTTACGTTACGGTTGAACCGCCA GGTGTTGGCTCTATGATGACAATATTATGGAAGGACTTGATCCAGCTTGCTGTTTAC ATGAATGGGAGGTTTAGGTTCATAATCGTGGACCGATCGAATGCACCAAATATCCCAAA ACTCAATAG | 2138 |
| | 2 | MSQPEAEEAALAAHAVGHDYVCSGGGVLLPHHQRNRL* | 2139 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTATGA TGTTA | 2140 |
| | 3 | MLWWWCLTSSSPEESFMMLRLNRQVLAL* | 2141 | ATGCTCTGGTGGTGGTGGTGTCTTACTTCCTCATCACCAGAGGAATCGTTATGATGTTA CGGTTGAACCGCCAGGTGTTGGCTCTATGA | 2142 |
| hsa-mir-1283-1 | 4 | MNKGHRGQ* | 2143 | ATGAACAAGGGCATCAGAGGCCAGTAG | 2144 |
| | 1 | METLYRVPFLALECPNLKLKKPPWLHMPLAMTMYALV VVSYFLJJTRGHVYDYVTVEPPGVGSMTDEQGHQRPVAFL AYRVSGQYYYGRTWIQLPVYNGRFRHNPGPIECTKYP KTQ* | 2145 | ATGGAGACTTTGTACCGTGTCCCGTTCTTAGCCCTTGAATGTCCAACCTGAAGCTG AAGAAGCCGCCTGGCTGCACATGCCGTTGCCATGACTATGTATGCTCTGGTGGTG GTGTCTTACTTCCTCATCACTGATGAACAACGGCCATGCGTTATGCGGTTGAACCGCCA GGGTGTTGGCTCTATGATGACAATATTATGGAAGGACTTGATCCAGCTTGCTGTTTAC AATGGAGGGTTTAGGTTCATAATCGTGGACCGATCGAATGCACCAAATATCCCAAA ACTCAATAG | 2146 |
| hsa-mir-520-b | 2 | MSQPEAEEAALAAHAVGHDYVCSGGGVLLPHHQRNRL* | 2147 | ATGTCCCAACCTGAAGCTGAAGAAGCCGCCCTGGCTGCACATGCCGTTGGCCATGAC TATGTATGCTCTGGTGGTGGTGTCTTACTTCCTCATCACCAGAGGAATCGTTATGA | 2148 |
| | 3 | MLWWWCLTSSSPEESFMMLRLNRQVLAL* | 2149 | ATGCTCTGGTGGTGGTGTCTTACTTCCTCATCACCAGAGGAATCGTTATGATGTTA CGGTTGAACCGCCAGGTGTTGGCTCTATGA | 2150 |
| | 4 | MNKGHRGQ* | 2151 | ATGAACAAGGGCATCAGAGGCCAGTAG | 2152 |

Figure 1 (Continued)

| | | | | | |
|---|---|---|---|---|---|
| hsa-mir-1283-2 | 1 | METLYRVPFLALECPNLKLKKPPWLHMPLAMTMYALV VSYFLTRGIVYDVTVEPPGVGSMTDEQGHQRPVAFL AYRVSGQYYYGRTWIQLPVYMGRFHNPGPHECTKYP KTQ* | 2153 | ATGGAGACTTTGTACGTGCCGTGTCCGTTCTTAGCGCTGAATGTCCAACCTGAAGCTG AAGAAGCCGCCGCCTGGCTGCACATGCCGTTGGCCATGGCCATGACTATGTATGCCCTGGTG GTGTCTTACTTCCTCATCACGAGGAATCGTTTATGATGTTACGGTTGAACCGGCA GGTGTTGGCTCATGATGAACAAGGGCATCAGAGGCCATCAGAGGCCAGTAGCTTTCTTGGCC TACAGAGTAAGTGGACAATATTATTATGAAGGACTTGGATCCAGTTCCAGTCGTTTAC AATGGGAGGTTTAGGTTTCATAATCCTGGACCGATCGAATGCACCAAATATCCCAAA ACTCAATAG | 2154 |
| | 2 | MSQPEAEEAALAAHAVGHDYVCSGGGVLLPHHQRNRL* | 2155 | ATGTCCCAACCTGAAGCTGAAGAAGCCGCCCTGGCTGCACATGCCGTTGGCCATGAC TATGTATGCTCTGGTGGTGGTCTTACTTCCTCATCACCAGAGGAATCGTTTATGA | 2156 |
| | 3 | MLWWWCLTSSSPEESPMMLRLMRQVLAL* | 2157 | ATGCTCTGGTGGTGGTGGTGCTTACTTCCTCATCACCAGAGGAATCGTTTATGATGTTA CGGTTGAACCGCCAGGTGTTGGCTCTATGA | 2158 |
| | 4 | MNKGIRGQ* | 2159 | ATGAACAAGGGCATCAGAGGCCAGTAG | 2160 |
| | 1 | MSHHQCVLGLLPWLPNYLPHSHVLIIPKGSRITSLLCSAP SCGSHVTQSQRQDLGSYPKSRVYVCPHSAFLTSSLQPH WLPPSSWNISGTRQPQGLCTCCSLFRLCALREPQASLS HLLQVFPSFSFPPFSFFFSFFSLSFCCFFFFFFFLIHQAGVQW HDLGSLQSPPPGFK* | 2161 | ATGAGCCACCAACCAGTGTGTGCTTGGAATTGTTGCCATGGCTTCCAAACTATCTCCC CATTCTATCATTGTCTGTGCCATGTCCCATGCAAGGAGTCGGATCACCGTCTCTGCTCA GCACCTCTGCTGGCTCCCATGTCACCAGAGTCAAAGACAAGATCTGGACAGTGC CCTAAATCCGTGCTGCTGTCCTGGTTGTATGCCGCACTCTGCCATCTCCGCTCCAGC CACACTGCTTGCTGTCCTGTTCCCTCTCCTGAGACATATCAGGCACCAAGCCTGC TTTGCACTTGCTGTCCTGTTCCCTCTCCTGAGACTCTGTGCCTGAGAGAACACACAAGCCTG CTCTCTCACCTCGCATGATGCTTGGCTGCTGCAATCCTCCGCCTCCTGGGTTCAAGTA TGGAGTGCAGTGGCATGATGCTTGGCTGCTGCAATCCTCCGCCTCCTGGGTTCAAGTA A | 2162 |
| hsa-mir-3147 | 2 | MASKLSPFFYHCLLDTQRKSDHVSALLSTLLWLPCHPES KTRSWQCP* | 2163 | ATGGCTTCCAAACTATCTCCCATTCTATCATTGTCTTGATACCCAAAGGAAGTCG GATCACCGTCTCTGCTCTGCTCACCGTCCCTGTGGCTCCCATGTCACCAGAGTCA AAGACAAGATCTGGACAGTGCCCTAA | 2164 |
| | 3 | MSPRVKDKILAVSLNPVWLYAPTLPF* | 2165 | ATGTCACCCAGAGTCAAAGACAAGATCTGGACAGTGTCCCTAAATCCGTGTGGTTG TATGCCCCACTCTGCCTTTCTGA | 2166 |
| | 4 | MPPLCLSDIFPPATLASSLLEHRHTAASGPLHLLFPLPE TLCPERTTSLPLSPPPGLSLIFFESFFLFPSFFLLFFFFFF FPDTPGWSAVA* | 2167 | ATGCCCCCACTCTGCCTTTCTGACATTTCCCAGCCACACTGGCTTCCTCCTCC TCCTGGAACATATCAAGGCACACAGCCGCAGCTCAGGCTCCTCCAGGCCTCCTCCCTC TTCCTGAGACTCTGTGCCCTGAGAGAACACACAAGCCTCCCACTCGTGTGTCCTC GTCTTTCCCCTCATTTCTTTCTTTCTTTTTCTGATACACAGGCTGGAGTGCAGTGGCATGA GTTTTTTTTTTTTTTTTTTCTGATACACAGGCTGGAGTGCAGTGGCATGA | 2168 |
| hsa-mir-1268 | 1 | MVNGSRNSSPVRPSLSCSP* | 2169 | ATGGTGAACGGCAGCCGGAACTCATGCGCCGTGCGGCCTCGTTGAGCTGCAGCC GTAG | 2170 |
| | 2 | MMESRA* | 2171 | ATGATGGAGTCACGTGCGTGA | 2172 |
| | 3 | MHRSSRPHRNSTR* | 2173 | ATGCACCGGTCCAGCAGGCCGCATAGGAACTCCACGCGCTGA | 2174 |
| | 4 | MPVPSSGR* | 2175 | ATGCCCGTGCCCAGCAGCGGCGGGTGA | 2176 |
| hsa-mir-4316 | 1 | MRMPPHSLLQMVTKLPAQLTSAEPVTRPALLQFRMWY SHPVWGWNC* | 2177 | ATGAGGATGCCGCCGCACAGCCTACTCAAATGTCACTAAGTTGCCTGCACAGCTA ACATCTGCCGAGCCTGTGACACGACCAGCTTGCTTCAATTTCGAATGTGGTACTCC CACCCAGTTTGGGGTGGAACTGTTAG | 2178 |
| | 2 | MVEPAPGSLCQLGLPGHRPREALSKAGPVFIPCFLASVPP KALERPWSQRSG* | 2179 | ATGGTTGAACCTGCACCAGGGTCACTGTGCCAGCTGGGCCTGCCAGGCCACCGTCCC CGAGCTCTGTCCAAGGCAGGGCCAGTGTTCATACCTTGCTTCCTTGCCAGTGTCCCA CCCAAGGCCCTGGAAAGCCCTGGAGTCAGAGATCCGGCTAA | 2180 |

Figure 1 (Continued)

| | | | | | |
|---|---|---|---|---|---|
| hsa-mir-1302-1 | 3 | MPHTCCVTMGQRLSLSVPPGLL* | 2181 | ATGCCCCATACCTGCTGTGTGACTATGGGCCAGCGACTCAGCCTCTCTGTGCCTCCGGGTTGCTGTGA | 2182 |
| | 4 | MHRGP* | 2183 | ATGCACAGAGGCCTGA | 2184 |
| | 1 | MRVPVASYPHQHWILIICFQKPSQWEYMSLISYYFYKYSL* | 2185 | ATGAGAGTTCCAGTGGCTTCATATCCTCACCAGCATTGGATATTAATTATCTGTTTTCAAAAGCCATCTCAGTGGGAATATGTCACTTATCAGCTATGTGTTTACAAATATAGTCTTTAA | 2186 |
| hsa-mir-1302-1 | 2 | MCFTNIVFKSVACHHFLNSVFQSIEVLHFYKVKFHHLWFKKPSQWEYMSLISYYFYKYSL* | 2187 | ATGTGTTTTACAAATATAGTCTTTAAGTCTGTGGCTTGTCATCATTTTCTTAACAGTGTCTTTCAAAGTATAGAAGTTCTACATTTTATAAGTCAAATTTATCATATTTATGGTTTAAAAAGCCATCTCAGTGGGAATATGTCACTTATCAGCTATGTGTTTACAAATATAGTCTTTAA | 2188 |
| | 3 | MCFTNIVFKSVACHHFLNSVFQSIEVLHFYEVKFHHLWFMLPCLS* | 2189 | ATGTGTTTTACAAATATAGTCTTTAAGTCTGTGGCTTGTCATCATTTTCTTAACAGTGTCTTTCAAAGTATAGAAGTTCTACATTTTATGAGGTCATCAAATTTATCATATTTATGGTTTATGCTTTTTAGCTAA | 2190 |
| | 4 | MRSNLSLFYGLCFFVLAKKSLSNSRSQRPFSFY* | 2191 | ATGAGGTCAAATTTATCATTATTTATGGTTTATGCTTTTGTCTTAGCTAAGAAATCTTTGTCTAACTCAAGGTCACAAAGATTTTCTCCTTTTTTATTAG | 2192 |
| hsa-mir-1979 | 1 | MCAGKCCKIYFLYVGIKISLKVINLINVCKEERKVKMRVLGFLNI* | 2193 | ATGTGTGCTGGGAAATGCTGCAAATATCTGTTTCTATATGGGATCAAAATAAGTTTGAAAGTCATAAACCTAATAAACCTAATAAATGTATGCAAAGAAGAGGAAGGTCAAGAACAGAGTGCTAGGGTTTC | 2194 |
| | 2 | MLQNFFHCRDQNKFESHKPNKCMQRREEGEQEQSARVSKYLSLCGS* | 2195 | ATGCTGCAAAATATATTTTTCATGTAGGGATCAAAATAAGTTTGAAAGTCATAAACCTAATAATATTGAGTTTGGGAAGTGA | 2196 |
| | 3 | MYAKKRGRSRTEC* | 2197 | ATGTATGCAAAGAAGAGGAAGGTCAAGACAGAGTGCTAG | 2198 |
| | 4 | MAKKNQPRGRKRTKKPSPGNQVKKCSMKESMVRRVNCVSNYYCI* | 2199 | ATGGCAAAGAAGAATCAGCCAGGAGTAGGAAGGAAGAGAACCAAGAACCAAGAACCCTGGCAACCAGGTTAAAGAGTGTGTTCTATGAAGGAAAGCATGGTCCGTAGGGTCAACTGTGTCCAATTCACTACTGTATTTAG | 2200 |
| | 1 | MHSR* | 2201 | ATGCATAATCTCAGATAA | 2202 |
| | 2 | MVSIW* | 2203 | ATGGTTTCTATATGGTAA | 2204 |
| hsa-mir-2052 | 3 | MYKCRVSLCLYMSFPSVFDFKQPILRHLDLTNYSCGHYCVWSLVSYGN* | 2205 | ATGTTAAAATGCCGTGTAAGTCTTGTTGTTATAACATTTCTTTCCAAGTGTTTTCGATTTAAACAACCCATACTACGAATAATACTGATTAACTATAGTTGTGAATATATTGTGTTTGGTCTTTGGTTAGCTATGGTAACTAA | 2206 |
| | 4 | MPCKSLFY* | 2207 | ATGCCCTGCAAGTCTACTGTATTAG | 2208 |
| | 1 | MATYVAHLQS* | 2209 | ATGGCAACTTATGTTGCACACCTGCAATCCTGA | 2210 |
| | 2 | MLHTCNFESLGIQKEPFPE* | 2211 | ATGTTGCACACCTGCAATCCTGAGTTCCTGAGGGATACAGAAGGAGCCCCATTTCCTGAGTGA | 2212 |
| hsa-mir-4311 | 3 | SMHLI* | 2213 | ATGCACATTCTAATCTAA | 2214 |
| | 4 | MILLKEKEKKDTQGPYNSSDCIGSI* | 2215 | ATGATTCTTTGAAGGAGAAAAGAAGGACACCAAGGCCGTATAATAGTGGGGACTGTATAGGAAGCATATAG | 2216 |
| hsa-mir-3118-6 | 1 | MQGELKLCHPGRKPSDLASFGASLGDSLQLSFNTFQQFCVLYYHKNSPCIFYPLSNRNLNMHME* | 2217 | CTTTGGCGCCGAGCTGGTCGTCAGTCGTCAGCCCAGGAAAACCAAGGAAACCCTCCGACTTGCCAGGCAAAGGCAAAGCAAAGGACAACCTGCAGCCTCAGCTCAACCTTTCAACAGTCTGTGTTCTCTATTCATCACAAGAATTCATCTGTATTCTATCCTTTATATCTTAAAATAGGAATTTAAATATGCATATGGAGTGA | 2218 |
| | 2 | MCLFCLMYNFLRSKJMTLLQF* | 2219 | ATGTGTCTTTTTGTTAATGTATAATTTCTAAGAAGTAAATTATGACTCTACTGCAAATATAA | 2220 |
| | 3 | MFFNSISDEGSSNRFKSLQGTLKELYSQC* | 2221 | ATGTTTTTCAACTCAATAAGCGATGAGGGTTCCAGTAACAGGTTCAAATCATTGCAAGGAACATTAAAGGAGCTTTACAGCCAATGTTAA | 2222 |

Figure 1 (Continued)

| | | | | | |
|---|---|---|---|---|---|
| | 4 | MRVPVTGSNHCKEH* | 2223 | ATGAGGGTTCCAGTAACAGGTTCAAATCATTGCAAGGAACATTAA | 2224 |
| hsa-mir-3118-4 | 1 | MLHGTSWSAIFLVTLRLHQID* | 2225 | ATGTTAATAGGTACCTCTTGGAGTGCCATTTTCCTTGTAACCCTTAGATTAATTCAGATTGACTGA | 2226 |
| | 2 | MLLCI* | 2227 | ATGCTTGCTTTGCATCTAG | 2228 |
| | 3 | MFRK* | 2229 | ATGTTTAGAAAATAG | 2230 |
| | 4 | MSPLLSASALGKFPRTSLLCLLKYEMKINVAQQARESLL* | 2231 | ATGTCACCACTTGTCAGCATCTGCATTGGRCAAATTTCTAGGACCTCCCTCTGTGTCTTTTAAAATATGAAAACAAAATCAATGTAGCGCAGCAAGCCAGGGAAAGTCTGCTTTGA | 2232 |
| hsa-mir-297 | 1 | MPHLARRVLRPRSRADCYHSCLRSNCKAAARLGRGRPPLPRLA* | 2233 | AGCTGTCTGAGATCAAACTGCAAGGCGGCAGGAGACGCAGCGAGACTGGGGAGGGGGCGCCACCATTGCCCAGGCTTGCTTAG | 2234 |
| | 2 | MSLSDSFEESSGSPSTQLEI* | 2235 | ATGTCCCTGTCTGACAGCTTTGAAGAGAGCAGCAGTGGTTCTCCCAGCACACAGCTGGAGATCTGA | 2236 |
| | 3 | MDRLPPQVGF* | 2237 | ATGGACAGACTGCCTCCCCAAGTGGGTCCTGA | 2238 |
| | 4 | MCTSPSSKTKSR* | 2239 | ATGTGCACATCACCATCATCAAGCAAGACCAAAAGTAGATAA | 2240 |
| hsa-mir-1471 | 1 | MQHSRRHVGSREQTLRQWTCWQLTLELLNLQNSEKINFCSL* | 2241 | ATGCAGCATTCAAGGCGCCATGTTGGAAGGCAGAGAGCAGACCCTCACCAGACAATGGACTTGCTGGCAACTTCTCAGAACTCTGAGAAAATAATTTCTGTTCTTTATAA | 2242 |
| | 2 | MLEAESRPSPDNGLAGNSLLNFSTSRTLRK* | 2243 | CTTGAACTTCTCAACCTGCAACCAGCAGAGAGCAGACCAGAATGGACTGTGCTGGCAACTCACT | 2244 |
| | 3 | MDLLATHS* | 2245 | ATGGACTTGCTGGCAACTCACTTGA | 2246 |
| | 4 | MASSWTYG* | 2247 | ATGGCCTCCTCCTGGACGTACGGTGA | 2248 |
| hsa-mir-514b | 1 | MPATWLPIKPEVL* | 2249 | ATGCCAGCAACATGGCTTCCTATAAGCCTGAGGTCCTGTGA | 2250 |
| | 2 | MASYKA* | 2251 | ATGGCTTCCTATAAGCCTGA | 2252 |
| | 3 | MQKWPNTKNWYQ* | 2253 | ATGCAAAAATGGCCTAATACAAAAATTGGTACCAGTAG | 2254 |
| | 4 | MRKQLWNQVMSRVWKSLEGSEADMKIKESLDFLQIDC* | 2255 | ATGAGGAAGCAACTTGGAACCAGGTAATGAGCAGGTAAGGAAGATAAAGGAAGTTTAGATTTCTTCAAGACTGCTGA | 2256 |
| hsa-mir-513a-1 | 1 | MPATWLPIKPEVL* | 2257 | ATGCCAGCAGCAACATGGCTTCCTATAAAGCCTGAGGTCCTGTGA | 2258 |
| | 2 | MASYKA* | 2259 | ATGGCTTCCTATAAAGCCTGA | 2260 |
| | 3 | MQKWPNTKNWYQ* | 2261 | ATGCAAAAATGGCCTAATACAAAAATTGGTACCAGTAG | 2262 |
| | 4 | MRKQLWNQVMSRVWKSLEGSEADMKIKESLDFLQDC* | 2263 | ATGAGGAAGCAACTTGGAACCAGGTAATGAGCAGGTAAAGGAAGATAAAGGAAAGTTTAGATTTCTTCAAGACTGCTGA | 2264 |
| hsa-mir-513a-2 | 1 | MPATWLPIKPEVL* | 2265 | ATGCCAGCAGCAACATGGCCTTCCTATAAAGCCTGAGGTCCTGTGA | 2266 |
| | 2 | MASYKA* | 2267 | ATGGCTTCCTATAAAGCCTGA | 2268 |
| | 3 | MQKWPNTKNWYQ* | 2269 | ATGCAAAAATGGCCTAATACAAAAATTGGTACCAGTAG | 2270 |
| | 4 | MRKQLWNQVMSRVWKSLEGSEADMKIKESLDFLQDC* | 2271 | ATGAGGAAGCAACTTGGAACCAGGTAATGAGCAGGTAAAGGAAGATAAAGGAAGTTTAGATTTCTTCAAGACTGCTGA | 2272 |
| hsa-mir-513b | 1 | MPATWLPIKPEVL* | 2273 | ATGCCAGCAGCAACATGGCTTCCTATAAAGCCTGAGGTCCTGTGA | 2274 |
| | 2 | MASYKA* | 2275 | ATGGCTTCCTATAAAGCCTGA | 2276 |
| | 3 | MQKWPNTKNWYQ* | 2277 | ATGCAAAAATGGCCTAATACAAAAATTGGTACCAGTAG | 2278 |
| | 4 | MRKQLWNQVMSRVWKSLEGSEADMKIKESLDFLQDC* | 2279 | ATGAGGAAGCAACTTGGAACCAGGTAATGAGCAGGTAAAGGAAGATAAAGGAAGTTTAGATTTCTTCAAGACTGCTGA | 2280 |
| hsa-mir-513c | 1 | MPATWLPIKPEVL* | 2281 | ATGCCAGCAGCAACATGGCTTCCTATAAAGCCTGTGA | 2282 |
| | 2 | MASYKA* | 2283 | ATGGCTTCCTATAAAGCCTGA | 2284 |

Figure 1 (Continued)

| | | | | | |
|---|---|---|---|---|---|
| hsa-mir-513c | 3 | MQKWPNTKNWYQ* | 2285 | ATGCAAAAATGGCCTAATACAAAAAATTGGTACCAGTAG | 2285 |
| | 4 | MRKQLWNQVMSRVWKSLEGSEADMKIKESLDFLQDC* | 2287 | ATGAGGAAGCAACTTGGAACCAGGTAATGAGCAGAGTTTGGAAGAGTTTGGAGGG GTCAGAAGCAGACATGAAGATAAAGGAAAGTTTAGATTTTCTTCAAGACTGCTGA | 2288 |
| hsa-mir-4277 | 1 | MGGGEGRAEWESSRPWGVGRGGW* | 2289 | ATGGGTCAAGGCCGTGAGGGTGGAGAAGGAGGGCAGAGTGGAGTCAAGGCCAT GGGGGGTGGGAGGGAGGGGTGGTGA | 2290 |
| | 2 | MGGGEGRVVRPGVRAMGPVPEARNLDLS* | 2291 | ATGGGGGGTGGGAGGCAAGGAGTGGTGAGGCCATGGGGTCAGGGCCATGGGACCAG TGCCCGAGGCAAGGAACCTGGATTGTCCTGA | 2292 |
| | 3 | MGAPAEPSEGVYSPAWVSHHPSGCCRMRWAGSGRR* | 2293 | ATGGGTGCCCCTGCAGAGCCCAGCGAGGAGTGGTGAGTCCTGCCTGGGTTCCA CCATCCCTCCGGCTGCTGCAGGATGAGATGGGCAGGTAGCGGCAGGAGGTGA | 2294 |
| | 4 | MKAGRGAQLVKGEGPMAAGWGWGAVIDYLWSRLQLL S* | 2295 | ATGAAGGCTGGAAGGGGTGCTCAGCTGGTTAAGGAGGAGGGTCCCATGGCAGCTGG CTGGGGGTGGGGGCTGTGATAGATTATCTGTGGTCCAGACTGCAGCTGCTCTCTG A | 2296 |
| | 1 | MPRLMKFMVNCNTLMEGKKSPCFNMFQTFHLTKVFNS VLIL* | 2297 | ATGTTCAGGTTAAGGAAATTATGGTTAACACACTCGATGGAGGGAAAGAAA TCTTTTGTTGTTCAACATGTTCAAACCTTTCACCTTACTAAAGTGTTAACTCTGTCCT CATACTTTAG | 2298 |
| hsa-mir-320c-2 | 2 | MNKIKYFFHKILGTLSPIEVGGSCNCTTDLECVKDHSRP CWEENWE* | 2299 | ATGAACAAAATTAAATATTTCTTCACAAGATCTAGTACTTTAAGTCCATTGAA GTTGGTGAGCTGTAATTGCACTACAGACCTAGAATGTGTTAAAGACCATTCCAGG CCATGCTGGGAAAATTGGGAATGA | 2300 |
| | 3 | MLGKLGMNVSEVSWHLCPHCYFIVLIN* | 2301 | ATGCTGGAAAATTGGGAATGTCAGTGAGGTTCATGGCATCTTTGTTTCAT TGTTATTTATTGTATTAATTAA | 2302 |
| | 4 | MSVRPHGIFYFIVILY* | 2303 | ATGTCAGTGAGGTTTCATGGCATCTTTGTTTCATTGTATTTTATTGTATTAA | 2304 |
| | 1 | MKKQLPASPQRPVHISALQFS* | 2305 | ATGAAAAAACAACTCCTGCCAGCCCCCAGAGACCTGTTATCATAATTTCTGCCTTG CAATTTTCCTAA | 2306 |
| hsa-mir-4305 | 2 | MNRSTMF* | 2307 | ATGAACAGAAGCACAATGTTCTAA | 2308 |
| | 3 | MLFQFYVPFLTL* | 2309 | ATGCTTATTTTCAGTTTATGTTCCTTTCCTAACATTATAG | 2310 |
| | 4 | MFLS* | 2311 | ATGTTCCTTTCCTAA | 2312 |
| | 1 | MTLGPTILEATRISTAKAITQEMERNSWPGAVAHTCSPST LGGQGGQITRSGDRDHPG* | 2313 | ATGACCTTGGGACCCACTCTGGAAGCCACGCGCATTTCCACTGCCAAAGCAATAACA CAGGAGATGGAAAGAAATTCTTGGCCAGGCGCGGTGGCCCACGCTGTAGTCCCAG CACTTTGGGAGGCCAAGGCGGGCAGATCACGAGGTCAGGAGATCGAGACCATCCTG GCTAG | 2314 |
| | 2 | MKMWQRCGGVSVWQRGGVSVWWCVRVAECLCGAM SMWWCVHVSAW* | 2315 | ATGAAAATGTGGCAACGATGTGGTGGTGTCTCTGTGTGGCAGCGTGTGTGGTGTGTCT GTGTGGCAGTGTCTCGTGTGCAGTGTCTATGTCCATGTGCTATGTCCATGGTTGG TGTGTTCATGTGCATCTGCATGGTGA | 2316 |
| hsa-mir-3118-5 | 3 | MWWCLCVAAWCVCVVPCGRVSVWCVHVVCS CICMVMSPCDSVCIHVTMSVCPCVHMAVSVWCLTV WRCVHVTVWRCVCVCWQCPCGSVFVCSCDGVSM* | 2317 | ATGTGGTGGTGTCTCTGTGTGGCAGCGTGGTGTGTCTGTGTGGTGGTGTGTCCG TGTGGCAGTGTCTGTGTGTCCGTGTGGACAGTGTCTGTGGACAGTGTCATGTCGC ATGTGGTGATCTGTGTGGGAGGTCTGAGTGTCGACAATGTCTGTGGTCCT TGTGTCCACATGGCAGTGTCTGTGGACAGTGTCTGAGGGTGTGTCCAT GTGACAGTGTGGCGGTGTGCGTGTGCTGGCAGTGTCCATGTGGACAGTGTTTGTG GTTCCTGTGTGATGGTGTGCATGTGA | 2318 |
| | 4 | MYLHGDVSY* | 2319 | ATGTATCTGCATGGTGATGTCTCGTGTGA | 2320 |
| | 1 | MLRT* | 2321 | ATGCTAAGAACGTGA | 2322 |
| | 2 | MRIDSQYCPRSTLR* | 2323 | ATGAGAGATTCCAAGTATGTCCACGTCAACCTTCGGTAA | 2324 |
| | 3 | MSTVNLAVSLCARRNPG* | 2325 | ATGTCCACGTTCAACTTGCGGTAAGCTTGTGTCTCGGAGGAATCCAGGGTAA | 2326 |

Figure 1 (Continued)

| | | | | |
|---|---|---|---|---|
| hsa-mir-3141 | 4 | MGQAESKYASYLSPIKHLRRGGVKASTENLIMLFQTIEQ FCTWFPEQGTLYLKDWEKIGKELKQASREGKHPLTVW NDWAHKATLEPFQIEEDSVSVSDAPESCVIDCEEEAGTE FKKGMESSHCKNVAESVMARSMQNC* | 2327 | ATGGGGCAAGCTGAAAGTAAATAGCTCTTATCTCAGCTTCATTAAAATTATCTTA AGAAGAGGGGAGTTAAAGCTTCCAGAACCAGGAACTTCTACAGAAAAATCTAATTATGCTATTTCAAACAATA GAACAATTCTGCCCATGGTTCCCATGGTTCCAGAACCAGGAACTTTATATTTAAAAGATTGGGAA AAAATTGGCAAGAATTAAAACAAGCAAGTAGGGAAGGTAAAATCATCCACTTAC AGTATGGAATGACTGGGCCATTATTAAAGCAACTTTAGAAGCTTTCAAATAGAAGA AGATAGTTGTTTCAGTTTCTGATCCCTGAGAGCTGTGTAATAGATTGTGAAGAAGA GGCAGGAACAGAGTTCAAGAAGGAATGGAAAGTTCACATTGTAAAAATGTAGCAG AGTCTGTAATGCTCGGTCAATGCAAAATTGTTGA | 2328 |
| hsa-mir-4266 | 1 | MPPSRQRWECLFCRHLQAAVPKVSCSRQDTNTRIDGE PLLSHL* | 2329 | ATGCCCCCATCTAGGCAGAGATGGAGTGCTCTTCTGCAGACACCTACAAGCAGCT GCTGTCCCTAAAGTGAGCTGTTCCAGGCAGGATACAAACACCAGGATCGATGGAGA GCCACTCCTTCCCATCTGTAA | 2330 |
| | 2 | MGVPLLQTPTSSCCP* | 2331 | ATGGGAGTGCCTCTTCTGCAGACACTCAAGCAGCTGCTGTCCCTAA | 2332 |
| | 3 | MESHSPICNPS* | 2333 | ATGGAGAGCCACTCCTTTCCCATCTGTAATCCAGTTAG | 2334 |
| | 4 | MFSGKL* | 2335 | ATGTTCTCAGGGAAGTTATGA | 2336 |
| | 1 | MHDSK | 2337 | ATGCATGATTCAAAATGA | 2338 |
| hsa-mir-4280 | 2 | MIQNDHFIWMKIKLQRGKLRRGETS* | 2339 | ATGATTCAAAATGATCACATTTCATCTGGATGAAGATTAAATTGCAGAGGGGCAAA CTTAGAAGAGGAGACAAGTTAG | 2340 |
| | 3 | MITESSCG* | 2341 | ATGATCACATTTCATCTGGATGA | 2342 |
| | 4 | MVVRLAW* | 2343 | ATGGTGGTTAGACATTAGCATGGTAG | 2344 |
| | 1 | MCLTPFLS* | 2345 | ATGTGTTTGACTCCTTTCTGTCATGA | 2346 |
| hsa-mir-548g | 2 | MIYSFLRPQPSGTVSQLNLFSL* | 2347 | ATGATTGTAAGTTCCTGAGGCCTCCCCAGCCATCCGAACTGTAAGTCAATTAAAC CTCTTTTCTTTATAA | 2348 |
| | 3 | MLYMSLI* | 2349 | ATGCTATACATGTCACTCATTTAA | 2350 |
| | 4 | MYIQCFLLYAQNFALLLKSKFRIFIHHLKKIPHTH* | 2351 | ATGTATATATAATTCAATGCTTTTTATCATGCACAGAATTTGCACTATTGCTAAAAT CTAAGTTTAGAATATTTCATCCATGTTCCAGAACAAAGATACCTCATACCCATTAG | 2352 |
| hsa-mir-1302-10 | 1 | MLARPGWRRGAGAERRAAPAQAQRHMLPRPGVEAWR RREEAHRAGAGAETHASASRGGGVAQAQRRKPTGGG WGGVCCRSKVARRRAGAGGGWRRARAEIHVTVARRR DG* | 2353 | ATGCTAGCGCGTCCGGGTGAGGCGTGGCGCAGGGGCGTGGCGCAGGAGGGCGCCGCGCC GCGCAGGCGCAGAGAGGCGCACCGGCGTCCAGGGTGGAGGCGTGGCGCAGGC AGAGAGGCGCAGGCGTGGCCAGGCGCAGGCGCAGAGACACATGCTAGCGCGTCCAGG GGTGGAGGCGTGGCGCAGGAGGCGCAGAGACGCCAAGCGCGACGCCGGGCGCGGTGGCGGG GCGTGTGTGCCACGCGGAGCAAGTGCACGACGCCGGTGGCGCGGGGGCGGGTG GCGGTGTGCCACGCGGAGCAAGTGCACGACGCCGGTGGCGCGGGGGCGGGTG | 2354 |
| hsa-mir-1302-10 | 2 | MLARPGVEAWRRPRDASLRAGVGGACVAGAKSHGAG LGRGEGGAVHAQKLTSRWRGAETGRTSVIRKAGHDRPL LAAGHYRTRLLTVLCQGAPCWRLGQLQGSLA* | 2355 | ATGCTAGCGCGTCCAGGGTTGGAGCGTGGCGCAGGGGCGTGGCGCAAGCGCTACG GCGGGGGTTGGGGGGGCGTGTGTGCAGGAGCAAAGTGCACGCGACGCGTG GGCAGAGACGGGTTAGAAGCGTGCAGAGCGCAGAAACTGCCAGAAACTGGCGCG CTTGCAGCGCGGCACTACAGACCGCCGTTGCTCACGTGCTGTGCCAGGCGCCCCTTG CTTGCAGCGCGGCACTACAGACCGCCGTTGCTCACGTGCTGTGCCAGGCGCCCTCTCTTCTAG TGCTGGCGACTAGGGCAACTGCAGGCGCCTCTCTTTCTAG | 2356 |
| | 3 | MLFGLSRLLNMGFLGLKVKNKYV* | 2357 | ATGCTGTTTGGTCTCAGTAGACTCCTAAATATGGGATTCCTGGGTTTAAAGTAAAA AATAAATATGTTTAA | 2358 |
| | 4 | MFNL* | 2359 | ATGTTTAATTTGTGA | 2360 |
| | 1 | MYIRCPDSLTH* | 2361 | ATGTACATTCGGTGTCCAGATTCATTAACTCATTAA | 2362 |
| hsa-mir-3197 | 2 | MATF* | 2363 | ATGCAACATTCTAA | 2364 |
| | 3 | MLDPFFFTSF* | 2365 | ATGCTTGATCCCTTCCTTTCTTTCTTTACCAGCTTTTAA | 2366 |
| | 4 | MSWAS* | 2367 | ATGAGTTGGGCTTCTAG | 2368 |

Figure 1 (Continued)

| | | | | |
|---|---|---|---|---|
| hsa-mir-1197 | 1 | MPNPGSMMTTGGV* | 2369 | ATGCCAATCTGGATCGATGATGACCACTGGTGGCGTATGA | 2370 |
| | 2 | MSHT* | 2371 | ATGAGTCATACATGA | 2372 |
| hsa-mir-1197 | 3 | MMNMCLEL* | 2373 | ATGATGAATATGTGTCTGGAACTCTGA | 2374 |
| | 4 | MHSYVIRMIGSMKE* | 2375 | ATGCATTCTTATGTTATTATTATGATTGGTCAATGAAAGAATGA | 2376 |
| hsa-mir-1193 | 1 | MPNPGSMMTTGGV* | 2377 | ATGCCCAATCTGGATCGATGATGACCACTGGTGGCGTATGA | 2378 |
| | 2 | MSHT* | 2379 | ATGAGTCATACATGA | 2380 |
| | 3 | MMNMCLEL* | 2381 | ATGATGAATATGTGTCTGGAACTCTGA | 2382 |
| | 4 | MHSYVIRMIGSMKE* | 2383 | ATGCATTCTTATGTTATTATTATGATTGGTCAATGAAAGAATGA | 2384 |
| hsa-mir-1185-1 | 1 | MPNPGSMMTTGGV* | 2385 | ATGCCCAATCTGGATCGATGATGACCACTGGTGGCGTATGA | 2386 |
| | 2 | MSHT* | 2387 | ATGAGTCATACATGA | 2388 |
| | 3 | MMNMCLEL* | 2389 | ATGATGAATATGTGTCTGGAACTCTGA | 2390 |
| | 4 | MHSYVIRMIGSMKE* | 2391 | ATGCATTCTTATGTTATTATTATGATTGGTCAATGAAAGAATGA | 2392 |
| hsa-mir-1185-2 | 1 | MPNPGSMMTTGGV* | 2393 | ATGCCAATCTGGATCGATGATGACCACTGGTGGCGTATGA | 2394 |
| | 2 | MSHT* | 2395 | ATGAGTCATACATGA | 2396 |
| | 3 | MMNMCLEL* | 2397 | ATGATGAATATGTGTCTGGAACTCTGA | 2398 |
| | 4 | MHSYVIRMIGSMKE* | 2399 | ATGCATTCTTATGTTATTATTATGATTGGTCAATGAAAGAATGA | 2400 |
| hsa-mir-4278 | 1 | MQNENWSLLFKNYEEFQVSKD* | 2401 | ATGCAAAATGAAAATTGGAGCCTCTTATTCAAAAATTATGAAGAATTCAAGTTAGCAAAGACTAA | 2402 |
| | 2 | MKIGASYSKIMKNFKLAKTKCGLGPLNRSPK* | 2403 | ATGAAAATTGGAGCCTCTTATTCAAAAATTATGAAGAATTCAAGTTAGCAAAGACTAAATGTGGCTTGGCCCTTTGAACAGGAGCCCTAA | 2404 |
| | 3 | MWLGPFEQEP* | 2405 | ATGTGGCTTGGGCCCTTTGAACAGGAGCCCTAA | 2406 |
| | 4 | MKTEVQFISGHRALPSLPAKMRGPHGRTAPQREDPHVLRHLKQDKYVHVRITGSMSH* | 2407 | ATGAAGACAGAAGTGCAGTTCATCAGCGGCACAGGGCCCTTCCTTCCCTTCCAGCCAAAATGAGGGGCCCAGAATCGGCAGAACAGTCTCAAAGAGAAGATCCCATGTCCTGAGACAAATATGTTCATGTCCGATTACTGGGTCTATGTCTCATTGA | 2408 |
| | 1 | MTENHYH* | 2409 | ATGACAGAAAATCACTACTCATTATGA | 2410 |
| hsa-mir-3116-2 | 2 | MLKILCESYFPFVAIVRILRYYRACMFKKHEEFFWLSPNTDKSEQEGGHI* | 2411 | ATGCTTAAAAATTCTTTGCGAGTCCTATTTGCCATTGTGGCTATTGTAGGATTCTGCGTTACTACCGGTGCATGCATGTTCAAGAAGCATGAGGAATTTTTTGGCTTTCCCCAAATACAGACAAATCAGAGCAACAAGAGAAGGGGTCACATTGA | 2412 |
| | 3 | MHVQEA* | 2413 | ATGCATGTTCAAGAAGCATGA | 2414 |
| | 4 | MRNFGPQIQTNQSNKKGVTFDY* | 2415 | ATGAGGAATTTTTTGGCTTTCCCCAAATACAGACAAATCAGAGCAACAAGAAGGG GGTCACATTGATTATTAA | 2416 |
| hsa-mir-1324 | 1 | MELLGFCPHHHEERGGCLWYPCFYCNL* | 2417 | ATGGAGCTACTTGGCTTTTGCTTTCATCACACATGAGGAAAAGAGGATGTGCTTATGGTACCCCTGTTTTTACTGCAACCTGTAA | 2418 |
| | 2 | MVPLFLLQPVIDEMLPVAESKTLN* | 2419 | ATGTACCCCTGTTTTACTGCAACTGTAACTGAAATAGATGAGAACCTCCTGTTGCAGAGAGCAAAACACTGAACTAA | 2420 |
| | 3 | MRTSLLQRAKH* | 2421 | ATGAGAACCTCCCGTTGCAGAGAGCAAAACACTGA | 2422 |
| | 4 | MQFLASLHSDRDNCLGSCSLYERQLTKSQLLRYLNNFIL* | 2423 | ATGCAAAACGTTGCAAGTTGCACAGTGACAGAGACAAATTGTTGGGCAGCTGTCTCTATAATGAAAGGCAATTGACCAAAAGTCAGTTACTGAGATATCTCAATAATTTCATTTTATTTTAA | 2424 |
| hsa-mir-2117 | 1 | MRPHCMNVPSLN* | 2425 | ATGAGATTCCATTGTATGAATGTACCATCATTAATTAA | 2426 |
| | 2 | MYHH* | 2427 | ATGTACCATCATTAA | 2428 |
| | 3 | MVLLAYIPGTLGEAFP* | 2429 | ATGTCCTCCTTGCATATATATTTTTGGTACACTTGGGAAGKYTTCCCATAA | 2430 |
| | 4 | MYLKLS* | 2431 | ATGTATTTAAGTGTCATAG | 2432 |

Figure 1 (Continued)

| | | | | | |
|---|---|---|---|---|---|
| hsa-mir-2114 | 1 | MEHLPGTTPTVC* | 2433 | ATGGAGCACCTACCAGGTACCACCTACGTGTCTAG | 2434 |
| | 2 | MGQRVQGCAMPCALM* | 2435 | ATGGGACAGAGGGTACAGGGTTGTCCATGCCTGTGCTCTGATGTGA | 2436 |
| | 3 | MGVFGHCSR* | 2437 | ATGGGTGTATTTGGCCATTGCAAAAGATAA | 2438 |
| | 4 | MHRTALSTTGPAFNSKYSHSQVCVPSSLIWCD* | 2439 | ATGCATAGAACAGGTTTGCCCTCGAGTTTAATATGGTGTGATTGA | 2440 |
| hsa-mir-3119-1 | 1 | MLASLVWNS* | 2441 | ATGTTGGCCAGCCTGGTCTGGAACTCCTGA | 2442 |
| | 2 | MGLQV* | 2443 | ATGGGATTACAGGTGTGA | 2444 |
| | 3 | MPCLYL* | 2445 | ATGCCATGTTTATACTTATGA | 2446 |
| | 4 | MFILMNPYKLVKHY* | 2447 | ATGTTTATACTTATGAATCCATATAAACTAGTAAAACACTATTAG | 2448 |
| hsa-let-7a-1 | 1 | MKHR* | 2449 | ATGAAGCACAGATAG | 2450 |
| | 2 | MYYICTFANSPRSFR* | 2451 | ATGTATGTTCATATGCACTTTTGCAAACTCACCAAGAAGTTTCGATGA | 2452 |
| | 3 | MSYALLQTHQEVSDEHMKKMSEGLIVL* | 2453 | ATGTCATATGCACTTTTGCAAACTCACCAAGAAGTTTCGATGAACATATGAAGAAA | 2454 |
| | 4 | MHFCKLTKKFPMNI* | 2455 | ATGTCAGAAGGGCTCATAGTGCTATAA | 2456 |
| hsa-let-7a-2 | 1 | MSPGKTRKPV* | 2457 | ATGAGCCCAGGCAAGACCAGAACCTGTGTAA | 2458 |
| | 2 | MHLLYATEAL* | 2459 | ATGCATTTATTGTATGCCACTGAGGCTTTGTAG | 2460 |
| | 3 | MPLRLCSVYYAAFFCDNAAFFVTTWCLLCSIFVTMDT* | 2461 | ATGCCACTGAGGCTTTGTAGTGTTTATTATGCAGCATTTTTGTGACAATGCTGCATTTTTTGTGACAATTTTGGTGTTTATTATGCAGCATTTTTGTGACAATGGACACCTGA | 2462 |
| | 4 | MQHFFVTMLHFL* | 2463 | ATGCAGCATTTTTTGTGACAATGCTGCATTTTGTGA | 2464 |
| hsa-let-7a-3 | 1 | MHLPFQ* | 2465 | ATGCACCTGCCTTCCAGTAG | 2466 |
| | 2 | MLGVGRGGQLCPWPGGEGAGGPCGSPVGALWGWPHI GSCYPCNKIPWRAVCLLEEGRRNHHVKQRMAFDECVL FLGVDAGPLGSMGWCRVDPTVACVRHVAVGQFLAGG DPSPDTCRAPSQTLEAWEGLWMPPYTPPRLLSLWFLDR TFRHHETKFAQALPSPWENPAGHGKEECPPARPDQSR PTCQARPASSWGTREPQASRQEKPPTAEGLVSGGELL GGVTTGRGSGWGIFNDVVASGHRPLPPPHLSCPPHLVTQ TVA* | 2467 | ATGCTGGGTGTTGGCCGTGGAGGACAATTGTGCCCTGGCCAGGCGGGAGGGGGC AGGTGGACCCTGTGGGAGCCCTGTGGGAGCCCTGTGGGGAGCCAGTGTGGGGACAG CCTGCTATCCTTGCAACAAGATCCCTGGGAGCCCTGTGGGAGCCAGTGTGCTCTAGAAGAGCA GGAGAAATCACGCAGGTCCTCTGGCAGCCATGGGCGTTTGAGAGTGCGTTGAGAGTGCTTTTTCTAG GGTCGACGCAGGTCCTCTGGCAGCCATGGGCGTTGAGAGTGCGTGGGACCCCACGGTG CCTGTGTTCGCCGGGCACCCAGCCAAACCTTGAGGCCTGGGAGAGGTCTGGATGCC GACACCTGCCGGGGCACCCAGCCAAACCTTGAGGCCTGGGAAGGTCTGGATGCC ACCCTACACCCGCCGGGCACCCAGCCAAACCTTGAGGCCTGGGAAGGTCTGGATGCC CAGGGCCAGGCCGCATCCTGCCGGGACCACCAGCGGGAGCCCAGGCTGCGCCACATGC CCAGGGCCAGGCCGCATCCTGCCGGGACCACCAGCGGGAGCCCAGGCTGCGCCACATGC AAAGCCCCCAGCCCCTGCCACCGCAGAAGGGCTGGTTCTGTGGGGAGTTGCTGCTGGGTGGG TGACCGCCCCTGCCACCGCCAGGTTCAGCCTGGGTATTTTTAATGATTAGTTGCATCTGTC ACCGGCCCGCCCTGCCACCGCCAGATTCTTCTGCCCTCCACCTTGTGACCCAGAGTCT GGCTTGA | 2468 |
| | 3 | MSYCFF* | 2469 | ATGAGTGTGTGCTTTCTAG | 2470 |
| | 4 | MGRRNAARLPAQTRVAPHARPGPHPPGAHGSPRLPGRK SPPPQKGWSLVGSCCWVG* | 2471 | ATGGGAAGGAGAAATGCTGCGCGCTTCGCCGCAGACCAGAGTCGCCCACATGC CAGGCCAGGCCGCATCCTCCTGGGCACACGGGAGCCCAGGCTTCCGGCAGGA AAAGCCCCCCAGGGGCTGGTCTCTGGGGTCTGTGGGAGTTGCTGCTGGGTGGGG TGA | 2472 |
| | 1 | MHLPFQ* | 2473 | ATGCACCTGCCTTCCAGTAG | 2474 |

Figure 1 (Continued)

| | | Protein | SEQ ID | Nucleotide | SEQ ID |
|---|---|---|---|---|---|
| hsa-let-7b | 1 | | | ATGCTCGGTGTTGGCCGTGGAGGACAATGTGCCCTGCCAGCGGGAGGGGGCAGGTGGACCCTGTGGAGGCCCTGTGGGGGTGGCCACACAGAAGGGCACTGCTCATCCTTGCAACAAGATCCCCTGAGGGCAGTGCTGCTCCTAGAAGAAGGCAGGAAATACCACCAGGTGAAGCAGAGAATGGCGTTGATGAGTGTGCTTTTCTAGGGTCGACGCAGGTCCTCTGTGGCAGGTGGCCATGGGGTGTCCGGGTGACCCTGCGGTGGCCTGTGTTCGCCACGTGACCACCGCCAGCTCCTTGGAGGCCTGGAAGTCTCTGGATGCCGACACCTGCTCGGCGACCCGCCAGACTCCTTGTCCCAGGAAACATTCGTCACCAGAAACGAAGTTTGCCCAGACCCTCCAGGCCCCTCACCCTGGCCCCGCCTGCCGCCTGAGGACAGGAACCCAGCCGGGCCCACGARPASSWGTREPQASRQEKPPTAEGLVSGGELLCCAGGAGGAGGAATGCTGCCGGCCATCTCTGAGGACCAGGAGCCCAGGAGCCAGGAGCCTTCGCCAGGAAAAGCCAGGCCCCACCCTGCCACCACGGGTGGTCTCTGGTGGGAGGTTGTCTGGGTGGGGTGACCAGGAGGTCGGGGTTTAATGATGTAGTTGCATCTGGCACCGCCCCTGCCACCCCGATCTTTCCTGCGGTATTTTAAAGCCCCACCTTGTGACCCAGACTGTGGCTTGA | 2476 |
| | 2 | MLGVGRGGQLCPWPGGEGAARGPCGSPVGALWGWPHGSCYPCNKIPWRAVCLLEEGRRNHRYKQRMAFDECVLPLGVDAGPLGSMGWCRVDPTVACVRHVAVGQFLAGGDFSPDTCRAPSQTLEAWEGLWMPPYTPPRLLSLWFLDRTFRHHETKFAQALPSPWENPAGHGKEECPPARPDQSRPTCQARPASSWGTREPQASRQEKPPTAEGLVSGGELLGGVTTGRGSGWGHFNDVVASGHRPLPPPHLSCPPHLVTQTVA* | 2475 | | |
| hsa-let-7c | 3 | MSVCFF* | 2477 | ATGAGTGTGTGCTTTTCTAG | 2478 |
| | 4 | MGRRNAARLPAQTRVAPHARPGPHPPGAHGSPRLPGRKSPPPQKGWSLVGSCCWVG* | 2479 | ATGGGAAGGAGGAATGCTGCCCGCTGCCCGGAGACCAGAGTCGCCCCACATGCCAGGCCAGGCCCGCATCCTCCTGGGCACACGGGAGCCCAGGCTTCCCGGCAGGAAAAGCCCCCACCGCAGAAGGCTGGTCTCTGGTGGGAGTTGCTGCTGGGTGGGGTGA | 2480 |
| hsa-let-7d | 1 | MGVTSVSFIDVLLCCLSEGLAHTRT* | 2481 | ATGGGAGTCACATCAGTTCTTTCACTGATGTTCTCCTATGCCGAGAGGCCTG | 2482 |
| | 2 | MFSYAYQKAWHILGLNK* | 2483 | ATGTTCTCCTATCAGAAGGCTTGGCACATACTAGGACTTAA | 2484 |
| | 3 | MPIRRPGTY* | 2485 | ATGCCTATCAGAAGGCCTGCACATACTAG | 2486 |
| | 4 | MRTGNLNFYVNECVIGFLVLLNHGA* | 2487 | ATGAGAACTGGAAATTTAAACTTTTATGTCAATGAATGTGTCATCGGCTTTCTGTGTTTTGCTGAATCATGGGCTTAA | 2488 |
| hsa-let-7e | 1 | MKHR* | 2489 | ATGAAGCACAGATAG | 2490 |
| | 2 | MYVICTFANSPRSFR* | 2491 | ATGTATGTCATATGCACTTTTGCAAACTCACCAAGAAGTTCCGATGA | 2492 |
| | 3 | MSYALLQTHQEVSDEHMKKMSEGLIVL* | 2493 | ATGTCATATGCACTTTTGCAAACTCACCAAGAAGTTCCGATGAACATATGAAGAAA | 2494 |
| | 4 | MHFCKLTKKFPMNI* | 2495 | ATGCACTTTTGCAAACTCACCAAGAAGTTCCGATGAACATATGA | 2496 |
| hsa-let-7f | 1 | MPLHSSLGNPSQK* | 2497 | ATGCCACTGCACTCCAGCCTGGGCAATCCGTCTCAAAAATAA | 2498 |
| | 2 | MHNH* | 2499 | ATGCATAACCATTAG | 2500 |
| | 3 | MNTMEYYHKMNEEVL* | 2501 | ATGAATATGGAGTATTATCACTATTAAAATGAATGAGGAGGTTCTATAA | 2502 |
| | 4 | MRRFYKPRYGRIFGYHVKKKKKTKVQNNVLSGDRKEEGGIYVHRCIKNLWKDT* | 2503 | ATGAGGAGGTTCTATAAGCCTAGATATGGGAGGATCTTTGGATATCATGTAAAAAAAAAAAAAACCAAGGTGCAGAATAAATGTGCATAGATGTATAAAATTCCTCTGGAAAGATACATAA | 2504 |
| hsa-let-7g | 1 | MKHR* | 2505 | ATGAAGCACAGATAG | 2506 |
| | 2 | MYVICTFANSPRSFR* | 2507 | ATGTATGTCATATGCACTTTTGCAAACTCACCAAGAAGTTCCGATGA | 2508 |
| | 3 | MSYALLQTHQEVSDEHMKKMSEGLIVL* | 2509 | ATGTCATATGCACTTTTGCAAACTCACCAAGAAGTTCCGATGAACATATGAAGAAA | 2510 |
| | 4 | MHFCKLTKKFPMNI* | 2511 | ATGCACTTTTGCAAACTCACCAAGAAGTTCCGATGAACATATGA | 2512 |
| hsa-let-7i | 1 | MMGTGTMILEHNKELKIL* | 2513 | ATGATGGGCACTGGGACAATGATACTTGAACATAACAAGAACTAAAGAACTGTGA | 2514 |
| | 2 | MTLKVALGFYYWSRFKIFYLFKTYVVCFKKLCYK* | 2515 | ATGACCTTGAAAGTTGCATTGGGTTTTTATTATTGGTCCAGTTTAAAACATTTTATCTATTTAAAACATATGTTGTGTTTTAAGAAGTATGTTATAAATA | 2516 |

Figure 1 (Continued)

| | | | | |
|---|---|---|---|---|
| | 3 | MLCVLRSYVFNNSIVVKSPESSGARLLRCKSQLCYFTKCV TLGKLINLFWCPPL* | 2517 | ATGTTGTGTTTAAGAAGTTATGTTATAAATAACAGCATTGTGGTTAAGAGCCCA GAGTCTGGGGCAGGCTTCTTAGAATGCAAATCCCAACTCTGTTATTTTACTAAATGT GTGACCTTGGGCAAGTTAATTAACCTGTTTTGGTGTCCTCCTGTGA | 2518 |
| | 4 | MQIFLLFY* | 2519 | ATGCAAATCCAACTCTGTTATTTTACTAA | 2520 |
| | 1 | MSPGKTRKPV* | 2521 | ATGAGCCCAGGCAAGACCAGAAAACCTGTGTAA | 2522 |
| | 2 | MHLLYATEAL* | 2523 | ATGCATTTTATTGTATGCCACTGAGGCTTTGTAG | 2524 |
| hsa-mir-100 | 3 | MPRLRLCSVYYAAFFCDNAAFFVTWCLLCSIFVTMDT* | 2525 | ATGCCACTGAGGCTTTGTAGTGTTTATTATGCAGCATTTTTGTGACAATGCTGCAT TTTTTGTGACAATTTGGTGTTTATTATGCAGCATTTTTGTGACAATGGACACCTGA | 2526 |
| | 4 | MQHFFVTMLHFL* | 2527 | ATGCAGCATTTTTTGTGACAATGCTGCATTTTTGTGA | 2528 |
| | 1 | MQGIS* | 2529 | ATGCAAGGAATTTCCTAG | 2530 |
| | 2 | MELWKRSSSGLHLLHC* | 2531 | ATGGAATTATGGAAAAGATCTCTTCAGGCCTTCATTGCTCATTGCTAG | 2532 |
| hsa-mir-101-1 | 3 | MEKILFRPSFAHSLLVMVLNMGDIK* | 2533 | ATGGAAAAGATCCTTCAGGCCTTCATTTGCTCATTCATAGTCATGGTGCTAA ATATGGGAGATATAAAATGA | 2534 |
| | 4 | MSMAWPWPQSLP* | 2535 | ATGAGTATGGCATGGCCGTGGCCTCAAAGCTTACCCTAG | 2536 |
| | 1 | MCFLNAVLAAVNFVWNPVSVVWKCIDFWQCALF* | 2537 | ATGTGTTTCCTTAATGCTGTATTGGCGGCCGTGAACTTGTTTGGAATCCAGTCTCTG TAGTCTGGAAATGTGATTTCTGCAGTGTGCTCTGTTTGA | 2538 |
| hsa-mir-101-2 | 2 | MLYWRP* | 2539 | ATGCTGTATTGGCGGCCGTGA | 2540 |
| | 3 | MGPITVGSPLPSLGVQMVVSFDDAGKWGRAFQGRT* | 2541 | ATGGGTTTCATCACAGTGGGGTCCCCTCTTGTTCTCTCGGGTGTGCAGATGGTCGTG TCCTTTGATGATGATGCTGGGAAATGCGAAGGCTTTCAGGGAGAACATAA | 2542 |
| | 4 | MMMLGNGEGLSRGEHKS* | 2543 | ATGATGATGCTGGGAAATGCGGAAGGCTTTCAGGGAGAACATAAAAGTTAA | 2544 |
| | 1 | MFDLKKKIKGLLMFLGCSILGS* | 2545 | ATGTTTGATTTAAAAAAAATTAAAGGGCTGTTAATGTTTTAGGGTGTTCCATA CTAGGAAGTTAG | 2546 |
| | 2 | MEGLLFCGRFLL* | 2547 | ATGGAAGGTCTTATCCTTTTGTGGGAAGGTTTTTACTTTGA | 2548 |
| | 3 | MLGPQI* | 2549 | ATGCTAGGACCACAGATATAG | 2550 |
| | 4 | MGVVYTHDFPTLRFSILMLIT* | 2551 | ATGGGTGTGTTTATACACATGACTTCCAACTGCATTTCAGTATCCTTATCGTGA TAACTTGA | 2552 |
| | 1 | MHSLQYPLASPPRKQFPVCEAALWTASPLVDPG* | 2553 | ATGCACTCCTCTCAGTATCCTCTCGCCCGAAAACAGTTCCAGTTCCGCG AGGCCCCTCTGCCTCTTCCCCTAGTGGATCCGGGCTGA | 2554 |
| hsa-mir-107 | 2 | MHLGRKGTSQAPDHFALPKDEPGQLERWGVRTERHT* | 2555 | ATGCATCTAGGGAGGAAAAGGTACCTCGCAGGCCCCAGACCATTTGCCTTACCAAAA GATGACCCAGGCCAGTTGGAAAGGTGGGGAGTTCAGGAGTCAGGACGGCACACCTAG | 2556 |
| | 3 | MTQASWKGGESGRKGTPRGEVEGKCQPVWGVAS* | 2557 | ATGACCCAGGCCAGGCAGTTGGAAAGGTGGGGAGTCGGAGGACGGAAAGGCACACCTAGGG GAGAGTGGAGGGGAAAGTGCCAGCGTGTGTGGGCGGCGTCGCCTCTTGA | 2558 |
| | 4 | MIEDTLFRGSCRLVLRCMHLSNSFSPLFSESQGIPRREKG NPSQGEVGVWEAIFGRKGNRKRTGCPHRRCSGPEAEAV TSRSCQ* | 2559 | ATGATAGAGGATACCCTATTCGCGGCTCTGCAGCTTGTCCTTAGGCATGCAT CTCTCTAATTCGTTTCTGTTTCGTGTTTCTGAAATCCAAGGGATCCAAGGAGGAGA AGGAAATCCTTCCCAGGGAGAGGTGGGGGTCTGGAAATCCAAGGGATCCCAAGGAGG GAAAAACCGAAAGCGACAGCCGGTTGTCCGACACCCGCGTCCTCTGACCAGAGGACAGA GGCTGTAACATCCGGAGCTGCCAGTAG | 2560 |
| hsa-mir-10a | 1 | MPAPKAHFWHSWSTLEKLQ* | 2561 | ATGCCAGCTCCAAGGCCCACTTTGGCACTCCTGGGCACTCTGGAAAGTCCAG TAG | 2562 |
| | 2 | MAGLSLASQP* | 2563 | ATGGCAGGGCTGTCTCTGGCTTCCCAGCCATAG | 2564 |
| hsa-mir-122 | 3 | MVTQASSWLSQCPSSMACPHMDPRFRGSASIRLKARCL PF* | 2565 | ATGGTCACACAAGCTTCCTCTTGGCTCTCAATGCCCTTCTCCATGGCGTGCCCTC ATATGGACCCTCGATTCCGCGGCATCAGGCATCAGGCTCAAGGCGCCGTTGTCTCC CCTTCTAG | 2566 |

Figure 1 (Continued)

| | | | | | |
|---|---|---|---|---|---|
| | 4 | MPFFHGVPSYGPSIPRLSEHQAEGPLSPLLASSTSDSPGS LSHPPT* | 2567 | ATGCCCTTCCATGGCGTGCCCTCATATGGACCCTCGATTCCGCGGCTCAGCGAG CATCAGGCTGAAGGCCCGTTGTCTCCCCTTGTAGCAAGCTCCACAAGTGACTCTCCA GGATCCTTTCCCATCCACCTACATGA | 2568 |
| hsa-mir-125a | 1 | MPLHSSLGNPSQK* | 2569 | ATGCCACTCACTCCAHCCTGGGCAATCCTGCGTCTCAAAAATAA | 2570 |
| | 2 | MHNH* | 2571 | ATGCATAACCATTAG | 2572 |
| | 3 | MNTMEYTITIKMNEEVL* | 2573 | ATGAATACAATGGAATATTATCACTATTAAAATGAATGAGGAGGTTCTATAA | 2574 |
| | 4 | MRRFYKPRYGRIFGYHVKKKKKJKVQNNVLSGDRKEE GGHYVHRCIKFLWKDT* | 2575 | ATGAGGAGGTTCTATAAGCCTAGATATGGAGGATCTTTGGATATCATGTAAAAAA AAAAAAAAACCAAGGTGCAGAATAATTGTGATCCTATCAGGGACAGAAAAGAGG AGGGTGGTATATATGTGCATAGAHGTATAAAATTCCTCTGGAAAGATACATAA | 2576 |
| | 1 | MPSVKLRPVCVYISVCNREIAWIRGKKSCICICCF* | 2577 | ATGCCTTCTGTAAAGTTAAGGCTGTGTGTGTATATCTCTGTATGTAATAGAGAG ATAGCAGTCCACAGAGCTGGAATATCAGTAGGCAGTTGCTGTA | 2578 |
| hsa-mir-125b-2 | 2 | MWSPQSWNSRQLL* | 2579 | ATGTGGAGTCCACAGAGCTGGAATATCAGTAGGCAGTTGCTGTAA | 2580 |
| | 3 | MFNY* | 2581 | ATGTTCAATTATTAA | 2582 |
| | 4 | MSDSHSEVMTLYPKYCGGLSRKINSIKDTDARELKKKK KKRWY* | 2583 | ATGTCTGATAGCCATAGGAGTCATGACATTAATTTATCCAAAGTATTGTGGCAA CTGTCTAGAAAAATAAATAGCATAAAGGACACAGAGCTAATTATCCAGAGAACTAAAAAAGAA AAAAAAAAAAGGTGGGTCTGA | 2584 |
| | 1 | MNQQGPLCALHPVPLGGRGTPMPCSGLWEEGEG* | 2585 | ATGAACCAACAGGGACCTCTCTGCCCCTTCACCGGTTCTCTGGGAGGAGGGG AACGCCAATGCCGGGACGGCTTGGGAGGAGGGGAAGGCTAA | 2586 |
| hsa-mir-129-1 | 2 | MPSQMLFPASRIYSGV* | 2587 | ATGCCCTCTCAAATGCTCTTCCCTGCTTCCGCCATCTACTCAGGTGTGTGA | 2588 |
| | 3 | MCYYFGRASVSRGNLMTQ* | 2589 | ATGTGTTACTATTTCGGGGAGGCAGTGTTTCCAGGGAACCTAATGACGCAATGA | 2590 |
| | 4 | MTSMQVSSRLSGRAGGLPAPGLGAVCGREGAGEVARA AGAGAREPRLSPGTGGRPLPAPEPRQLPAARAGVSP* | 2591 | ATGACGTCAATGCAGGTCAGCAGCAGGTCTCCGGGAGGCCTCCCGGAGGGCCGGCGGAGGCGCGGCTCCGGCC TTTCGGCCTCGGCGCAGTCTGCGGGGAGCCCCGGCGGAGGGCGCGGCGAGGTTGCGCGAGGGCGG CTGGCCGCGGGGGCCGAACCCAGGCAACTCCGCCGCCGGGCAGGAGTTTCTCCGTAG | 2592 |
| | 1 | MLWEQIRLFQAECRTRPKIKTVVAAELTFSEHLLNARC WANNLHSHSFAAGNSQPYGAGLIAISILQEGNRGS* | 2593 | ATGCTGTGGGAGCAGATAAGATTGTTCCAGCAGATGTGCAGGACAAGGCAAAGAT AAAAACTGTAGTGGCAGCAGAACTCACTTCAGTGAACACTTACTAAATGCCAGGTG CTGGCCAACAATTTACACAGACATCTCATTTGCTGCTGGCAACAGCCAGCCTATGG GGCAGGTTTGATTGCCATTCAATTTGCAAGAAGGCAACAGGGGTTCATAA | 2594 |
| hsa-mir-130b | 2 | MQDKAKNKNCSGSRTHFQ* | 2595 | ATGCAGGACAAGGCTGCTGGGCAACAATTTACACAGACATCTAGTGCAGCGAGAACTCACTTTCAGTGA | 2596 |
| | 3 | MPGAGPTIYTASHLLLATASPMCGQV* | 2597 | ATGCCAGGTGCTGGGCCAACAATTTACACAGCATCTCATTGCTGCTGGCAACAGCC AGCCCTATGGGGCAGGTTTGA | 2598 |
| | 4 | MNASPQSGSQSRRNQSLHFKSPYLPQIQKITGPRPRSP* | 2599 | ATGAATGCTTCTCCCCAAAGTGGATCACATACACAATGGACCACAAACCAAAGCTTACACTTC CGTTCCACCATATCTCCACAGATCAAAGACCACGGGGCCACGGGCCAGGACCCGGTCTCCA TAG | 2600 |
| hsa-mir-133a | 1 | MLFIFSVRRLR* | 2601 | ATGTTGTTCATTTTTCTGTGAGAAGGCTAAGATGA | 2602 |
| | 2 | MRGKRDILGGVMEIGYWNCTGDWIPGPYP* | 2603 | ATGAGGGGCAAGAGAGACATACTGGGGGAGTTATGGAGTTGGGTATTGGAACTG TACTGGAAGATTGGATACCTGGACCATATCCCTGA | 2604 |
| | 3 | MIKLMHGPEDAKAVHPESNHYVNHPASLSRLSLM* | 2605 | ATGATAAAGTTGAACCATGGCCCAGAAGATGCAAAAGCAGTCAAAAGCCAA CCACTATGTGAATCACCCAGCCAGTCTTAGCAGGCTGTCCTGATGTGA | 2606 |
| | 4 | MAQKMQKQCIRKATTM* | 2607 | ATGCCCAGAAGATGCAAAAGCAGTGCATCCGGAAAAGCCAACCACTATGTGA | 2608 |
| hsa-mir-133b | 1 | MPLRK* | 2609 | ATGCCACTCAGGAAGTGA | 2610 |

Figure 1 (Continued)

| | | | | |
|---|---|---|---|---|
| hsa-mir-138-2 | 2 | MLNAESENEPLGWRVDPGLTKSWQSPH* | 2611 | ATGCTGAATGCTGAGTCAGAGAAATGAACCCTGGGCTGGCGGGTTGACCCAGGCCT GACAAAGTCTTGCAGTCCCACACTGA | 2612 |
| | 3 | MLSQKMNPWAGGLTQA* | 2613 | ATGCTGAGTCAGAAATGAACCCTGGCTGGCTGGCGGTTGACCCAGGCCTGA | 2614 |
| | 4 | MEMCVLYQN* | 2615 | ATGGAAATGTGTGTTTTATATCAGAATTGA | 2616 |
| hsa-mir-141 | 1 | MDRLTT* | 2617 | ATGGACAGACTCACAACTGA | 2618 |
| | 2 | MAASPPPLPDPVYSPARPQAGPTLLLL* | 2619 | ATGGCTGCATCCCCCACCTTCCTGACCCTGTATAGCCAGCCAGGCCAGCCCTTAG GCAGGGCCAACCTTCTCCTCTGTAA | 2620 |
| | 3 | MGNCVCLRACLA* | 2621 | ATGGGTAACTGTGTGCTCGGCTGCCTCCGGTTA | 2622 |
| | 4 | MEGDHNRVVVKSTEMTADDKTGTVTHHTLAMCPGTK RLHTLVQSRHFCHSHFTVAETEGQKN* | 2623 | ATGGAGGGCGATCATAACAGGGTGGTGGTGAAAAGCACCGAGATGACGGCTGACGA TAAGACGGGCACAGTGACTCATCACACGCTGGCCATGTGCCCAGGCACTAAAAGACT ACACACGTTAGTCAGTCTAGGCACTTCTAGCACTTCTGTCATTCTCATTTTACCGTGGCGGAAAACT GAGGGACAGAAAACTAA | 2624 |
| | 1 | MAKFSIVYFYLT* | 2625 | ATGGCAAAGTTTCCATTGTATATTTTATTTGACCTAA | 2626 |
| | 2 | MPCIQ* | 2627 | ATGCCCTTGTATTCAGTGA | 2628 |
| | 3 | MFKRLITFIQMFL* | 2629 | ATGTTTAAGCGTTTGATCACTTTTATTCAAATGTTCCTATGA | 2630 |
| hsa-mir-181a-1 | 4 | MITRRYCAFSYYFNAPMYTAGLNNHKSNVCLESDWFV YLHCCRKSH* | 2631 | ATGATAACCAGAAGATACTGTGCATTCTCATATATTTAATGCTCAATGTATACTG CAGGCTTAAATAACCATAAAGTAATGTTTGTTTAGAAAGTGACTGGTTTGTTTACC TTCACTGCTGCAGAAAATCTCACTAG | 2632 |
| | 1 | MSQMTVLYNDLVSQWLRKMENKPQGP* | 2633 | ATGTCACAAATGACAGTCCTGTATAATGACCTGGTTCCCAGTGGCTCAGAAAGATG GAAAATAAACCCCAAGGACCCTAG | 2634 |
| hsa-mir-181a-2 | 2 | MTWFPSGSERWKINPKDPSSDRLKRADRGCLA* | 2635 | ATGACCTGGTTCCAGTGGCTCAGAAAGATGGAAAATAAACCCAAGGACCCTAG TTCAGACAGACTGAAGAGACGAGACCGTTGCTGTCTTGCATGA | 2636 |
| | 3 | MIKGYVTAQ* | 2637 | ATGATTAAAGGCTATGTCACAGCTCAGTAG | 2638 |
| | 4 | MSQLSRVHAFIASPPQQPLM* | 2639 | ATGTCACAGCTCAGTGAGGTCCATGGGTCCATGCTTTCATAGCTTCCCCCCAGACAACCCTA ATGTGA | 2640 |
| hsa-mir-181b-1 | 1 | MAKFSIVYFYLT* | 2641 | ATGGCAAAGTTTTCCATTGTATATTTTATTTGACCTAA | 2642 |
| | 2 | MPCJQ* | 2643 | ATGCCTTGTATTCAGTGA | 2644 |
| | 3 | MFKRLITFIQMFL* | 2645 | ATGTTTAAGCGTTTGATCACTTTTATTCAAATGTTCCTATGA | 2646 |
| | 4 | MITRRYCAFSYYFNAPMYTAGLNNHKSNVCLESDWFV YLHCCRKSH* | 2647 | ATGATAACCAGAAGATACTGTGCATTCTCATATATTTAATGCTCAATGTATACTG CAGGCTTAAATAACCATAAAGTAATGTTTGTTTAGAAAGTGACTGGTTTGTTTACC TTCACTGCTGCAGAAAATCTCACTAG | 2648 |
| hsa-mir-181b-2 | 1 | MSQMTVLYNDLVSQWLRKMENKPQGP* | 2649 | ATGTCACAAATGACAGTCCTGTATAATGACCTGGTTCCCAGTGGCTCAGAAAGATG GAAAATAAACCCAAGGACCCTAG | 2650 |
| | 2 | MTWFPSGSERWKINPKDPSSDRLKRADRGCLA* | 2651 | ATGACCTGGTTCCAGTGGCTCAGAAAGATGGAAAATAAACCCAAGGACCCTAG TTCAGACAGACTGAAGAGACGAGACCGTGGCTGTCTTGCATGA | 2652 |
| | 3 | MIKGYVTAQ* | 2653 | ATGATTAAAGGCTATGTCACAGCTCAGTAG | 2654 |
| | 4 | MSQLSRVHAFIASPPQQPLM* | 2655 | ATGTCACAGCTCAGTAGGTCCATGCTTTCATAGCTTCCCCCCAGCAACCCTA ATGTGA | 2656 |
| hsa-mir-181c | 1 | MPVIPAL* | 2657 | ATGCCTGTAATCCCAGCACTTTAA | 2658 |
| | 2 | MGGWLESGRRRIQ* | 2659 | ATGGGAGGATGGCTTGAATCCGGAGCGGAGGATACAGTGA | 2660 |
| | 3 | MGCIC* | 2661 | ATGGGTTGCATCTGTTAA | 2662 |
| | 4 | MELPFPETGKMAGDRLQLRK* | 2663 | ATGGAGCTGCCATTTCCGGAGACCGGGAAGATGGCGGGAGACCGTTTGCAGTTGAG GAAATGA | 2664 |
| | 1 | MPVIPAL* | 2665 | ATGCCTGTAATCCCAGCACTTTAA | 2666 |
| | 2 | MGGWLESGRRRIQ* | 2667 | ATGGGAGGATGGCTTGAATCCGGAGCGGAGGATACAGTGA | 2668 |

Figure 1 (Continued)

| | | | | |
|---|---|---|---|---|
| hsa-mir-181d | 3 | MGFFC* | 2669 | ATGGGTTGCATCTGTTAA |
| | 4 | MELPFPETGKMAGIDRLQLRK* | 2671 | ATGGAGCTGCCATTTCCGGAGACCGGGAAGATGGCGGGAGACCGTTTGCAGTTGAAGGAAATGA | 2670, 2672 |
| | 1 | MALREGRAGPGAGGGKTLLESFSVHSVEPPRSRAGAAGPPFSSRAVRAARAPCSSGPRAQVPHLWTSPACSAEAAAPLQVAGPGPSPADLSPDTQEARGRVPAPLCSPAGLGAPAPPPLAGQRRFGPGPGALQAPSMRLFPNRGRFCLASLVWTPRGAERRLCAQPGAGAGECLGPGAGGRAGRSQSGAQ* | 2673 | ATGGCGCTGCGCGAGGGTCGGGCGGGCCCGGGCGCGGGGGGCGGGAAGACCCTCCTGGAGTCATTCTCGTTCGTCCACTCCGTGGAGCCGCCGCGCAGCCGCGCGGGAGCCGCAGCCCCGTTCTTCCGGTCCTCAGCGAGTCCCGGGGCCGGGCCGGGTACCCCGTCTGGACCTCCCCCGGCCAGCCGCGGAGGCGGCTCCTTCAGGTGGCCGGGCCGGGTCCCGGCTCCCCGTTGTCCCGGCGCTGGGCTCCGGCGCCCAGGAAGCGGCGGCCCGGGTCCCCGGGGCACGGAGTTTGGCGCGGACCGCGTTTGCCGGCGCGCTGCAGGCCGAGCTCGGGGTCATGCCGCGAGCTTTCCAAACCGGGAGGTCTCTCTGAGGCCGCGCTGGCGAGGCGCGTGAGTTGGGGGAGCTGAGAGCGCGCTGTGCGCCCAGCCTGGCGCGCCAGGTGAGTCAGCCTCCTGCCAGGGCGGGGGCGGGGGCTCAGTAG | 2674 |
| hsa-mir-182 | 2 | MIRQCLLALPRLQAEAPTGRLGPGSASGVCPAPSAVPGRGRGRERLRSECGRCLRGAYPRGVWLGSGCVSPPWWAQAEAPGWEGAAESAGAPELAPPASCGCAAGSRLLPWPGAAPPSLWGKAALRPPVCLHFAATHPGNPGARE* | 2675 | ATGACGCGGCAGTGCCTACTGGCTCTTCCGCGCCTTCAGGCGGAGGCGCCCACGGGCGCCCTGGGTCCGGGCAGTGCGAGCGTCTGCCCAGCGCCCAGCGCTGTTCCGGGCCTACCCGCGAGGCGGTTGGCCTGGGAGCGGCTGCGGGGAGCGCGTTGCGCCTGGTGGGCTCAGGCGGAAGCGCCAGGTCTTGTCAGGGCTGCGGCCTGGTTCGGAGGCCCCGGAGCTGGCCCCTCCAGCCGCCCCGCCCAGTCTCTGGGGAAAGCGGCTCTCAGACTCCGTGCCCTTCCACTTCGCGGCACTCATCCCGGGAACCCGGCGCACGCGAATGA | 2676 |
| | 3 | MRHRSPPSTAPFLLIALVAPRFPALPQDRRLDGLPLAPHRSAHPKTMGSEGVTRGQGSPDSTVSSRLSHSFALPTRAPGHRVQ* | 2677 | ATGAGACACCGTTCCCGCCCAGGTTCCACCCCCGACGCCCTCCCAACTGCCCGCCCATTCTGTTAATAGCGCTAGTGGCACCCAGGTTCAGCGCATCCCAAGATGGGGCTGACCGCTTGCCTCTGCGCCCTCACCGGTGTCAGTGAGGGTGTCACCGGGGTCAGGGGTGCCCGATTCTCAGGGTCTCCAGGCTGAGCCATTCGTTGCTCTTCCAACCCGGGGCTCCGGACACGTGTACAGTAA | 2678 |
| | 4 | MGTESADL* | 2679 | ATGGGCACGGAGTCGGCGGATCTCTGA | 2680 |
| | 1 | MALREGRAGPGAGGGKTLLESFSVHSVEPPRSRAGAAGPPFSSRAVRAARAPCSSGPRAQVPHLWTSPACSAEAAAPLQVAGPGPSPADLSPDTQEARGRVPAPLCSPAGLGAPAPPPLAGQRRFGPGPGALQAPSMRLFPNRGRFCLASLVWTPRGAERRLCAQPGAGAGECLGPGAGGRAGRSQSGAQ* | 2681 | ATGGCGCTGCGCGAGGGTCGGGCGGGCCCGGGCGCGGGGGGCGGGAAGACCCTCCTGGAGTCATTCTCGTTCGTCCACTCCGTGGAGCCGCCGCGCAGCCGCGCGGGAGCCGCAGCCCCGTTCTTCCGGTCCTCAGCGAGTGGCCGGGCCGGGTACCCCGTCTGACCTCCCCGGCCAGCCGCGGAGGCGGCTCCTTCACCGACGCCAGGAAGCGGTGGCCGGGTCCCCGGGGCCGGGGGTCCCGGCTCCCCGTTGTTCCCGGCGCTGGGCTCCGGCGCCCAGGAAGCGGCGGCCCGGGAGGTTTGGCCCGGCGCTTTGCCCAGCCGCGGAGCTCGGGGCACTCAAACCGGGAGCTCTCTCTGAGGCCGCAGCCTGGCGCCGCTGAGCGGCCGCTGCGCAGGTGAGTGTCTGGGGCGCAGGGGAGCTGAGAGCGCGGAGGCCAGGAGGCGGGGGCTCAGTAG | 2682 |

Figure 1 (Continued)

| | | | | |
|---|---|---|---|---|
| hsa-mir-183 | 2 | MTRQCLLALPRLQAEAPTGRLGPGSASGVCPAFSAVPG RGRGRERLRSECGRCLRGAYPRGVWLGSGCYSPPWWA QAEAPGWEGAAESAGAPELAPPASCQGCAAGSRLLPWP GAAPPSLWGKAALRPPVCLHFAATHPGNPGARE* | 2683 | ATGACGCGGCAGTGCTACTCGCTCTTCCGGCCTCTTCAGGGCTGGAGGCCCCACGGG GGGCCTGGTCCTGGGTCCGGCCCAGTGCCGGTCTGCCCAGCGCCAGCGCTGTTCCGG GCGGGGGCGCGGGCGAGGAGTTTGCTCGGCAGCCTGCGGTCGCGGAGTCCGCCCTGGTGGGCT GCCTACCCGCGAGGAGTTTGCTCGAGGGTGCTGCGTTTGCCGCCTGGTGGGCT CAGGCGGAAGCGCCAGGCTGGGAGGGGCTGCGCAAGGGGCTGCGGAAGCTGCTTCCGTGCC TGGCCCTCCAGCGTCTGTCAGGGCTGCGGCGCTGCGGCGCTGCGAGGCTGCTTCCGTGCC CCGGAGCGCCCCCGCCCAGTCTCTGGGCGAAAGCGGCTCTCAGACCTCCGTGTGCC TCCACTTCGCGGCCACTCATCCCGGAACCCGGCGCACGCAGCGAATGA | 2684 |
| | 3 | MRHRSPPSTAPFLLJALVAPRFPALPQDRRLDGLPLAPH RSAHPRTMGSEGVTRGQCGSPDSTVSSRLSHSFALPTRAP GHRVQ* | 2685 | ATGAGACACCGTTCCGCCGCCTCAACTGCCTCCCATTCTGTTAATAGCGCTAGTGGCA CCCAGGTTCCGACCTTCCCAGCTCCCAAGATGCGGCGTTGGACGGCTTGCCTCTGGCGCCT CACCGGCGCATCCAGACTATGGGCAGTGAGGGTGTCACCCGGGGTCAGGG GTGCGCGGATTCCACGGTGTCCTCCAGGCTGAGCCATTCGTTTGCTCTCCAACCCG GGCTCCCGGACACCGTGTACAGTAA | 2686 |
| | 4 | MGTESADL* | 2687 | ATGGGCACCGAGTCTGCGGATCTCTGA | 2688 |
| hsa-mir-190 | 1 | MAETWA* | 2689 | ATGGCTGAGACTTGGGCATGA | 2690 |
| | 2 | MRTEEQRKERK* | 2691 | ATGAGGACAGAGGAGCAAAGGAAGGAGAAGAAAATGA | 2692 |
| | 3 | MKRRGKQGICS* | 2693 | ATGAAAAGACGCGGGAAACGCAAGCAAGGAATTGTAGTTAA | 2694 |
| | 4 | MRLSDFKL* | 2695 | ATGAGATTATCTGATGAAATCAAGTTATAA | 2696 |
| hsa-mir-192 | 1 | MGKPRLGLGIREPSPC* | 2697 | ATGGGGAAACCAAGGCTCGGGTTGGGAATCAGGGAACCTCACTTGCTAG | 2698 |
| | 2 | MPPGEADGAQPDASWTRPTLPGHSPGLPALRTALVISID GGGHINHHQGLGQRLKRPWAQGVPTSSLCPEGQPGTQ VRGFLSGRTPAALPVLGGS* | 2699 | ATGCCACCCGGAGAGGCAGATGGGGCCAGTCCAGGGCTTCCTGCCCTTGAACGCACTGCCGGCCCAC CCTGCCCGGGCACAGTCCAGGGCTTCCTGCCCTTGAACGCACTGTGATCAGTAT TGACGGTGGTGGGAGATAATCATTAACCACCAGGGGCTGGGTCAACGGCTCAAAA GGGGCCTGGGCCAGGGTGTCCCACTTCCTCGAGTGGTAGGACCCTCCGCGCCTCCGGCA CTCAGGTAAGAGGCTCCGAGTGGTAGGACCCCTCCTGCGCCTCCGGCA GCTCCTGA | 2700 |
| | 3 | MGPSLMLPGPAPPCPGTVQGFLPFEPHL* | 2701 | ATGGGCCCCAGCCTGATGCTTCCTGGACCCGCCCCACCCTGCCCGGGCACAGTCCAG GGCTTCCTGCCCTTCGAACCGCACTTGTGA | 2702 |
| | 4 | MGWPGRAPSSLCLGFHCGHGP* | 2703 | ATGGGGTGGCCGGGACGAGCCCTTCCTCTGTGCCTTGGTTCCACTGTGGATA AGGGGGCCTTAG | 2704 |
| | 1 | MVAHACNPSYS&G* | 2705 | ATGGTGGCATGCCTGTAATCACTGTACTCTGAGGCTGA | 2706 |
| | 2 | MPVIPVTLEAEAGESPTPGR* | 2707 | ATGCCTGTAATCCAGTTACTCTGAGGCTGAGGCAGGAGAATCGCTTACACCTGGG AGATAG | 2708 |
| | 3 | MERAGTPQAEGEEASSLPLAGVPGTSSVASGLPAKLGG VFYERDLCWPTEDSKHPL* | 2709 | ATGGAGAGGGCAGGGACACCACAGGCAAGGAGGAAGGAGGAGGCAGCTCGCCCCTT GGCTGGGGTCCCTGGGACCTCCTCTGTGGCATCAGGACTGCCGCTAAGTGGGTGG TGTGTTTTATGAGCGTGACCTGTGTTGCCAACAGAGGACAGGCAAAATACATTTTT ATGA | 2710 |

Figure 1 (Continued)

| | | | | |
|---|---|---|---|---|
| hsa-mir-193b | 4 | MSVTCVGQQRTAKYIFYDPGRFRPVTFSRREAGRWRGT SHVSVMWILFAKEGPLLQWIWGSLGRGVGEDFRKG MSCWGGASPLLREFMKSITAMAGESVSTRGQIFARWRG HPCALPPSSSTSPRALSPGSSNKVTLDWGGSTTLFSGP KLGWYLGEFLGTQCVCAISTLGDPGDSSHSRGGERPSW GGCKRLGEPA* | 2711 | ATGAGCGTGACCTGTGTTGCCAACAGAGGAACAGCAAATACATTTTTATGATCCT GGGAGGTTCAGGCAGTCAGTTATGTGGATTTCGCGCAGAGGACGTGGCGGTGGAGAGGGAC AAGTCATGTCTCAGTTGTCCTGGGCAGGGGTCCAGGGGTCCTGAAAGAGGGGCCACTCTGCAATG GATTTGGGGGTCCCTGGGCAGGGGTCCTGCAGGGGGTCCAGGGGGAAGATTTTAGGAAGGGGA TGAGCTGCTGGGGGGGCATCTCCCTTACTGCGGGAAATGAAAGTATTACAGCT ATGGCTGGTGAGTGTCAGCAGGCCAGATCTTTGCCAGGTGGAGGGGACA CCCTTGTGCCCTACCCCAAGTTCCAGCACCTCTCCAAGAGCCCTTAGCCCGGAAG CAGCAACAAAGTGACATTGGGAGACTGGGGAGGAGGAAGGCAACAACTTTATTTCTGGCC CGAAGCTGGGTTGGTATTTGGGAGGGACTTCAGCCATTCCAGAGGAGGTGAAGAGACCGTCA CAACCCTGGGGGATCCAGGGGACTCTGGGAGCCTTCGRGRGAACCTGCCTGA | 2712 |
| | 1 | MGKPRLGLGIREPSPC* | 2713 | ATGGGGAAACCAAGGCTCGGGTTGGAATCAGGGAACCCTCACCTTGCTAG | 2714 |
| | 2 | MPPGEADGAQPDASWTRPTLPGHSPGLPALRTALVISHD GGGHINHHQGLGQRLKRPWAQGVPTSSLCPEGQPGTQ VRGFLSGRTPAALPVLGGS* | 2715 | ATGCCACCCGGGGCAGAGGCAGATGGCCCAGCTGATGCTTCGGACCCGCCCAC CCTGCCCGGGGCACAGTCCAAGGCTCCTGCCTCGAACGCACTTGTGATCAGTAT TGACGGTGGTGGGATAATCATTAACCACCACCACGCGGCTTGGGCTCAAGCGCTCAAAG GCCCCTGGGCCCAGGGTGTCCCAGGTGTCCAAGGCCAGCAGCCCGGCA CTCAGGTAAGAGAGGCTTCCTGGTAGGACCCCTGCCCGCCCTCCTGTCCTAGGAG GCTCCTGA | 2716 |
| | 3 | MGPSLMLPGPAPPCPGTVQGFLPFEPHL* | 2717 | ATGGGGCCCAGCTGATGCTTCCTGATGCTCCTGAACCGCACTTGTGA | 2718 |
| | 4 | MGWPGRAPSSLCLGFHCGIRGP* | 2719 | ATGGGGTGGCCGGGACGAGCCCTTCCTCTCTGTGCCTTGGTTCCACTGTGGATA AGGGGCCCTAG | 2720 |
| hsa-mir-194-2 | 1 | MDTQEAFSPGEKQGEGREDRRKLKFWGVLILGVFCHSGC FW* | 2721 | ATGGATACCAAGAAGCTTTTCCCAGGGAGAAACAAGGTGAGGCCGAGGA CAGGAGACTAAAGTTCTGGGGTGTTCTTATTTGGGGGTGTTTGTCACTCGGCTG CTTTTGGTGA | 2722 |
| | 2 | MSFAYSALSPQHLEVSLVNPQISPGFEGRNLERVWYLLL LLCGLREKRGRKGGFRL* | 2723 | ATGTCTTTTGCTTATAGTGCCCTCCACCCCAGATTCTAGAAGTTTCTTTAGTGAACC CCCAAATAAGCCCAGGATTTGAAGGAGAAACTTGAAAGGGTGTGGTATCTCCTTT TATTATTATGTGGCTTGAGCGGAGAAGAGAGAGAGAAAGGCCGTTTCAGACTCTGA | 2724 |
| | 3 | MWLEGEEREKRRFQTLNPNFLREHPLVWGKLEKNGVS LGQVGTPDQCSAVGTYARRGAGGVQGGDSCTLIF* | 2725 | ATGTGGCTTGAGGGAGGAGCACCCTTAGTTTGGGGGAAGTTGGAGAAAAATGGGTGTCCCT TGGCCAAGTGGAGCACCCCTGACCAGGGCAGTGCTGTTGGAACTGTGGCAAGGAGGG GTGCTGGTGGGGTACAAGGAGGTGATTCTTGCACCCGATTTTCTAG | 2726 |
| | 4 | MGTPLAKWAPLTRAVLLELWQGGVLVGYKEVILAP* | 2727 | ATGGGCTGTCCCTTGGCCAAGTGGCACCCTGACCAGGCAGTGCTGTTGGAACT GTGGCAAGGAGGGGTCTGGTGGGGTACAAGGAGGTGATTCTTGCACCCTGA | 2728 |
| hsa-mir-195 | 1 | MKHRK* | 2729 | ATGAAGCACCGAAAATGA | 2730 |
| | 2 | MIELKGEMDKSTHVRYFNSSHLVKSLVKSLCPFYRGKT EA* | 2731 | ATGATAGAATTGAAAGGAGAGATGGACAAATCCACAATTATAGTAAGATATTTCAA CAGTTCTCACTTGGTAAAAATCACTTGTAAAATCACTCTGCCCATTTTACAGAGGAAA AACTGAGGCCTAA | 2732 |
| | 3 | MPPGQPPAGRDWIVRGCPQSHAG* | 2733 | ATGCCCCCTGGACAACCACCACCTGCAGGAAGGCGACTGGATTGTGAGGGGTGTCCCA GTCCCATGCAGGGTGA | 2734 |
| | 4 | MQVEEAGSQG* | 2735 | ATGCAGGTTGAGGAGGAAGCAGGGTCTCAGGGTGA | 2736 |
| hsa-mir-196a-1 | 1 | MRQRRRAAVAVAGV* | 2737 | ATGAGGCAGCGTCGTCGGGCAGCTGTGGCGGTGGCGGGGGTCTAG | 2738 |

Figure 1 (Continued)

| | | | | |
|---|---|---|---|---|
| hsa-mir-196b | 2 | MEPPDGPFPPPQQQPPPPQPPQPQPAPQATSCSFAQNIKEE SSYCLYDSADKCPKVSATAAELAPFFRGPPFDGCALGTS SGVPVPGYFRLSQAYGTAKGYGSGGGAQQLGAGPFP AQPFGKGFDLPPALASGSADAARKERALDSPPPPTLACG SGGGSQGDEEAHASSSAAEELSPAPSESSKASPEKDSLG KQGCRGLQSGGQTGRHKEEKDQKTRSPRSSRPALAQA AGRLTL* | 2739 | ATGGAGCCGCCTGACGGCCCGCCGCCGCCGCCCCAGCAGCAGCCGCCGCCCCCGCC GCAACCACCCAGCCGCCTCAGCGCAGCAGCCCTCGTGCTCTTTGCGCAGAACATCAA AGAAGAGAGCTCCTACTGCCTCTACGACTCTGCTGACAAGTGCCCAAAGTCTGGC CACTGCGCCGCCTCCAAGGGCTCCATCGCCGCCGCTCCCGCCGCTGGCCGCCCT GGGCACCTCCAGGGACTTGGCTCCCAGTGCCAGCTGCGCGGCGCCACTCGGGCTACGG CACCGCCCAAGGGCTATGGAGCCCCCGGGGTCGCGGTTTCGATCTCCGCGCTAGCCTCCG GCTTCCCCGCGATGGCCGGGAGCGAAGAGCCGCGCGCCCACG CTGGCTTGCTGGCAGCGCGGGGAGCTCGAGGCGAGCGGCGCACCGTGTC CTGGCCGGGAGAGCTCTCCCGGCCCCTTGCGAGCAGCAGCCTGCGGG AGAAGGATTCCCTTGGGTAAGCAGGGCTGCAGAGGGCTGCAGTCAGGCGCAGAGACA GGCAGACACAAGGAGGAGAAGGATCAGAAAACTAGGAGCCCGCAGCAGCCGGC CGGCCTTGCCCAAGCTGCAGGCAGCCGCTGACCTTGTGA | 2740 |
| | 3 | MPQSLGHRRRTGSLPAGPAARRLRPGHLQRGASAWLLP PPSGLRHRQGLWQRRRRSAATRGWPVPRAAPGARFRSP ARASLRLGRCGPEGASPRFAAAPHAGLRQRRGLAGRRG GARVVLGRGGALPGPFREQQSLAGEGFPG* | 2741 | ATGCCCCAAAGTTCTGGCCACCGGCGCCGCAACTGCTCTCCGCGGGCCCTGC CCCGACGGCCACCGTGGGCACTGCCAGGCTATGGCAGGGCTGGCTACTTCCG CCTTTCTCAGGGCTACGGCACCGCCGTTCCCGGCCGCAGCCCCGGGCGCGGTTCGATCTCC AGCAACTCGGGGCTGGCCGTTCCCGGCCCGTCGCGGCGGGAGCGAAGGAGCGAGCCCTGAT CGCCCGCTAGCCTCGGCTCGGGCCGATGCGCCCGGAAGGAGGAAGGAGCCTCGAT TCGCGCCGCACGTCGGCTTGCGCCAGCGTGGGCGGGGCTCGCAGGGCACGA GGAGGCGCACGGTCGCGTCCTCGCCGCGAGGAGCTCTCCCCGGCCCCTTCGGAGA GCAGCAAAGCTCGCGGAAGGATTCCCGGTAA | 2742 |
| | 4 | MAAAAAARSNSGLARSPRSPRGAVSISRFR* | 2743 | ATGGCGGCCGCAGCGCGGCGGCGTTTCGATCTCCCGCCGCTAG CCCCGGGGCGCGGTTTCGATCTCCCGCCGCTAG | 2744 |
| | 1 | MVGSPALSGSMVEGHGLGGEHWALESRSRGKGSRWIQ RALGTAAPPPAHPSRPQFTHPFAHPSHPRHPRHPRHPR HPRHPRHPRHPRHPR2POLRPSPAPPSPPRPQPRPSPASHR PGGSLAFLPGWKRVKSATGVRVEQEGGRRRGGKDRWAP RGGGAACRGLPPPLDPV* | 2745 | ATGGTTGGGTCACTGCCTTGTCTGGCAGCATGGTGAGAAGGCATGGCTGGGCGG GGAGCACTGGGGACTGCAAGTCAAGTCGCAGCCCACCTCCCGCCCGCCATCCCG AGCCCCTACGCCCCATCCCGCCATCCCGCATCCCGCCATCCCCGCCATCCCGC CCCAGCCCAGCCCTCCATCCCGCCAGCCCAGCCCTCCAGCCCTCCGC CATCGCCTCGGAAGCTCCCATCCTGCCGGGTGGAAACGGTGTGTCTGCTACC GCGGTTCGTGTGGAACGCGGAAGGCAGAAGGCGGACGAGGTGAAAGAGGCTGGG CGCCCCGAGGAGCGGGAGCCCTCCGAAGGCCCTCAAGTTCAGAGGCAAAGGCAGC AGGTGGATCCAGCGAGCCCTAG | 2746 |
| | 2 | MAWAGSTGPWNQGPEAK AAGGSSEP* | 2747 | ATGACAATGTCTACCCAGCAGGAGGAGCCAGCAGGAGCCAGCAGCCACAGT TCCTGGAGATTCCGACACCAAGTGCAGCCACTGTCGCGGGCGTGAGTGC CCCACACGACCAGCTCCACGCGACCCAGCTGGCCACAGCCACTGGCCCCCTCCGTGAGG AGGAGAGAGGGCTTCGGGCAGCCTGAGGGCCTCACTCACTTCCTTGGT AGGTGGGGATGCCGCGGCCTCCGAGACTTGA | 2748 |
| hsa-mir-200a | 3 | MTMSYPAGGPGRNLWQPPVPGDSDTKCSHCAGPGVE WPHTDQLTPAGRATGPPPWRRREASGATRCAPGPLTSL VGGGCRPGPPET* | 2749 | ATGCCGGCCTCCAGGGACCTGTCCAGCGCTCCGCCCTGCCCCTGCAGCTCAGCGAGAG CGGGGGCCCTGCTGTCACGCCAGAGCGGCATCAGCCCTCACGGGCCACTCCGTTAGCAAT CCTCCCCCAGCTCGGGCTTAGGAGCTGCCAGCTCACGAGGACTCTCCAGCAGGCACCTGA GGGCCTGGGGCTTGGGGCCTGGGTAGGGACTGCCGTGGTCTCCCAGCAGCTACC CAGGTTCATCCAGGATGAAAGCAGGGAGTGGGAACCACGTGA | 2750 |
| | 4 | MPAWASRDLSPAPALAPRETCASERPRPPLPEPCTRAVR GPCCTPERASALSHSVSNPPPSSGPQNWPSTEL RGTRGP WGLGRDWPARGPPAAIPRFIQDESRAVGIT* | 2751 | ATGCCGGCCTGGGCCTCCAGGGACCTGTCCGCGCCGGCTCTCGCCCCTCGCGAGACTTGC GCTAGTGAGCGCCCTCGCCCACCCCTAGAGCCATGCACAGCCCTCAGCCACTCCGTTAGCAAT CCTCCCCCCAGCTCAGGGCCTAGGAACTGCCAGCACTGCAAACTCACGAGGCACCTGA GGGCCTGGGGCTTGGGGCCTGGGTAGGGACGCAAGGGCAGTGGGAACCACGTGA | 2752 |

Figure 1 (Continued)

| | | | | |
|---|---|---|---|---|
| | 1 | MVGSPALSGSMVEGHGLGGEHWALESRSRGKGSRWIQ RALGTAAPPPAHPSRPQPTHPIPAHPSHPRHPRHPRHPR HPRHPRHPRHPRHPRPQLRPSPAPPSPPRPQPRPSPASHR PGGSLAFLPGWKRVSATGVRVEQEGGRRGGKDRWAP RGGGAAGRGLPPPDPV* | 2753 | ATGGTGGGGTCACCTGCCTTGTCTGGCAGCATGGTAGAAGGGCATGGCCTGGGCGG GGAGCACTGGGCCTGGAATCAAGGTCAGAGGCAAAGGCAGCAGGTGGATCCAGC AGCCCTAGGGACTGCAGCCCCCACCCATCCCGCCCCATCCCGCCCATCCCG CCATCCCGCCATCCCGCCATCCCGCCATCCCGCCCATCCCGCCATCCCGCCATCCCG CCCAGCCCAGCCTCCATCCCGCCCCGCCGCCCCGCCCCGCCGCCCAGCTCGCC CATCGGCCTGGAGGCCTCCTGCGGCCTTCTGCCGGGGTGGAAACGGGTGTCTGCTACC GGGGTTCGTGTGAGCAGGAAGGGGAAGGCGACGAGGTGAAAGACCGCTGG CGCCCCGAGGAGCGGAGCTGCTGGGAGGGGCTCCCTCCCGCCGATCCTGTTTAA | 2754 |
| hsa-mir-200b | 2 | MAWAGSTGPWNQGPEAKAAGGSSEP* | 2755 | ATGGCCTGGGCGGGAGCACTGGGCCTGGAATCAAGGTCAGAGCAAAGGCAGC AGGTGGATCCAGCGAGCCCTAG | 2756 |
| | 3 | MTMSYPAGGPGRNLWQPPVPGDSDTKCSHCAGPGVE WPHTDQLTPAGRATGPPPWRRREASGATRCAPGPLTSL VGGGCRPGPPET* | 2757 | ATGACAATGTCTACCGAGGAGGACCAGGCCGAACCTTTGCAGCCACCAGT TCCTGAAGATTCCGACACCAAGTGCAGCCACTGTGCGGGCGGGTGTGGAGTGGC CCCACACCGACCAGCTCACGCCAGTGGCAGAGCCACTGGCCCCTCCGTGGAGG AGGAGAGAGCGCTCGGGCCACGTGCCTGGCCTGCCCAGGCCACTCACTTCCTTGGT AGGTGGGGGATGCCGGCCTGGCCTCCGAGACTGA | 2758 |
| | 4 | MPAWASRDLSPAPALAPRETCASERFRPLPEPCTRAVR GPCCTPERASALSHSVSNPPPSSGPQNWPSTELRGTRGP WGLGRDWPARGPPAAIPRFIQDESRAVGTT* | 2759 | ATGCCGGCCTGGGCCTCCCGGGACCTGAGCCCTGCCCTGCCCTGCCCTGAGAG ACCTGTGCCAGGAGCGTCCAGGCTCCCCTGAGCCTTGCACCCGGCGGTG CGGGGCCCTGCTGCACCCAGAGCGGGCATCAGCCCAGCCACTCCGTTAGCAAT CCTCCCCCCCAGCCTGGGCCTCAGAACTGGCCATCCACGGAGCTCAGAGGCACCGA GGGCCCTGGGCCTCGGGATAGGACTGGCCAGGGTCTCTCCAGCAGCCATACC CAGGTTCATCCAGATGAAAGCAGGGCAGTGGGAACCACGTGA | 2760 |
| | 1 | MDRLTT* | 2761 | ATGAGACAGACTCACAACGTGA | 2762 |
| | 2 | MAASPPPLPDPVVSPARPQAGPTLLLL* | 2763 | ATGGCCTGCATCCCCCCACTCTCCTGACCCTGTATAGCCCAGCCAGGCCCAG GCAGGCCAACCCTTCTCCTCTTGTAA | 2764 |
| | 3 | MGNCVCLRACLA* | 2765 | ATGGGTAACTGTGTGTGCCTCCGCGTGCCTCCGTGA | 2766 |
| hsa-mir-208c | 4 | MEGDHNRVVVKSTEMTADDKTGTVTHHTLAMCPGTK RLHTLVQSRHFCHSHFTVAETEGQKN* | 2767 | ATGGAGGGCGATCATAACAGGGTTGGTTGTGAAAAGCACCGAGATGACGGCTGACGA TAAGACGGGCACAGTTAGTTCAGTTCAGTTCAGGACGTTGCATGCCAGGCACTAAAAGACT ACACACGTTAGTTCAGTTCAGTTCAGGCACTTCGTCATTTCACCGTTGGCGAAACT GAGGGACAGAAAAACTAA | 2768 |
| | 1 | MHGGARATPAPPRLRAMARPRPRPVSRQRPRPRAHSV SSPGNGPARAPPIPSRLPATAPARAPPIPSRLLATAPPLPA PCPCPGHCPAPPPPCWARPRRPRAASTPGWTRSRSATHAP PGPGPQLWRWARVREVVESEGPPRQGPAPSAQEKRRM ARGAPPGCSLTPPFKSLGLRTPLRLCCIRLSLSDL* | 2769 | ATGCACGGAGGAGCCGCTACCCCGCCCGCCCGTCCTCCGGCAATGCCCG CCCGCCCCGCCCCGTCCTGGAGGGGCCCGCAACGGCCCGCCTCGTCTGCGGC AACGACGCGCCGGCCAAGCCCCCATCCCGTCTGCTGCCGCACCCGGCAGAACC TCTTCCGACCCGCCATGCCCCGGCCTCCGCGCCCCACCCGCCTGCTCAGC GGCTCGACCCGCCCCCGGCCCCCCGGGAACCCGCTGCTGCCGCTATGCCCCGG CACCCACGGCGCCGGCCTCGAGGGCCCCGAGGGCCTCGGCCCCCCGAGGAG AAGTCGTGAGTCGAGCGTGAGGGCTGCGCCTCCAGGCCCCAAGG AAGCGGCGAATGGCCCGCGTTGCCTCCGAACCCGCCTTCGCATCCGTCAGCT AGTCTGGGGCTGCGAACCCGCTTCGCATGCTGCTTCGCATCGGCCTTTCAGAT CTGTAG | 2770 |

Figure 1 (Continued)

| | | | | | |
|---|---|---|---|---|---|
| hsa-mir-202 | 2 | MPLSGPLPRTPPAMLGSTPAPRGLHAWLDALPLSHPRAAWPGTSAMAVGARPRSRGVRGAPAAGACALGPGEAANGPRRPSRLLADPPAQESGAANPASPLLHPTQPFFRSVGSGTPVSDYRAGLTAHTRRSTPPDAHVPSGHPLGASPWCQAGALASEEVASALGT* | 2771 | ATGCCCTTGTCCGGGCCACTGCCCGCCACCCCCCCGCCATGCTGGGCTCTGACCCCGGCCCCGCGCCCGCTCTCACGGCCTGTCGGACGGCCTCCCGCTCAGCCACCAACGGCCGCCTGGCCCGGACCTGCAGCTATGGCGGTGGGCGCGTCCGGAAGTCTGGAGTCCGAGGGGCCCCCGACCCCGGTTGCTCGCTGATCCGAACTCCGACTCAGCTTTCAGATCTGAGGATCCGCGAACCCCGCTTCGCCTTGCCATCGGACGGCGGGCTCACGGCCACACGCGCGCAGTACCCGACTCCAGTGTCCGACGTTCCCTCTGGCCACCCCTGGGAGCGTCCCCGTGGTGCCAGGCTGGGCGCGCTGCCGCGCTGGCCTGCTGCTCTGCTCTAGGCACCTGA | 2772 |
| | 3 | MRTPPLGTPWERPRGARLARWPLRRWLLL* | 2773 | ATGCGCACGTTCCCTCTGGGCACCCCTGGGAGCGTCCCCGTGGTGCCAGGCTGGCGCGCTGGCCTGCTGCTCTGCTCTAG | 2774 |
| | 4 | MGAASGWLLRGRALS* | 2775 | ATGGGTGCTGCCTCCGGGTGGCTGCTGCGAGGCGAGAGCCCTGAGCTGA | 2776 |
| hsa-mir-204 | 1 | MQRHFKNRRVFLLSLFQ* | 2777 | ATGCAGAGGCACTTAAGAACACGAGAGTCTTTCTGCTGAGCTCTTTCAATAA | 2778 |
| | 2 | MNVL* | 2779 | ATGAATGTTTTATGA | 2780 |
| | 3 | MFYDKKQVATKWKF* | 2781 | ATGTTTTATGATAAAAAAACAAGTAGCAACAAAATGAAAATTTTAA | 2782 |
| | 4 | MIKNK* | 2783 | ATGATAAAAAACAAGTAG | 2784 |
| hsa-mir-206 | 1 | MLFHFSVRRLR* | 2785 | ATGTTGTTCATTTTTCTGTGAGAAGCTAAGATGA | 2786 |
| | 2 | MRGKRDILGGVMEIGYWNCTGDWIPGPYP* | 2787 | ATGAGGGGCAAGAGAGACATACTGGGGGGAGTTATGGAGATTGGGTATTGGAACTGTACTGGAGATTGGATACCTGGACCATATCCTGA | 2788 |
| | 3 | MIKLMHGPEDAKAVHPESSNHYVNHPASLSRLSLM* | 2789 | ATGATAAAGTTGAACCATGGCCCAGAAGATGCAAAAGCCGTGCATCCTGAAAGTAACCACTATGTGAATCACCCAGCCAGTCTTAGCAAGGCTGTCCTGATGTGA | 2790 |
| | 4 | MAQKMQKQCIRKATTM* | 2791 | ATGGCCCAGAAGATGCAAAAGCAGTGCATCCGAAAGCAACCACTATGTGA | 2792 |
| hsa-mir-21 | 1 | MAWSQLTATSTSWVQAILRPQPPE* | 2793 | ATGGCGTGGTCTCAGCTCACTGCAACCTCCACTTCCTGGGTTCAAGCGATTCTTCCGGCCTCAGCCTCCCGAGTAG | 2794 |
| | 2 | MRRKVLNMQFFVFFFETEHSRCPGWSAMA* | 2795 | ATGAGAAGGAAAGTTCTTATAAATATGCAGTTTTTTGTTTTTTGAGACAGAGTTTCAACTCTGTTGCCCAGGCTGGAGTGCAATGGCATGA | 2796 |
| | 3 | MISAHCNLCLPGSSDSPASASLVVGHCMCHBAWLILYF* | 2797 | ATGATCTCGGCTCACTGCAACCTCTGCCTCCCAGGTTCAAGCGATTCTCCTGCCTCAGCCTCACTAGTGGGGATTCTGTGCATGTGCCACCACCTGGCTAATTTTGTATTTTAG | 2798 |
| | 4 | MSHCSRPHKFAVFKVALFVHHFIYTKHHFNYIYLIY* | 2799 | ATGAGCCACTGCTCCGGCCACATAAATTGCAGTTTCAGTTTCAAGGTCAACCTTTTGTCATATATTGTATACACAAAATACATATTTAATTATATATTAA | 2800 |
| hsa-mir-210 | 1 | MISFQDVSLNDICKDAFSR* | 2801 | ATGATCTCGTTTCAAGATGTTTCCCTTAATGACATCTGCAAAGATGCTTTCTCCCGATGA | 2802 |
| | 2 | MPPLMTSAKMLSPDEGTIFRKPGY* | 2803 | ATGTTTCCCTTAATGACATCTGCAAAGATGCTTTCTCCCGATGAGGGCACATTTAGGAAGCCTGGGTATTAG | 2804 |
| | 3 | MRAHLGSLGIRMWIYLLFGGGTIPLTTDAEKRCL* | 2805 | ATGAGGGCACATTTAGGAAGCCTGGGTATTAGGATGTGGATATCTTCTTTTTGGCGGAGGGCACCATCCACTCACTAGACAGATGCTGAGAAAAGGTGCTGTGA | 2806 |
| | 4 | MLRKGACEIGRTGRSGPTSAGHDRNTELPCPLAPSCPLV* | 2807 | ATGCTGAGAAAGGGCACGTGCCTGTGAAATTGGCAGGACTGGGGCAGGAGTGGGTTCACGTCAGCAGGCACGACAGGAACACAGAGCTGCCCTGTCCTTGCCCCTTCTTGTCCCCTAGTCTGA | 2808 |
| | 1 | MVAGACSPSYSGG* | 2809 | ATGGTTGCGGGTGCCTGTAGTCCAGCTACTCAGGAGCTGA | 2810 |
| hsa-mir-216a | 2 | MYSTREGRSKLIQPLQLQFHGADQWLMSLKLHMSLYCRKSTSKIFFFYEREVGHSLVLRIATQLHIGSPQ* | 2811 | ATGTACTCTACCAGAGAGGTAGGTCAAGCTGATTCAGCATTCAACTTCAATTCCATGGAGCAGATCAGTGGCTCATGTCACTGAAGTTAATTATTATGTCTCGTCTGCAAGAAAGAGCACCTCCAAAATTTCTTTTTTTATGAAAGAAGAAGTGGCATAAGTTTAGTTGTTAAGGATTGCAACCCAATTACATATAGGCAGCCCCAATGA | 2812 |

Figure 1 (Continued)

| | | | | |
|---|---|---|---|---|
| hsa-mir-217 | 3 | MFQJSGSCH* | 2813 | ATGGAGCAGATCAGHGGCTCATGTCACTGA | 2814 |
| | 4 | MKEKLA* | 2815 | ATGAAAGAGAAGTTGGCATAA | 2816 |
| | 1 | MVAGACSPSYSGG* | 2817 | ATGGTTGCGGGTGCCTGTAGTCAAGTGTCCAGCTACTCAGGAGCTGA | 2818 |
| | 2 | MYSTREGRSKLIQPLQLQFHGADQWLMSLKLHHMSLVCRKSTSKHFPFYEREVGISLVLRIATQLHGSPQ* | 2819 | ATGTACTTCACCAGAGAAGGTAGGTCAAGCTGATTCAGCGATTCAGCTTCAATTCCATGGAGCAGATCAGTGCTCATGCACTGCAAGTCACTGAAGTTAATTATTATGTCTCTGTCTGCAGAAAGAGCACCTCCAAAATTTCTTTTTTATGAAAGAGAAGTTGGCATAAGTTTAGTCTTAAGGATTGCAACCCAATTACATAT AGCCAGCCCCCAATGA | 2820 |
| | 3 | MFQJSGSCH* | 2821 | ATGGAGCAGATCAGHGGCTCATGTCACTGA | 2822 |
| | 4 | MKEKLA* | 2823 | ATGAAAGAGAAGTTGGCATAA | 2824 |
| | 1 | MLWDLE* | 2825 | ATGCTGTGGGACCTGGAGTAA | 2826 |
| hsa-mir-221 | 2 | MVLNTLAFPSKIPLGTDFPSLVLKPVDPC* | 2827 | ATGGTGCTTAACACACTTGCATTCCTTCCAAAATCCCTTTAGGAACAGAGACTTCTTCAGTTTAGTCCTAAAGCCTGTAGATCCATGCTAA | 2828 |
| | 3 | MLSDMTFFHIRLSKTLMMAVTVAYCAVTMFWTGTVVRALPASTHFSS* | 2829 | ATGCTAAGTGATATGACTTTTTTCACATCAGATTAAGCAAAACACTGATGATGGTGACTGTGCTTATTGTGCAGTTACCATGTTCTGGACAGGCACTGTGTAAGGGCTCTACCTGCATCGACCCATTTTTCCTCATGA | 2830 |
| | 4 | MTNYWCNYHAHFIDEHTEAQRGRGTYLGPLCHGTRJ* | 2831 | ATGACAAACTATTGGTGCAATTATCATGCCCATTTCATAGATGAACACACAGAGGCACAGAGAGGTAAAGGAACTTACTTAGGCCACTCATCGTCATGAACCAGAATCTA | 2832 |
| | 1 | MRACYPSPWVQSAWKSL* | 2833 | ATGAGAGCATGTATCTCAGCCGTGGGTTCAGATGCTGGAAGTCTTTAA | 2834 |
| hsa-mir-222 | 2 | MPAPILSPVCSFLHLSILSHKSFNIYLQIGERKDGSESPSGDGRGEAINSLYVPFTSLTASCI* | 2835 | ATGCCGGCCTTCAAACATCTACCTGCAAATAGGTGAAAGAAGATGGGAGTGAGAGTCCATCAGGGGACGGGAGGACCTGGAGGAGAAGCAATAAACTCACTCTATGTCCTTTCACCTCACTGACTGCATCTTGTATCTGA | 2836 |
| | 3 | MGVRVHQGTGEEKQ* | 2837 | ATGGGAGTGAGTCCATCAGGGACGGGAGGAGAAGCAATAA | 2838 |
| | 4 | MFLSPH* | 2839 | ATGTTCCTTTCACCTCACTGA | 2840 |
| | 1 | MAPFGLPRAQ* | 2841 | ATGGCCCCATTTGGCCTGCCCCAGGGCTCAATGA | 2842 |
| hsa-mir-23a | 2 | MRGELGHASCCSLLVPHGPSRYLCLSSPGAGTHGTARLQLPVWWLLHMRKELPCDQRKHLGTWRGGVPKSHYLLCSLSLSPLQVPASGPARCTPHPCATAGWGSWGWDLLPVTNHIARDFQPTLSSATEDAARGRGGREAPKPVPGLRSRA* | 2843 | ATGAGGGGAGAAGCTTGGCCATGCAAGTTGCTGTAGCCTCCTTGTCCCGCATGGCCCTCCAGTTATCTCCGTGGTGGCTCTGGGCTCTGGGCCTGGAACGAGGGCACAGTAGGCTCCAGCTCCGTGGTGGCTCTGGTCCTGCATATGAGAAAAGAGCTTCCTTGTGATCAAAGGAAGCATCGGGAGCCTGGGACCTGGAGGGGAGGGTGTCCCAAATCCATTACCTCTCTTGCTCTCTCTCTTCTTTCTCCCGGCACCCTCCAGGTGCAGCTCTGGGCCCCTCGAGGTGCCCCCTCACCACATTGCCAGGATTTCCAACCGACCTCGGATTCCTCCCTGTCCAGGGATTCGTCACCAAATCGACGGGGTGGCAGGAGACCTGTGGCCTGCGACCCTGGAGGAGCAGGGCTTAG | 2844 |
| | 3 | MQVAVASLSRMGPLGHSASPVLGLERRAQLGSSSPCGGSCI* | 2845 | ATGCAAGTTGCTGTAGCCTCCCTCGCATGGGCCTCTAGGTATCTCCGTGGTGGCTCTGGAAACGGAGGGCACAGTAGCTAGGCTCCAGCTCCGTGGTGGTGCCTCCTGCATATGA | 2846 |
| | 4 | MGFASCHKSHCQGPPTDPELCHRGCCPGTGWQRGPEACAWPEEGQLAACEQGPHQVFVTVAKPRPGPHLLWPCRLSPAAACLPAIHLPGLPGLCLPCLLS* | 2847 | ATGGGATTTGCTTCCTGTCACAAATCACATTGCCAGGGATTTCCAACCGACCTCGGCTCTGCCCTGAGGATGCTGCCGGGACAGGGTCAGAGAGGCCAGAGGCTGCTACCAAGCCTGTGCTTCACAGTCGCTAAGTTCGGCCCGCAGGGCCCTCCATCCGGCCTTGGCCCGCCTTGTTCACAGTGCTAAGTTCGCCCCGCAGGGCCCTCACTCGTCATCCGGCCATCCTGGCCTCTGCCGCTGTCCCTGTGCTGCCTACTGA | 2848 |
| hsa-mir-23b | 1 | MGTNGNLDPATRRLR* | 2849 | ATGGCACAAATGGAAACTTAGATCCTGCTACAAGAAGGTTACATTAA | 2850 |
| | 2 | MQVGVGVRGD* | 2851 | ATGCAGGTTGGCGGTGGGAGTGGGAGTTGGGGATTAA | 2852 |

Figure 1 (Continued)

| | | | | | |
|---|---|---|---|---|---|
| | 3 | MGASCAAALR* | 2853 | ATGGGAGCATCATGCGCAGCAGCACTCCGATAA | 2854 |
| | 4 | MRSSTPHLLYGRIA* | 2855 | ATGCGCAGCAGCACTCCGATAATTCTGTTGTATGGCAGAATAGCGTAA | 2856 |
| hsa-mir-24-1 | 1 | MGTNGNLDPATRRLH* | 2857 | ATGGGCACAAATGAAACTTAGATCCTGCTACAAGAAGGTTACATTAA | 2858 |
| | 2 | MQVGVGVRGD* | 2859 | ATGCAGGTGGGCGTGGAGTGAGGGGGATTAA | 2860 |
| | 3 | MGASCAAALR* | 2861 | ATGGGAGCATCATGCGCAGCAGCACTCCGATAA | 2862 |
| | 4 | MRSSTPHLLYGRIA* | 2863 | ATGCGCAGCAGCACTCCGATAATTCTGTTGTATGGCAGAATAGCGTAA | 2864 |
| | 1 | MAPFGLPRAQ* | 2865 | ATGGCCCCATTTGGCCTGCCCAGGGCTCAATGA | 2866 |
| | 2 | MRGFELGHASCCSLLVPHGPSRYLCLSSPGAGTHGTARLQLPVWWLLHMRKELPCDQRKHLGTWRGGVPKSHYLLCSLSLSPLQVPASGPARCPPHPCATAGWGSWGWDLLPVHMHARDFQPTLSSATEDAARGRGGREAPKPVPGLRSRA* | 2867 | ATGAGGGGGAGCTTGGCATGCAAGTTGCTGTAGCCTCCTTGTCCCGCATGGGCCCTCTAGGTATCCTGCCCTTCCAGTCCGTGTCTCAGGGCTCCTCAGTGCCAGCCCGTGTGGTGCTCTGCCATATGAAGGGCCGAGCTAGCCTCCCTGTTGGCATATGAGAACGGAGGCACAGCTAGGCTCAGTGATCAAAGGAAGCATCTGGGAGCCTGGAGGGAAGGGTCCCCAAATCTCATTACTCCTTTGCTCTCTCTCTTTCTCCCCCTCCAGGTGCAGCCTCTGCCCTCCAGCCTCTGCCCCCTCAACCCCTGTGCCACGGCCGGCTGGGGTTCCTGGGATGGAGTTGCTTCCTGTACAAATCACATTGCCAGGGATTTCCAACCGACCCTGAGCTGCCTGGCCTGCCACCGAGAGCGGCACCGGCTAGGGACGGGATGGGTCCACCAGAGGCCCGGGGCACGAGAGCGGCGGAGCTGCCTGAGAGGTGGCCCTGGACGCCGAGAGCGGCCCGAAGCCTGGTGTTGTGAGGAGGGATGTGGTGGGGTTGGCTGGCCAGCCCGTGATCCGAACCTCTGCAACCTGGGGACCCCGCATGGCCACAGCTCAGGCTGGGCTGTGGTGCCAGCATAG | 2868 |
| hsa-mir-24-2 | 3 | MQVAVASLSRMGPLGISASPVLGLERRAQLGSSSPCGGSCT* | 2869 | ATGCAAGTTGCTGGGGCTGGAAACGGACCTGAGCCTCCTCTGTCCCGCATGGGCCCTCTAGGTATCTGCCTCTCCAGTCCTGGGGCTGGAAACGGAGCACAGCTAGGCTCAGTGACCTCCCCGTGTGGTGGCTCCTGCATATGA | 2870 |
| | 4 | MGFASCHKSHCQGFPTDPELCHRGCCPGTGWQRGPEACAWPEEQGLAACEQGPHQVVFTVAKPRPGPHLLWPCRLSPAAACLPAHLPGLPGLCLPCLLS* | 2871 | ATGGGATTGCTTCTGTCACAAATCACATTGCCAGGGATTTCCAACCGACCCTGAGCTGCCTGGCCTGCCACCGAGGATGCTGCCCGGGGACGGGTGGCAGAGGGCCCGAAGCCTGGCACCAAGTCGTGCCAGGAGGTCCACCAAGTCGTGCCCTCGGCCTCCTGCCTCTGCCTGGCCTGCCGCCTCCCTGCTGCCTCCTGGGCTCTGCCTCCCGTGCTACTGAGCTGA | 2872 |
| | 1 | MLPGDGVAERPRSLCLA* | 2873 | ATGCTCCCGGGGACGGGGGTGGCAGAGAGGCCCGAAGCCTGTGCCTGGCCTGA | 2874 |
| | 2 | MLGAEMRTQNQTCVWRRDVVGGVGWAQMCAAGPDPQLCNWGPLHGHSSGWAVVPA* | 2875 | ATGCTTGAGCAGAGATGAGGACTCAGAATCAGACTGCGTGTGTGGAGGAGGGATGTGGTGGGGTTGGCTGGCCAGCCCGTGATCCGAACCTCTGCAACTGGGGACCCCTGCATGGCCACAGCTCAGGCTGGGCTGTGGTGCCAGCATAG | 2876 |
| hsa-mir-24-2 | 3 | MWWVGLAGPKCVLQALIPNSATGDPCMATAQAGLWCQHR* | 2877 | ATGTGGTGGGTGGGGTTGGCGGTTGGCTGGGCCAAATGTGTCTGCAGGCCTGATCCAACCTCTGCAACTGGGGACCCCTGCATGGCCACAGCTCAGGCTGGCTGTGGTGCCAGCATAGATAG | 2878 |
| | 4 | MPTPGFRYQAGLT* | 2879 | ATGCCAACTCCTGGCTTCCGGTATCAGGCTGGGTTGACCTGA | 2880 |
| | 1 | MRFVNYRDLQGWPLVNSDYYLFPHCHLGGPHAWRSQWPGLA* | 2881 | ATGAGGTTTGTGAACTATCGGGACCTACAGGGTTGGCCCTTGGTAAACAGTGATTATTATCTCTTCCCACACTGCCATCTTAGGTGGCCCTGCATGCCTGGCGGTCCCAATGGCCTGGTCTGGCCTGA | 2882 |
| hsa-mir-26a-1 | 2 | MPGGPNGLVWPDLPLK* | 2883 | ATGCCTGGCGGTCCCAATGGCCTGGTCTGGCCTGACCTGCCCTTTGAA | 2884 |
| | 3 | MAWSGLTCL* | 2885 | ATGGCCTGGTCTGGCCTGACCTGCCTTTGA | 2886 |
| | 4 | MRRLK* | 2887 | ATGAGAGCGCTGAAATGA | 2888 |
| | 1 | MAPFGLPRAQ* | 2889 | ATGGCCCCATTTGGCCTGCCCAGGGCTCAATGA | 2890 |

Figure 1 (Continued)

| | | | | | |
|---|---|---|---|---|---|
| hsa-mir-27a | 2 | MRGELGHASCCSLLVPHGPSRYLCLSSPGAGTEGTARL QLPVWWLLHMRKELPCDQRKHLGTWRGGVPKSHYLL CSLSLSPLQVPASGFARCPPHPCATAGWGSWGWDLLPV TNHIARDFQPTLSSATEDAARGRGREAPKPVPGLRSRA * | 2891 | ATGAGGGGGGAGCTTGGCCATGCAAGTTGCTGTAGCCTCCTTGTCCGCATGGCCC TCTAGGTATCTTGCCTCTCCAGTTGCTGGGCTGGCCTCCTCCGGGCTGGAACCGAGGGCACAGCTAGGCTC CAGCTCCCCGTGTGGTGGCTCCTGCATATGAAGAAAAGAGCTTCCCTGTGATCAAAGG AAGCATCTGGGGACTTGGACGGGAGGGTGTCCCAAATCTCATTACCTCCTTTGCTCT CCTCTCTTTTCTCCCCCAGGTGCCAGCCTGGGCCCCAGCCGGTGCCCCCTCACC CCTGTGCCACGCCGCCGCTGGGGTTCCTGGGATGGATTTGCTTCTGTCACAAATC ACATTGCCAGGGATTTCCAACGACCCTGAGCTCTGCACCTGAGCTGCCTGCCCCGG GACGGGGTTGCAGAGAGGCCCGAAGCCTGTCGTCCGCCTGAGGAGCAGGGCTTAG | 2892 |
| | 3 | MQVAVASLSRMGPLGISASPVLGLERRAQLGSSSPCGG SCI* | 2893 | ATGCAAGTTGCTGTAGCCTCCTTGTCCCGCATGGGCCCTCTAGGTATCTCTGCCTCTC CAGTTGCTGGGCTGGAACGGAGGGCACAGCTAGGCTCCCAGCTCCCAGCTCCCCGTGTGGTGGC TCCTGCATATGA | 2894 |
| | 4 | MGIASCHKSHCQGFFTBPELCHRGCCPGTGWQRGPEA CAWPEEQGLAACEQGPHQVVFFTVAKFRPPGPHLLWPC RLSPAAACLPAILLPGLPGLCLPCLLS* | 2895 | ATGGGATTGCTTCTGTCACAAATCACATTGCCAGGGATTTCCAACGACCCTGAG CTCTGCCACCGAGGATGCTGCCCGGGACGGGGTGGCAGAGGAGGGCCTGTGGCAGCCTG TGCCTGGCTGAGGAGCAGGGCTTAGCTGCTGTGAGGACCCTCACCAACAAGTCG CCAGGACAGGGGTCCCACTGGCCCCAGGTCCTCGGCCCTCCTGCCTTGCCGCCT GTCCCCTGCTGCCGCCTGTCTGCCATCCTGCTGCCTGCTGCCCCTGGGCTCTGC CTCCCGTGCTACTGAGCTGA | 2896 |
| | 1 | MGTNGNLDPATKRLH* | 2897 | ATGGGCACAAATTGAGATCTGCTACAAGAAGTTACATTAA | 2898 |
| | 2 | MQYGVGVRGD* | 2899 | ATGCAGTTGGGAGTGGGAGTGGAGTGAGTGGGATTAA | 2900 |
| | 3 | MGASCAAALR* | 2901 | ATGGGAGCATCATGCCAGCAGCACTCGATAA | 2902 |
| | 4 | MRSSTPHLLYGRIA* | 2903 | ATGCGCAGCAGCACTCCGATAATTCTGTTGTATGCAGAATAGCGTAA | 2904 |
| hsa-mir-27b | 1 | MWAPPPHACCPVISDPWRWDVYHGSAQSPTVFTPATS GMILPSPS* | 2905 | ATGTGGGCTCCACCCCACGCCTGCATCTCGATCCTGGCGGTGG GATGTCTACCATGGCTCTGCCACATGTCTTCACCCCTGCCACATCTGGCA TGATTTTACCGTCCCTTCCTAG | 2906 |
| | 2 | MSTMALPNPPLSSPLPHLA* | 2907 | ATGTCTACCATGGCTCTGCCAATCCTCCGCCACTGTCTTCACCCCTGCCACATCTGGCAT GA | 2908 |
| | 3 | MKFLLNNPSACPELIQSPMTIVLSTSRTHRSTFSVPENW TPFHS* | 2909 | ATGAAGCCTCTGAATAATCCATCAGCCTGCCCTGAGCTCATCCAGTCTCCAATG ACGATTGTGCTCCTGACCCACGAGCCACCGAGCACTTCTGTCCCTGAGAAT TGGACTCCATTCCACAGTTAG | 2910 |
| | 4 | MILRGLS* | 2911 | ATGATTTTAAGAGGTCTGTCTTGA | 2912 |
| hsa-mir-29b-1 | 1 | MWAPPPHACCPVISDPWRWDVYHGSAQSPTVFTPATS GMILPSPS* | 2913 | ATGTGGGCTCCACCCCACGCCTGCATCTCGATCCTGGCGGTGG GATGTCTACCATGGCTCTGCCACATGTCTTCACCCCTGCCACATCTGGCA TGATTTTACCGTCCCTTCCTAG | 2914 |
| | 2 | MSTMALPNPPLSSPLPHLA* | 2915 | ATGTCTACCATGGCTCTGCCAATCCTCCGCCACTGTCTTCACCCCTGCCACATCTGGCAT GA | 2916 |
| | 3 | MKFLLNNPSACPELIQSPMTIVLSTSRTHRSTFSVPENW TPFHS* | 2917 | ATGAAGCCTCTGAATAATCCATCAGCCTGCCCTGAGCTCATCCAGTCTCCAATG ACGATTGTGCTCCTGACCCACGAGCCACCGAGCACTTCTGTCCCTGAGAAT TGGACTCCATTCCACAGTTAG | 2918 |
| | 4 | MILRGLS* | 2919 | ATGATTTTAAGAGGTCTGTCTTGA | 2920 |
| hsa-mir-30b | 1 | MLWEQIRLFQAECRTRPKIKTVVAAELTFSEHLLNARC WANNLHSISFAAGNSQPYGAGLIAISHLQEGNRGS* | 2921 | ATGCTGTGGGAGCAGATAAGATTGTTCCAGGCAGAATGCAGGACAAGGCCAAAAT AAAAACTGTAGTGGCAGCAGAACTCACTTTCAGTGAACACTTACTAAATGCCAGCTG CTGGGCCAACAATTTACACAGCATCTCAATTTGCTGCAACAGCCAGCCTATGG GGCAGGTTTGATTGCAATCTCAATTTTGCAAGAAGGCAACAGGGGTTCATAA | 2922 |
| | 2 | MQDKAKNKNCSGSKTHFQ* | 2923 | ATGCAGGACAAGGCCAAGAACAAAATGTAGTGGCAGCAGAACTCACTTTCAGTGA | 2924 |

Figure 1 (Continued)

| | | | | |
|---|---|---|---|---|
| | 3 | MPGAGPTTYTASHLLATASPMGQV* | 2925 | ATGCCAGGTGCTGGCCAACAGCATTACACAGCATTCATTGCGCTGGCAACAGCCAGCCCTATGGGGCAGGTTGA | 2926 |
| | 4 | MNASPQSGSQSRRNQSLHFRSPYLPQHQKTTGPRTRSP* | 2927 | ATGAATGCTTCCCATATCTCCCACAGATCCAAAGTGGATCACAATCACGAAGAAACCAAAGCTTACACTTCCGTTCCCCATATCTCCCACAGATCCAAAGACCACGGGGCCCAGGAGCCCGGTCTCCATAG | 2928 |
| hsa-mir-30a | 1 | MCHRARLIFLFLFL* | 2929 | ATGTGCCACCGTGCCAGGCTAATATTTTATTTTATTTGTAA | 2930 |
| | 2 | MGSHFWAQAIPPQPPKVLGL* | 2931 | ATGGGGGTCTCACTCTGGCTCAAGCAATCTTCCTCAGCCTCCCAAAGTGCTGGGATTATAG | 2932 |
| | 3 | MGKGI* | 2933 | ATGGGTAAGGTATATGA | 2934 |
| | 4 | MNLFYFAACNPIPMPNPICIQYTNNGDKFFYRKLHKPVTDYCVCKYTQTIL* | 2935 | ATGAATCTCTTTATTTGCTTGCTGCAACCCAATTCCCATGCCAAACCCAATTGTATCCAAACAAACATATTGGAGACAAGTTCTATAGAAAGTTCATAAGCCAGTTACTGACTACTGTGTCTGTAAATATACTCAAACTATTTTGTAG | 2936 |
| hsa-mir-30b | 1 | MPLHL* | 2937 | ATGCCCCTAATAATTTTATAA | 2938 |
| | 2 | MNSQLIHEC* | 2939 | ATGAACAGCCAACTCATACATGAATGTTAG | 2940 |
| | 3 | MNVRETFCR* | 2941 | ATGAATGTTAGAGAAACTTTTGAGGTGA | 2942 |
| | 4 | MLFKLFVGDNMHK* | 2943 | ATGTTAGAGAAACTTTTGTAGGTGATAATATGCATAAATAG | 2944 |
| hsa-mir-30d | 1 | MPLHL* | 2945 | ATGCCCTAATAATTTTATAA | 2946 |
| | 2 | MNSQLIHEC* | 2947 | ATGAACAGCCAACTCATACATGAATGTTAG | 2948 |
| | 3 | MNVRETFCR* | 2949 | ATGAATGTTAGAGAAACTTTTGTAGGTGA | 2950 |
| | 4 | MLEKLFVGDNMHK* | 2951 | ATGTTAGAGAAACTTTTGTAGGTGATAATATGCATAAATAG | 2952 |
| hsa-mir-32 | 1 | MSQRAGLAEKCLSGLRHLPRSFTDTLPGVWDKLVNT* | 2953 | ATGAGCCAGCGTGCTGGCCTTGCTGAGAAATGTTGAGTGGACTGAGGCATTGCCAAGAAGTTCACAGATACTTATTTGAGTGGACTGAGGCAAACTGGTTAATACTTAA | 2954 |
| | 2 | MFEWTEAFAKKFHRYFIWSVGQITG* | 2955 | ATGTTTGAATGGACTGAGGCATTTGCCAAGAAGTTCACAGATACTTATTTGGAGTGTGGACAAACTGGTTAA | 2956 |
| | 3 | MTLWLSVATDFLFMTIFLIHST* | 2957 | ATGACTTTGTGGCTGTCAGTGGCAACTGACTTCTCTCTTTATGACCATCTTCTCTATACACAGCACATAA | 2958 |
| | 4 | MLHI* | 2959 | ATGTTGCACATTTGA | 2960 |
| hsa-mir-34a | 1 | MQNQTRNSPDLTRLIQHRGKF* | 2961 | ATGCAAAATCAAACAAGAAACTCCCCAGACCTCACTAGACTACATCAGACTACATAGAGG | 2962 |
| | 2 | MKAKCFITDAT* | 2963 | ATGAAAGCAAAGTGCTTTATCACTGATGCTACCTAA | 2964 |
| | 3 | MLPNSCHSTLLPGLCTFSNYFISCVYQVGPNIRAIHDEEPKPGKEVLPPN* | 2965 | ATGCTACCTAATAGTTGCCACAGCACCCTGCTCCCTGGTTTATGCACATTCTCGAATTATTTATCTCATGCGTCTACCAAGTTCCTAACATAAGGGCAATTTTATAGATGAGGAACCAAAGCCAAGGTCCAGGAAGTCCTATTTCCAAATTAG | 2966 |
| | 4 | MHILELFYLMRLPSRS* | 2967 | ATGCACATTCTGAATTATTTTATCCATGGTCTACCAAGTAGGTCCTAA | 2968 |
| hsa-mir-379 | 1 | MHREK* | 2969 | ATGCATAGAGAAAATAG | 2970 |
| | 2 | MNTCLEL* | 2971 | ATGAATACATGTCTGGAACTCTGA | 2972 |
| | 3 | MSGTLRPIRKSISSVSHDSIGRCQEYRLSLF* | 2973 | ATGTCTGGAACTCTGAGGCCCATCAGAAAGTCAATTCCTCTGTTCACATGATTCTATAGGTAGAATGTCAGGAATACAGACTCAGTTGTTTAG | 2974 |
| | 4 | MSGHQTQFVLGLCVLCIYILFYNWISENQ* | 2975 | ATGTCAGGAATACAGACTCAGTTTGTTCTTGGTGTGTTATGCATTTATATTTATTTTATAATTGGATCAGTGAGAATCAATAA | 2976 |
| hsa-mir-410 | 1 | MHREK* | 2977 | ATGCATAGAGAAAATAG | 2978 |
| | 2 | MNTCLEL* | 2979 | ATGAATACATGTCTGGAACTCTGA | 2980 |
| | 3 | MSGTLRPIRKSISSVSHDSIGRCQEYRLSLF* | 2981 | ATGTCTGGAACTCTGAGGCCCATCAGAAAGTCAATTCCTCTGTTCACATGATTCTATAGGTAGAATACAGACTCAGTTGTTTAG | 2982 |

Figure 1 (Continued)

| | | | | | |
|---|---|---|---|---|---|
| | 4 | MSGHQTQFVLGLCVLCTYLFYNWISENQ* | 2983 | ATGTCAGGAATACAGACTCAGTTGTTTGTGTCTTGTGTTATGCATTTATATTT TATTTTATAATTGGATCAGTGAGAATCAATAA | 2984 |
| hsa-mir-411 | 1 | MHRFK* | 2985 | ATGCATAGAATACATGTCTGAAACTCTGA | 2986 |
| | 2 | MNTCLEL* | 2987 | ATGAATACATGTCTGAACTCTGA | 2988 |
| | 3 | MSGTLRPIRKSISSVSHDSIGRCQEYRLSLF* | 2989 | ATGTCTGGAACTCTGAGGCCCATCGAGAAAGTCAATTTCCTGTTCACATGATTCT ATAGGTAGAATGTCAGGAATACAGAACTCAGTTGTTTAG | 2990 |
| | 4 | MSGHQTQFVLGLCVLCTYLFYNWISENQ* | 2991 | ATGTCAGGAATACAGACTCAGTTGTTTGTTAGGTCTTGTGTGTTATGCATTTATATTT TATTTTATAATTGGATCAGTGAGAATCAATAA | 2992 |
| hsa-mir-429 | 1 | MVGSPALSGSMVEGHGLLGGEHWALESRSRGKGSRWIQ RALGTIAAPPPAHPSRPQPTHPIPAHPSHPRHPRHPHPRHP HPRHPRHPRHPRHPRPQLRPSPAPPSSPPRPQPRPSPASHR PGGSLAFLPGWKRVSATGVRVEQEGGRRRGGKDRWAP RGGGAASGRGLPPPDPV* | 2993 | ATGGTGGGGTCACTTGCCTTGTCTGGCAGCATGGTAGAAGGGCATGGCCTGGGCGG GGAGCACTGGGCCTTGGAATCAAGGTCCAGAGGCCACACCGACCAGGCAGCCACC GAGCCCTAGGGACTGCAGCCCCTGCAGCCCATCCCGCAGCCCATCCCGCAGCCACC ATCCATCCCGCCCACCATCCCGCCCATCCCGCCATCCCGCCATCCCGCAGTCCGC CCATCCCGCCACCAGCCCTCCATCCCGGCCTTCCTGCCGCCGGCCAGCCCCTGCCTCC CATCCGGCCTCGAGGCTCCCTGGCTTGGAAACGGTGTCTGCTACC GGGTTCGTGTGAAGCACGAAGGGGAAGGCGACGAGGTGGAAAGACCGCTGGG CCCCCGAGGAGGCGGAGCTGCTGGGAGCGGGGCCTCCCTCCCCGATCCTGTTTAA | 2994 |
| | 2 | MAWAGSTGPWNQGPEAKAAGGSSEP* | 2995 | ATGGCCTGGGCTGGCGGAGCACTGCGCCCTGGAATCAAGGTCCAGAGGCAAAGGCAGC AGGTGGATCCAGCGAGCCCTAG | 2996 |
| | 3 | MTMSYPACGPGRNLWQPPYPGDSDTKCSHCAGPGVE WPHTDQLTPAGRATGPPPWRREASGATRCAPGPLTSL VGGGCRPGPPET* | 2997 | ATGACAATGTCCTACCCAGCAGGAGGACCAGGCCGGAACCTTGGCAGCCACCAGT TCCTGGAGATTCCGAACACCAAGTGCAGCCACTGTGCGGGGCCGGTGTGGAGTGGG CCCACCACCGACCAGCTCACGCCAGCTGGCAGAGCACTGGGCCCCTCCTGGAGG AGGAGAGAGGCCTGCAGCCGGCTGGGCCTCCGGGACTTGCT AGGTGGGGGATGCCGGGCCTGGGCCTCCGAGACTGA | 2998 |
| | 4 | MPAWASRDLSPAPALAPRETCASERPRPPLPEPCTRAVR GPCCTPERASALSHSVSNPPSSGPQNWPSTELRGTRGP WGLGRDWPARGPPAAIPRFIQDESRAVGTT* | 2999 | ATGCCGGCTGGGCTCGGAGCTCCAGCGCCTGAGCCTGCCCTTGCCCTGCCCAGAGAG ACCTGTGCAGCGAGCGTCCCAGAGCCTCCCTCCCTGAGCCTGCACCGGGCGGTG CGGGGCCCTGCCTGCAGGCTCAGCATCCAGCCCTCAGCCACTCCGTTAGCAAT CCTCCCCCAGAGCCTCCCAGGGCTCCAGCACTCAGCCCTCAGCGACCGTCAGAGGCACCCGA GGGCCCTGGGCTGGCTGGTAGGGACTGGCCAGCTCGGGGTCCTCCAGCAGCCATACC CAGGTTCATCATACTATAGAATAATATTATAA | 3000 |
| | 1 | MIYTHYL* | 3001 | ATGATATATACTCATTATAGAATAATATTATAA | 3002 |
| | 2 | MAFCFRSSFPC* | 3003 | ATGGCATTCTGCTTTATAAGCATTCTTTTCCCTGCTAA | 3004 |
| | 3 | MYYV* | 3005 | ATGTATTATGTTTAG | 3006 |
| hsa-mir-448 | 4 | MFRRAEVLFG* | 3007 | ATGTTTAGAAGGGCTGAAGTGTTATTTGGATGA | 3008 |
| | 1 | MHRN* | 3009 | ATGCATCGAAATTGA | 3010 |
| | 2 | MPFSDLKHSLYLYLHDPSCSVPRFSSKDKNVNKAIF* | 3011 | ATGCCTTTCTGACTTAAAACATTCCTGTACCTTATTACACGATCCAAGTTGCA GTGTCCTAGATTTTCCTCAAGGACAAAAATGTGAATAAAGCAATATTTAG | 3012 |
| hsa-mir-450a-1 | 3 | MCHMCGRLV* | 3013 | ATGTGCATCATGTGTGGGAGACTGTATAA | 3014 |
| | 4 | MLPPPRRHLSTIFSFFPQHMLFVSEEAACTWHCIKPIRQT WPLN* | 3015 | ATGTTACCACCTCCAAGGAGGACACCTTCCACTATTTTCTCCAACACA TGTTATTGTTAGTGAGGAAGCTGCGTGCACGTGGCATTGTATAAGTTATTAGAC AGACCTGGCCCTTAAACTAG | 3016 |
| | 1 | MHRN* | 3017 | ATGCATCGAAATTGA | 3018 |
| hsa-mir-450a-2 | 2 | MPFSDLKHSLYLYLHDPSCSVPRFSSKDKNVNKAIF* | 3019 | ATGCCCTTTCTGACTTAAAACATTCCTGTACCTTATTACACGATCCAAGTTGCA GTGTCCTAGATTTTCCTCAAGGACAAAAATGTGAATAAAGCAATATTTAG | 3020 |
| | 3 | MCHMCGRLV* | 3021 | ATGTGCATCATAATGTGTGGGAGACTGTATAA | 3022 |

Figure 1 (Continued)

| | | | | | |
|---|---|---|---|---|---|
| | 4 | MLPPPRRHLSTFSFFPQHMLFVSEEAACTWHCIKFIRQTWPLN* | 3023 | ATGTTACCACCTCCAAGGAGGCACCTTTCCACTATTTTCTCATTTTTCCCAACACATGTTATTTGTTAGTGAGGAAGCTGCGTGCACGTGGCATTGTATAAAGTTTATTAGACAGACGTGGCCCTTAAACTAG | 3024 |
| hsa-mir-450b | 1 | MHRN* | 3025 | ATGCATCGAAATTGA | 3026 |
| | 2 | MPFSDLKHSLYLYLHDPSCSVPRFSSK.DKNVNKAIF* | 3027 | ATGCCCTTTCTGACTTAAAACATTCCTTGTACCTTATTTACACGATCCAAGTTGCAGTGTGCCTAGATTTTCCTCCAAGGACAAAATGTGAATAAAGCAATATTTTAG | 3028 |
| | 3 | MCHMCGRLV* | 3029 | ATGTGCATCATAATGTGTGCGGAGACTTGTATAA | 3030 |
| | 4 | MLPPPRRHLSTFSFFPQHMLFVSEEAACTWHCIKFIRQTWPLN* | 3031 | ATGTTACCACCTCCAAGGAGGCACCTTTCCACTATTTTCTCCAACACATGTTATTTGTTAGTGAGGAAGCTGCGTGCACGTGGCATTGTATAAAGTTTATTAGACAGACGTGGCCCTTAAACTAG | 3032 |
| | 1 | MRFTFTSRCLALFLLLNVSKTKVFKAMLMKNAE* | 3033 | ATGAGGTTCACATTTACAAGCCGGTGCTTGGCACTGTTCTTCTTCTAAATGTAAGTAAAACAAAAGTATTCAAAGCCATGCTAATGAAGAATGCTGAATAA | 3034 |
| hsa-mir-489 | 2 | MLNKEECFECDLISICKGRHWSPEAETKFLKAHLLNILLTNLSSELSLI* | 3035 | ATGCTGAATAAGGAGGAATGTTTTGAGTGTGATTTAATTAGTATTTGCAAGGTAGGCATTGGTCTCCAGAAGCCGAAACTAGTTCCTCAAAGCCATTATTTTGTTAATATTTTGTTAACAAATCTCCCTGAACTGTCTAATTTAA | 3036 |
| | 3 | MFSC* | 3037 | ATGTTTTCATGTGA | 3038 |
| | 4 | MLKKLCFES* | 3039 | ATGTTGAAAAAACTATGTTTGAATCTAG | 3040 |
| | 1 | MGNQILPTNEKQNFLSTH* | 3041 | ATGGGGAACCAAATTCTTCCTACAAATGAAGAAAACAGAACTTCTTGTCTACACATTAA | 3042 |
| | 2 | MRNRTSCLHKMTLET* | 3043 | ATGAGAAACAGAACTTCTTGTCTCAGCAGACTTTTTAATGACTTCAACCAAGTGA | 3044 |
| | 3 | MSRSGSRPFSTK* | 3045 | ATGTCAAGATCTGGCAGCAGACTTTTCTACACCTTAG | 3046 |
| hsa-mir-491 | 4 | MRPRHLFPYPYFFLRVPQGILETTKSDIFRVICLNSFILRKISILSSTTGHPLRFTSLSSPFSAGSFQRVSSWLLSVCYSLLTWEPLPRPTRKYMPIQ* | 3047 | ATGAGGCCCAGGCACTGTTTCTGTTTTTGATATTTTAGAGTATAATTGTCTTAACTTGTCTTAAAATTCCAACAACTAAGTCAGATATTTTCCTAAGGGTGCCCAGGTTAAAATTCCATTCTGTCATCCAACGGAATTCCACTCCGTCATCCAGTCTCCTGTTTTTTTTCGCTGGCTGTTCATCGTGGCTGCTGTCTGTCTGTTACAGCCTTCTCACGTGGCGAGCCCTGCCCCGCCCCACAGAAAATACATGTTTATCATTCAGTAA | 3048 |
| | 1 | MDTQEAFSPGFKQGEGREDRRLKFWGVLILGVFCHSGCFW* | 3049 | ATGGATACCCAAGAAGCTTTTTCCCAGGGGAGAAACAAGGTGAGGRCCGTGAGGACAGGAGACTAAAGTTCTGGGGTGTCTTATTTGGGGGTGTTTTGTCACTCTGGCTGCTTTTTGGTGA | 3050 |
| hsa-mir-497 | 2 | MSPAYSALSPQJLEVSLVMPQISPGFEGRNLERVWYLLLLCGLREKRGRKGGFRL* | 3051 | ATGTCTTTTTGCTTATAGTGCCCTCTCACCCGACAGATTCTCAAGGGAGAAACTTGAAGGGAGAAGGTGTAGTCTCCTTTTATTATTATGTGGCTTGAGGGAGAGAGAGGGAGAAAAGGCGGTTTCAGACTCTGA | 3052 |
| | 3 | MWLEGEEREKRFQTLNPNFLREHPLVWGKLEKNGVSLGQVGTPDQGSAVGTYARRGAGVQGGIDSCTLIF* | 3053 | ATGTGGCTTGAGGGAGAAGAGAGAGGGAGAAAAGGCGGTTTCAGACTCTGAATCCAATTTCTTAAGGGAGGAACCCTTAGTTTGGGAAGTTGGAAGTTGAGAAAAATGGGGTGTCCTTGGCCAAGTGGGCACCCCTGCCAAGGCCAGTCTGTTGGAACTGTGCCAAGGAGGGGTGTCGGTGGGGTACAAGGAGGTGATTCTTGCACCCTGATTTCTAG | 3054 |
| | 4 | MGCPLAKWAPLTRAVLLELWQQGVLVGYKEVILAP* | 3055 | ATGGGGTGTCCTTGGCCAAGTGGGCACCCTGACCAGGGTGCTGTTGGAACTGTGGCAAGGAGGGTGCTGGTGGGGTACAAGGAGGTGATTCTTGCACCCTGA | 3056 |
| | 1 | MGFSLJAE* | 3057 | ATGGGCTCTCGTTGATCGCAGAATGA | 3058 |
| hsa-mir-505 | 2 | MKPKLRNMPLKSFRP* | 3059 | ATGAAGTTCAAACTTGTAACATGTTTTGAAGATTTAGATTTTAG | 3060 |
| | 3 | MQCRSPLFL* | 3061 | ATGCAATGCGCTCTCCCTATTTCTCTAG | 3062 |
| | 4 | MSLSPISLAL* | 3063 | ATGTCGCTCTCCCTATTTCTCTAGCACTTTGA | 3064 |
| | 1 | MHRN* | 3065 | ATGCATCGAAATTGA | 3066 |

Figure 1 (Continued)

| | | | | | |
|---|---|---|---|---|---|
| hsa-mir-542 | 2 | MPFSDLKHSLYLYLHDPSCSVPRFSSKDKNVNKAH* | 3067 | ATGCCCTTTCTGACTTAAAACATTCTGACCTTTATTACACGATCCAAGTTGCAGTGTGCCTAGATTTCCTCAAGGACAAAAATGTGAATAAAGCAATATTTTAG | 3068 |
| | 3 | MCHMCGRLY* | 3069 | ATGTGCATCATATGTGTGGGAGACTTGTATA | 3070 |
| | 4 | MLPPPRRHLSTHFSFFPQHMLFVSEEAACTWHCIKFIRQTWPLN* | 3071 | ATGTTACCACCTCCAAGGAGGCACCTTCCACTATTTCTCACTATTTTCCCAACACATGTTATTTGTTAGTGAGGAAGCTGCTGCCACGTGGCATTGTATAAAGTTTATTAGACAGACGTGGCCCTTAAACTAG | 3072 |
| hsa-mir-653 | 1 | MRFTFTSRCLALFLLNVSKTKVFKAMLMKNAE* | 3073 | ATGAGGTTCACAATTTCAAGCACGGTTGCTTGGCACTGTTCTTCTTCTCTAAATGTAAGTAAAACAAAAGTATTCAAAGCCATGCTAATGAAGAATGCTGAATAA | 3074 |
| | 2 | MLNKEECFECDLISICKGRHWSPEAETKFLKAHLNHLLTNLSSHLSLI* | 3075 | ATGCTGAATAAGGAAGAATGTTTTGAGTGTGATTTAATTAGTATTTGCAAGGTAGGCATTGGTCTCCAGAAGCCGAAACTAAGTTCCTCAAAGCCATTATTTTGCTTAATATTTTGTTAACAAATCTCCTCTGAACTGTCTCTAATTTAA | 3076 |
| | 3 | MFSC* | 3077 | ATGTTTTCATGTTGA | 3078 |
| | 4 | MLKKLCFES* | 3079 | ATGTTGAAAAACTATGTTTGAATCTTAG | 3080 |
| hsa-mir-656 | 1 | MHREK* | 3081 | ATGCATAGAGAAAAATAG | 3082 |
| | 2 | MNTCLEL* | 3083 | ATGAATACATGTCTGAACTCTGA | 3084 |
| | 3 | MSGTLRPHRKSISSVSHDSIGRCQEYRLSLF* | 3085 | ATGTCTGGAACTCTGAGGCCCATCAGAAAGTCAATTCCTCTGTTCACATGATTCTATAGGTAGATGTCAGGAATACAGACTCAGTTTGTTTAG | 3086 |
| | 4 | MSCIQTQFVLGLCVLCTYILFPYNWISENQ* | 3087 | ATGTCAGGAATACAGACTCAGTTTGTTTAGGTCTTTGTGTTATGCATTTATATTTTATTTTATAATTGGATCAGTGAGAATCAATAA | 3088 |
| hsa-mir-7-1 | 1 | MNLLLH* | 3089 | ATGAACTTACTGCTCATTATTAA | 3090 |
| | 2 | MCGVVAHMVILVDLLLHK* | 3091 | ATGCAGGGGGTCGTGGCTCATATGGTCGATCTTGGTGGACCTATTATTACTACAAGTAA | 3092 |
| | 3 | MIBPPCIFPNSEGFNKNTHLGLRLC* | 3093 | ATGATTATTCCTCCTTTCTGTATATTTTTAATTCAGAAGGTTTTAACAAAATACACATTTAGGATTGAGGTTATGTTATA | 3094 |
| | 4 | MLMGHFSELGFQLFESCQVISAINKSS* | 3095 | ATGTTAAATGGCTTTAGTGAGCTGGGTTTCAGCTGTTTGAGTCTGTCAAGTGATCAGTGCTATTAATAAAAGTAGTTAA | 3096 |
| hsa-mir-96 | 1 | MALREGRAGPGAGGGKITLLESFSVHSVEPPRSRAGAAGPPSSRAVRAARAPCSSGPRAQVPLWTSPACSAEAAPLQVAGPGPSPADLSPDTQEARGRVPAPLCSPAGLGAPAPPPLAGQRRFGPGPGALQAPSMRLFPNRGRFCLASLVWTPRGAERRLCAQPGAGAGECLGPGAGGRAGRSQSGAQ* | 3097 | ATGGCGCTGCGTGCGAGGGAGGGCGTGCAGGTCCATTCTCGTGCACTCGTCGAGCCCGAGCGTCGGAGCGAGGGCCCCCCGTCTTCCGGTCCTCGGGCCCAGTACCCCTCTGACCTCCCCGGCAGCCCCGGCCAGACCTGCACCCAGGAAGCGAGGCCCGGGGCTCGCCGGGTCCGCGGGTCCCCCCTTGTTCCCGGCTCGGCTCGGCCCCGGCTCGGCGCGTCCTGCGCGGGCCTCGGGTGGGCCCCGGGCAGCCCCGGCCCGCCGCTTCCCCCCTTTGCCTGGCCGTTTTGCCTGCCCTTGGCCCTCCAAGCTCGGTCCATGCCCCGCTCTTCCAACCGGGCGTTTTGCCTGGCCGCCTCAGGCCGCGGGCTCCTCGGTGTGACTCCGGCGCCGCGCTGACTCCAAGGCCGTGGCTGAGCGCAGTGAGTGTCTGGGCGCGGAGCGGCGCGCGCGCCCGAGCCAGAGCGGGGGCTCAGTAG | 3098 |
| | 2 | MTRQCLLALPRLQAEAPTGRLGPGSASGVCPAPSAVPGRGRGRERLRSEGRCLRGAYPRGVWLGSGCVSPPWWAQAEAPGWEGAAESAGAPELAPPASCQGCAAGSRLLFWPGAAPPSLWGKAALRPPVCLHFAATHPGNPGARE* | 3099 | ATGACGCAGTGCCTACTGGCTGCCCCTTCCGCGCCTCCAGCGCGAGGCGCCACCGGGCGGCCTGGGTCCGGGCTCGCCAGTGCGTCTGCCCAGCGCCTCTCCCGGAGTGCGGGGCGCGGGGAGCGCGGAGCGCGGGAGCCCTGAGTGCCGCTACCGCGCGGAGGAGTTGCGCTGGGAGGAGGCGCAGGTCGCAGGGTCAGCTCGGGTCGGGGAGCCCGAGCCAGGCGGAAGCGCCAGGCGCGGGACCCTCCTCCGGAAGCGGCAAGCTCGCAGGGGAGGGAGCCCACCGAGGGCGCCCCCACCGGCCGGGGGAAGCGCGGGTCCAGAGCCCCACTTCGCCGCCGCACCCACCCCCGGGAAGCGGCAAGCGCCAAGCCAAAGCGGGCCGTTGCGCTGTCTGCCTAAGCGGGGCCGCGGGGAAGCGCGACCCCGGCCGCACGGCGAATGA | 3100 |

Figure 1 (Continued)

| | | Protein | | Nucleotide | |
|---|---|---|---|---|---|
| | 3 | MRHRSPPSTAPPLLIALVAPRFPALPQDRRLDGLPLAPH RSAHPRTMGSEGVTRGQGSPDSTVSSRLSHSFALPTRAP GHRVQ* | 3101 | ATGAGAGACACCGTTCCCGCCCTCAACTGCCCATTCCTGTTAATAGCGCTAGTGGCA CCCAGGTTCCCAGCCCTTCCCAGACCTTCCCAAGATCGGGCGGTCTTGCCGGGCCT CACCGGTCAGCGCCATCCAGGAGTATGGGCAGTGAGGCAGTGAGGCAGTGAGGCAGTGGTGTCACCGGGTCAGGG GTCGCCCGATTCCACGGTGTCCTCCAGGCTGAGCCAATCGTTTGCTCTTCCAACCCG GCTCCCGGACACGTGTACAGTAA | 3102 |
| | 4 | MGHESADL* | 3103 | ATGGGACACGAGTCGGCGATCTGA | 3104 |
| hsa-mir-99a | 1 | MGYTSVSFTDVLLCLSEGLAHTRT* | 3105 | ATGGGAGTCACATCAGTTTCTTTCACTGATGTTCTCCTATGCCTATCAGAAGGCCTG GCACATACTAGACTTAA | 3106 |
| | 2 | MFSYAYQKAWHILGLNK* | 3107 | ATGTTCTCCTATGCCTATCAGAAGGCCTGGCACATACTAGGACTTAATAAATAA | 3108 |
| | 3 | MPHRRPGTY* | 3109 | ATGCCTATCAGAAGGCCTGGCACATACTAG | 3110 |
| | 4 | MRTGNLNFYVNECVICFLVLLNHGA* | 3111 | ATGAGAACTGGAAATTTAAATTTTATGTCAATGAATGTCATCTGCTTCTTTGTT TGCTGAATCATGGGCTTAA | 3112 |
| hsa-mir-99b | 1 | MPLHSSLGNPSQK* | 3113 | ATGCCACTGCACTCCAGCCTGGCAATCCGTCTCAAAATAA | 3114 |
| | 2 | MHNH* | 3115 | ATGCATAACCATTAG | 3116 |
| | 3 | MNTMEYYHTKMNEEVL* | 3117 | ATGAATACAATGGAATATTATCACTATTAAAATGAATGAGGAGGTTCTATAA | 3118 |
| | 4 | MRRFYKPRYGRIFGYHVKKKKKTKVQNNVILSGDRKEE GGIYVHRCIKFLWKDT* | 3119 | ATGAGGAGGTTCTATAAGCCTAGATATGGGAGGATCTTTGGATATCATGTAAAAAA AAAAAAAAAACCAAGGTGCAGAATAATGTGATCCTATCAGGGGACAAGAAAGAGG AGGTGGTATATATGTGCATAGATGTATAAAATTCCTCTGGAAAGATACATAA | 3120 |
| | 1 | ATGCTCCCAGGTGA | 3121 | ATGCTCCCAGGTGA | 3122 |
| hsa-let-7a-2 | 2 | MVRTIMPPGLFSL* | 3123 | ATGGTTGAGAACGATCATGAATTCTCCAGGCTTTCTCCTATGA | 3124 |
| | 3 | MKGKIGVDYFMVF* | 3125 | ATGAAAGGTAAGATTGGGTACGATTATTTATGGTATTTAG | 3126 |
| | 4 | MLYFHILFPRVRFCFFKNVRL* | 3127 | ATGCTGTATTTTCATATTCTGTTTCCTCGGGTTAGATTTGTTTAAGAAAATGTGA GGCTTTTA | 3128 |
| | 1 | MFLNKCKNNF* | 3129 | ATGTTTCTAAACAAGTGTAAAATAATTTTAA | 3130 |
| hsa-let-7c | 2 | MLLKNSASNENYNLFHTKN* | 3131 | ATGCTTTTGAAAAATTCAGCAAGTATCATGAAAACTATAATTGCATACTAAGAAT TGA | 3132 |
| | 3 | MKTHCLRIDVHR* | 3133 | ATGAAAACTCATAATTGCATACTAAGAATTGACGTTATAATATTCGTAA | 3134 |
| | 4 | MLLKSYFLHLQCRVNREKCRTD* | 3135 | ATGCTTTTAAAATCATATTTCTTATTACAATATGTAGGTAAACAATGAAAAA TGTAGAAACTGATTAA | 3136 |
| hsa-let-7f-2 | 1 | MEYKCMSLKMWRNWNLRTLLARKQTGAAIVEKVGWPF KKLNEILLYNPAMSTLRYMSPKTESRGSTICTLMFIAALF TIAKRWKQSKVPLTDEWINKRWYIHTMEYH* | 3137 | ATGGAATATAAATGTATGTCGTTGAAGATGTGGAGAAATTGGAACCTTGGTTCTTCCTG GCAAGAAAGCAACATAGAATTACTGTATAATCCAGCAAATTCCACTCTTACGTATATGTCCCC CAAAACTGAAAGCAGGGGCTCAACTATTTGTACACTCATGTTTATAGCAGCATTATT CACAATAGCCAAAAGGTGGAAACAATCTAAATATCCGCTAACAGATGAATGGATAA ACAAAGGTGGTATATACATAACGATGGAATATCATTGA | 3138 |
| | 2 | MDKQKVVYTYDGISLSSKTE* | 3139 | ATGGATAAACAAAGGTGGTATATACATAACGATGGAATATCATTGAGCAGCAAAAC AGAATGA | 3140 |
| | 3 | MLQHG* | 3141 | ATGCTACAACATGGATGA | 3142 |
| | 4 | MDEGQRHCAN* | 3143 | ATGGATGAAGGTCAAGACATTGTCTAACTGA | 3144 |
| | 1 | MLSL* | 3145 | ATGCTTTCTTTGA | 3146 |
| hsa-let-7i | 2 | MNLISYYF* | 3147 | ATGAATTAATTAATCTCAGTTATTTTAA | 3148 |
| | 3 | MGSLELCAVC* | 3149 | ATGGGTAGCCTTGAATTATGTGCCGTTTGTGA | 3150 |
| | 4 | MCRLLKGL* | 3151 | ATGTGCCGTTTGCTGAAAGGTCTTTAG | 3152 |
| | 1 | MYVCVCVCVCVRERERERDRERERKS* | 3153 | ATGTATGTGTGTGTGTGTGTGTGTGTGTGAGAGAGAGAGAGAGAGAGA GAGAGACAGAGAGAGAGAGAGAAGAGTTAG | 3154 |

Figure 1 (Continued)

| | | | | | |
|---|---|---|---|---|---|
| hsa-mir-100 | 2 | MYVCVCVCV* | 3155 | ATGTATGTGTGTGTGTGTGTGTGTGTGTGA | 3156 |
| | 3 | MCVCVCVCVCERERERERQREREKELGG* | 3157 | ATGTGTGTGTGTGTGTGTGTGTGTGTGAGAGAGAGAGAGAGAGAGACA GAGAGAGAGAGAAAGAGAGTTAGGAGGTTGA | 3158 |
| | 4 | MWKSIDMESPRWRNADLLGEMQRDRGV* | 3159 | ATGTGGAAATCAATAGACATGGAGAGCCCTAGGTGGAGAAACGTGACCTGCTGGG TGAAATGCAGAGAGACAGGGGTGTGTGA | 3160 |
| hsa-mir-10b | 1 | MIQI* | 3161 | ATGATCCAGATCTAA | 3162 |
| | 2 | MCDNFFTQNVKAHFHYP* | 3163 | ATGTGTGACAATTTTTCATTACCCAGAATGTAAAGCAATCATATATTTCATTATC CTTAA | 3164 |
| | 3 | MLKQS* | 3165 | ATGTTAAAGCAATCATAA | 3166 |
| | 4 | MKIRGTIGK* | 3167 | ATGAAAATAAGAGGGACTATATAGGAAAATGA | 3168 |
| hsa-mir-1-1 | 1 | MDTGSREAAFTRDLPRKPADAQVSPQDTSRVSGLQFLV WPQEQGVVQLPEKEEAGPASSGVLGRAPPKVPLSTQPSL GLAGMR* | 3169 | ATGGATACGGGGTCCCGGGAGGCAGCCTTCACCAGGGACCTGCCCAGGAAACCAGC AGATGCCCAGGTAAGCCCCAGGACCACTCTCGGTCTCGTCTGCAGTTCCTCGT CTGGCCTCAGGAGCAAGGAGTTGTCCAGCTCCCGGAGAGGAGGAGGCTGGTCTG CGAGTGGGGTGTCTGGGCAGGGCGCCCCCAAGGTTCCTCTCCACCCAGCCTCTC TGGGCTTGGCTGGGATGAGGTGA | 3170 |
| | 2 | MEDASLLWGEGGGAACLFHGRKTELLLGPGTGARDFL GLTVHFCLSGSCECVRQTERIDGFRIDGGAPRSEGGRESW APGGGWTPGSSGRKAVLLTQRGLRQ* | 3171 | ATGGATGATGCCTCCCTGCTCTGGGGTGAGGGTGGAGGGGCAGCCTGTCTCTTCAT GGACGCAAAACCGAGCTACTGCTGGGGCCAGGGACAGGGCGCTCGAGACTTTCTGGG GCTCACTGTCCACTTCTGCCTTTCTGATCCTGTGTGAGACAGAGAG AGATGGATTCAGGATATGAGAGGATCGCCAGGGGGTCAGAGGGGCAGGGAGTCCTGG GCCCCTGGGGGTGGCTGGCACCAGGCAGGAAGGCTGTCCTGCTCAC ACAGAGAGGGCTCCGGCAGTGA | 3172 |
| | 3 | MMPPCSGVRVEGQPVSSMDAKPSYCWGQQALETFW GSLSTSAFLDRVSV* | 3173 | ATGATGCCTCCCCTGCTCTGGGGTGAGGGTCAGGACGACAGGCGCTCGAGACTTTCTGGG GCAAAACCGAGCTACTGCTGGGGCCAGGACAGGCGCTCGAGACTTTCTGGGGCTC ACTGTCCACTTCTGCCTTTCTGATCGTGTGAGTGTGA | 3174 |
| | 4 | MDSEMEGRRGQKGAGSPGPLGVAGHQAAVAGRL8C3 HREGSGSRLQGRSYTASELPSLHRSGVSFYRGGYPGSW NCMQTACLGNILLYMPIWTC* | 3175 | ATGGATTCAGGATGGAGGCGCAGGGTCAGAAGGGGCAGGAGTCCTGGC CCTGGGCTGGCTGGACACCAGGCACAGTGGCAGGACAACTGCCTCTGAGCTGCC AGAGAGGGTCCGGCAGTAGACTCCAGGGAAGAAGTTACACTGCTCCTGGGGTTGAA CTGCATGCAGACTGCCTGCTGGGAAACATACTTCTTTATAGGCCATATGACCTG CTAA | 3176 |
| hsa-mir-1-2 | 1 | MWKS* | 3177 | ATGTGGAAGTCCTGA | 3178 |
| | 2 | MQTIS* | 3179 | ATGCAGACTATTTCCTAA | 3180 |
| | 3 | MYSGGQRKTG* | 3181 | ATGTATTCTGAGGGCAAAGAAAACAGGGTGA | 3182 |
| | 4 | MFTYIWGF* | 3183 | ATGTTTACAGTTATTTGGGGGAGTAA | 3184 |
| hsa-mir-124-2 | 1 | MCLLAYFT* | 3185 | ATGTGTCTTTAGCTTATTTCATAACCTGA | 3186 |
| | 2 | MQVRRIKIVHN* | 3187 | ATGCAGGTTAGAAGAATAAAAATAGTTCATAATTAA | 3188 |
| | 3 | MKLQFFECAGCWN* | 3189 | ATGAAACTGCAGTTCTTTGAATGTGCAGTTGCTGRAATTAG | 3190 |
| | 4 | MCRLLELDATYILNTHTYFNILVLDNVFKVLEKNMQ* | 3191 | ATGTGCAGGTTGCTGGAGTTAGATGCTACATATTTTGAACACACATACTTATTTT AATATTTTAGTTTTAGTTAGACAACGTATTCAAAGTACTTGAGAAGAATATGCAATGA | 3192 |
| hsa-mir-124-2 | 1 | MQAARSLVPQWVPWCPGKA* | 3193 | ATGCAGGCAGCAGCCAGGTCGCTGTCCCACAGTTGGTCCTTGGTGCCCTGCAAGGC CTGA | 3194 |
| | 2 | MVQLPPLDSYQLATTGLADTHLGMDLTPGSI* | 3195 | ATGGTCCAGTTACCCCCTTGACAGTTACCAACTAGCAGCAGACCAACAGGCCTGCCTGAC ACACATCTGGCAATGCCTCACAACCCTGGTGCTCTGAC | 3196 |

Figure 1 (Continued)

| | | | | | |
|---|---|---|---|---|---|
| hsa-mir-124-3 | 3 | MTSQPLGASRHNQFCGWRLEKAGGQPRAAGSPSPSWALQQFLIYCSGVLARAVRKREGGTARFLHVTPGVQAGAGTPALPEPGG* | 3197 | ATGACCTCACAACCCTGGGAGCATCTAGGCACAACCAGTTTGTGGTGGCGGTGGAGAAGCTGGGCGCCAGTGGGGCCAGGGGCAGGATCTCCTTCTGGCTCTGCAGCAGTTTCTCATCTACTGCAGTGGGGTTCTGCCAGAGCAGTCAGAAAGCATGAAGGAGGCACTGCTGCTGCTTCCTCCACGTGACTCTGGGGTTGCAAGCTGGGCAGGGACCCCGGCTCTGCCAGAACCCCACCAGGGGCTAG | 3198 |
| | 4 | MKEALLASST* | 3199 | ATGGTAAAAGAGAAAGGAGAAGGAGTTGAGCGAGCGAGAGAAGCTAGGTGTGATGAGACAGACTAG | 3200 |
| hsa-mir-125b-1 | 1 | MVKEKRREVERAREKLGVMMTD* | 3201 | ATGATTCCATTTTAAAGGAGGGAGGGGAGAGTCTAG | 3202 |
| | 2 | MIPFLKEGRGRV* | 3203 | ATGGAAATATCTAAAAAATATTTACTAAGTGGTTGAGGCCTCTCCAGTGTCCTCCTGGCTGTGGCTGCTTGTCATTCTCTTTGA | 3204 |
| | 3 | MEISKKIPSIFTKCVEASPVSSWLWLLCHSL* | 3205 | | 3206 |
| | 4 | MKNRKKKEKKHL* | 3207 | ATGAAAAACAGAAACAGGAGAAAGGAGAGAAACATTTGTAA | 3208 |
| hsa-mir-125b-2 | 1 | MLPFHSNVPFMTHPQKYYCQKLYSKVITQLH* | 3209 | ATGCTTTTCTTTATCATCAGCAACGTTTTCACCATGACCATCCCAAAAATACTATTGTCAGAAACTGTACTCTAAGTGATTACACAGTTGCACTGA | 3210 |
| | 2 | MLLLVHFKVASIRGYLFS* | 3211 | ATGCTTCTTTTGGTGCATTTTAAGGTGCCTAGTATAAGAGGATATCTTCAGTTAA | 3212 |
| | 3 | MKRGDYIYNFSYALKYIH* | 3213 | ATGAAGAGAGGAGATTATATTTATAACTTTTCATATGCATTGAAATATACATTAG | 3214 |
| | 4 | MPPYNYGSDYVIYSYKHA* | 3215 | ATGCCTCCATATAACTATGCTCAGACTATGTCATATACAGCTATAAGCATGCTTGA | 3216 |
| hsa-mir-128a | 1 | MLQTLQKVLGKQ* | 3217 | ATGCTTCAGACACTACAGAAGGTATTGGGTAAACAATGA | 3218 |
| | 2 | MMMLCHCSLTISKPRGNDSCKQHNTMR* | 3219 | ATGATGAATTTGTGCCATTGTAGCCTCACATCCAAGCCAGGGAAATGACAGCTGTAAACAACAACAGCGATAA | 3220 |
| | 3 | MTAVNNTTQCDKCYENRIYIRHYT* | 3221 | ATGACAGCTGTAAACAACAACAATGCGATAAGTGTATGAAATAGAATATATATATAAGGCACTACACATAA | 3222 |
| | 4 | MKJEYI* | 3223 | ATGAAAATAGAATATATATAA | 3224 |
| hsa-mir-129-2 | 1 | MSCACRRL* | 3225 | ATGTCATGTGCATGCGCAGACTGTGA | 3226 |
| | 2 | MCMPQTVSMS* | 3227 | ATGTGCATGCCAGACTGTGAGTATGAGCTGA | 3228 |
| | 3 | MLRGSPLAAFFAPSKEDSGTD* | 3229 | ATGCTCCGGGTTCTTTTTGCCTGCCTTTTTGCCCCTTCTAAAGAGGATAGTGGGAATTCTTGC | 3230 |
| | 4 | MCIMNLGLHAKKPREGILAEPGITLTML* | 3231 | ATGTGTATAATGAATTTGGGCTGCATGCAAAGAACCGAGAGAGAGGGAATTCTTGCAGAGCCGAGAATCACCCTGACGAATCTCTGA | 3232 |
| hsa-mir-133a-1 | 1 | MWKS* | 3233 | ATGTGGAAGTTCCTGA | 3234 |
| | 2 | MQTIS* | 3235 | ATGCAGACTATTCCTAA | 3236 |
| | 3 | MYSGGQRKTG* | 3237 | ATGTATTCTGGAGGGCAAAGAAAAACAGGTGA | 3238 |
| | 4 | MFTVIWGE* | 3239 | ATGTTTACAGTTATTTGGGGGAGTAA | 3240 |
| hsa-mir-133a-2 | 1 | MRKPQWQLAPEKARQGWPSPTERRLLEPSGPGDLRPQELGAVAVVRKGWVLAGRQPMPGRREAAQLSLGKASSKAGERGVRGSRKGELCEAPDL* | 3241 | ATGAGGAAACCAGTGGTGCTGCCAGAGAAGGCAGGCAGGCTGGCCCTCCCTACCCGGAGGCTGCTGGAGCCCTCGGGGCCCGGGGATCTGAGGCCCCAGGAGCTAGGGGCAGTGGTCGTCGTGTGGTGAGGCAGATGGGTCTTGGCAGGAAGGCAGCCATGCCTGGGAGGCGGGAAGGCAGCACAGCTCAGTTTGGGAAGGCAAGTCCAAGGCCGGAGAGCGTGGGGTGGGGGTCTAGGAAGGGTGAGCTCTGTGAAGCACCTGACCTTTGA | 3242 |
| | 2 | MGLGRKAAHAWEAGGSTAQPGEGKLQGRRAWGAGV* | 3243 | ATGGGTCTTGGCAGGAAGGCAGCTCATCCTGGGAGGCGGAGCAGCAGCAGTCAGTTCGGGAAGGCAAGTCCAAGGCCGGAGAGCGTGGGGTCTAG | 3244 |
| | 3 | MGPLGRFWGLWGVGFLAFLERKEKNTYKEVEEPQGPPLSALAPCW* | 3245 | ATGGGGCCCTTGGGACGCTTCTGGGGACTTTTGGGGCGTTGGGCGTTGGTTCTTGGCTTTTAGAGAGAAAAAGAAAAATACTTACAAGGAAGTTGAGGAGCCTCAGGGACCTCCCTTGTCAGCCCTGCCCCATGCTGGTGA | 3246 |

Figure 1 (Continued)

| | | | | |
|---|---|---|---|---|
| | 4 | MLVRPQESEGKGLEDLPVSGSCCLREQSRTGGCPGPQGSPTSCPEDGPSSGTSQEHELWACSFTFARKGVDHTLGKE* | 3247 | ATGCTGGTGAGACCCCAGGTTCAGAGGGAAGGGCTAGAGGAATCTGCCAGTGAGTGGGAGCTGCTGCCTGAGGGAGCAGAGCAGAAACAGGGCGGTCCCGGTCCACAGGGGTCCCCGACGTCCTGCCCGAAGGATGACCTAGTTCCGGCACGTCCAAGAACACGAATTGTGGGCTGTTCCTTCACATTGCAAGAAAAGGTTGATCACACCCTTGGCAAAGAATGA | 3248 |
| hsa-mir-135a-2 | 1 | MAKLLCLY* | 3249 | ATGGCGAAACTCTGTCTCTACTAA | 3250 |
| | 2 | MEVAMSQDCALAPQPGQQNETLSQKIR* | 3251 | ATGGAGGTTGCAATGAGCCAAGATTGTGCCCTCCCAGCCTGGGCAACAGAATGAGACTCTTTCTCAAAAATAAATAA | 3252 |
| | 3 | MRLFLKK* | 3253 | ATGAGACTCTTTCTCAAAAATAA | 3254 |
| | 4 | MISSSRLHPQDARLVQHMHNKRNPLHKQSQ* | 3255 | ATGATCTCATCAAGTCGCTTCATCCCCAAGATGCAAGGCTGGTTCAACATATGCATATCAATAAACGTAATCCATTACATAAACAGAGCTCAATGA | 3256 |
| hsa-mir-137 | 1 | MIHRYFYECKLKHPSA* | 3257 | ATGATAACCATTAGATATTTTACGAGTGTAAACTGAAGCATCCTCTGCCTAG | 3258 |
| | 2 | MWSYGLFN* | 3259 | ATGTGGTCCTACGGTCTTCCAAATTAA | 3260 |
| | 3 | MHQSQ* | 3261 | ATGCACCAGAGTCAATGA | 3262 |
| | 4 | MKRVSCYSQYSSTPFQVDVKPLLVRT* | 3263 | ATGAAGAGAGTCAGCTGCTACTCCCAGTATTCTTCCACTCCTTTCCAAGTAGATGTAAGTTCCTTTGGTGAGGACCTAA | 3264 |
| hsa-mir-138-1 | 1 | MPTHCMLY* | 3265 | ATGCCTACAATAACATGTATGCTTTACTGA | 3266 |
| | 2 | MYALLTM* | 3267 | ATGTATGCTTTACTGACCATGTAG | 3268 |
| | 3 | MILIPQMLEAKRSSI* | 3269 | ATGATCTAATACCTCAGAATTTGAAGCCAAAAGGTCCTCCATTTAG | 3270 |
| | 4 | MKKQ* | 3271 | ATGAAAAAGCAGTGA | 3272 |
| hsa-mir-138-2 | 1 | MHPGK* | 3273 | ATGCACCCTGTAAATAG | 3274 |
| | 2 | MLQCL* | 3275 | ATGTTGTTGCAGTGCCTCTGA | 3276 |
| | 3 | MYWVGQNLLKEYLNSWLLGFL* | 3277 | ATGTATTGGGTGGGGCAGAATTTGCTTAAATATTTAAATAGTTGGTTATTGGATTTTTGTGA | 3278 |
| | 4 | MRWNMKHEFLFTKTRSFFGIAGESE* | 3279 | ATGAGGTGGAATATGAAATAGAAATTTATTTTATTTACTAAAACCAGATCCTCTTTGGGATTGCAGGTGAGAGTGAGTGA | 3280 |
| hsa-mir-144 | 1 | MLPFLALFLFCFK* | 3281 | ATGTTGCCTTTTTAGCCCTTTTATTTCTTTGTTTAAGTGA | 3282 |
| | 2 | MTDTEQIKFMVRSYVGMSHYHSQDTFAQEGTPSQLVKLLGQK* | 3283 | ATGACTGATACTGAGCAAATTAAGTTTATGGTCAGAAGTTATGTAGGAAACTCCATTACCAATTCCCAAGATACTTTTGCCCAGGAGGGCACCCATCCAGCTTGTAAAATTGCTGGGACAAAAATGA | 3284 |
| | 3 | MHVEVLLLALKFL* | 3285 | ATGATTATCGTAGAGGAAGTTTTGCTGCTTTAAAATTTATTATGA | 3286 |
| | 4 | MYTRTEL* | 3287 | ATGTATACCAGGACTGAGTTGTAG | 3288 |
| hsa-mir-145 | 1 | MLRLGVLLSC* | 3289 | ATGCTGCATCTGGGGTCTTGCTGTCTTGCTAA | 3290 |
| | 2 | MISKHPSS* | 3291 | ATGATCTCTAAGCATCCATCCAGCTGA | 3292 |
| | 3 | MVLLASRIPCCCSQLGEREGAEGYHRVNILSAQASPRHPSLRQSPWLLHRQCFFLJVWGFDFVIPRAWGSWQGKWFSNNGFEKQSWGRGNVSSGSGRQAEILGRLLGADCTWSNGKGCW* | 3293 | ATGGTCCTGTTGGCTTCTAGGATTCCTTGTTGTTGTAGTCAATGGGGAAGAAGGTGCAGAGGAGTGCACAGAGTTAACATCCATCAGCCAAGCTTCACCTCGGCAACCGAGTCTCAGGCAGTGCCTTGGCTTCTACATAGGCAGCAGTGCTTCTTCCATTGTGTGGGGCTTTGATTTTGTAATTCCAAGAGCCTGGGCTCTGGCAAGGAAAATGGTTTTCAATAATGGTTTCGAGAAACAAAGCTGGGAAGAATCCTCGGAAGGGTGCAATGTAAGCTAAGCCAAGTGTAAGCTCAGGCTCTGGCAGGCAGGCAGAGAATCCTCGGAAGCTGGGTGCTGACTGCACATGAGCAATGGGAAGGGATGCTGGTGA | 3294 |
| | 4 | MVFK* | 3295 | ATGGTTTTCAAATAA | 3296 |
| | 1 | MESCSRPVARAGGQW* | 3297 | ATGGAGTCTTGCTCCCGGCCTGTGCCCGGGCTGGAGGGCAGTGGTAA | 3298 |
| | 2 | MRATMPG* | 3299 | ATGCGCGCCACAAATGCCTGGCTAA | 3300 |

Figure 1 (Continued)

| | | | | |
|---|---|---|---|---|
| hsa-mir-146a | 3 | MGFWTELASLYLLFLKSYCCPYAWYSLEQISSHTRSSLRERRWTLGVYPVVWSCWTVSLWSG* | 3301 | ATGGGTTTTTGGACAGAACTGGCTTCTCTTTATTGTGTTTTAAAATCATACTGCTGTCCTTATGCATGGTACTCCTTGGAACAGATAAGCAGCATAAGAAGCTCTTGAGAGAGAAGGTGACTCTGGGGGTGCTGCCGGTTGTTTGGAGTGTTGGACTGTTAGCTTGTGGAGTGGGTGA | 3302 |
| | 4 | MHGTPWNR* | 3303 | ATGCATGGTACTCCTTGGAACAGATAA | 3304 |
| | 1 | MGTHFPNAVFPGRAGAFLLYS* | 3305 | ATGGGCACTCACTTCCCAATGCAGTGTTTCCTGGGAGAGCAGGAGCATTCTTACTGCTGTATCGTGA | 3306 |
| | 2 | MQCPLGFQEHSYCCIREHSYCRV* | 3307 | ATGCAGTGTTTCCTGGGAGAGCAGGAGCATTCTTACTGCTGTATCGTGAGCATTCTTACTGTCAGGGTGTGA | 3308 |
| hsa-mir-153-2 | 3 | MAVSLIVKPRCQEEQGNPSPLFRSFRGPLKLVGSKDKSGFRRS* | 3309 | ATGGCAGTCAGTCTCATTGTAAAACCAAGATGCCAGGAGGAGCAGGAGGAAACCCTCCTTCTTGTTCAGAAGCTCGTGTGTCCCGTTAAATTGGTAGGGTCAAGGATAAATCTGGTACAAGGCGTTCATAA | 3310 |
| | 4 | MPGGTGKPLLLVQKLPWSP* | 3311 | ATGCCAGGAGGAACAGGGAAACCCTCCTTCTTGTTCAGAAGCTCCCGTTGGTCCCCT TAA | 3312 |
| hsa-mir-15b | 1 | MQYRSILSE* | 3313 | ATGCAGTATCGGTCTATATTGAGTGAATAG | 3314 |
| | 2 | MISFSFYL* | 3315 | ATGATTTCCTTTTCATTTTATTTGTAG | 3316 |
| | 3 | MLHAYIYHWINTRKSLNKGIFF* | 3317 | ATGCTCCATGCTTACATATATCACTGGATCAATACAAGAAAAAGTTTAAATAAAGGCATTTTTTAA | 3318 |
| | 4 | MLTYITGSIQEKV* | 3319 | ATGCTTACATATATCACTGGATCAATACAAGAAAAGTTTAA | 3320 |
| hsa-mir-16-2 | 1 | MQYRSILSE* | 3321 | ATGCAGTATCGGTCTATATTGAGTGAATAG | 3322 |
| | 2 | MISFSFYL* | 3323 | ATGATTTCCTTTTCATTTGTTATTGTAG | 3324 |
| | 3 | MLHAYIYHWINTRKSLNKGIFF* | 3325 | ATGCTCCATGCTTACATATATCACTGGATCAATACAAGAAAAAGTTTAAATAAAGGCATTTTTTAA | 3326 |
| | 4 | MLTYITGSIQEKV* | 3327 | ATGCTTACATATATCACTGGATCAATACAAGAAAAAGTTTAA | 3328 |
| hsa-mir-181a-1 | 1 | MCQH* | 3329 | ATGTGCCAGCATTAG | 3330 |
| | 2 | MECP* | 3331 | ATGGAATGTCCTTAA | 3332 |
| | 3 | MSLNSMGGAE* | 3333 | ATGTCCTTAAATTCTAATGGAGGAGCTGAGTGA | 3334 |
| | 4 | MEELSEQIHHMWVRVKC* | 3335 | ATGGAGGAGCTGAGTGAACAAATACATCATATAATGTGGTCAGGGTTAAATGCTAG | 3336 |
| | 1 | MCQH* | 3337 | ATGTGCCAGCATTAG | 3338 |
| | 2 | MECP* | 3339 | ATGGAATGTCCTTAA | 3340 |
| hsa-mir-181b-1 | 3 | MSLNSNGGAE* | 3341 | ATGTCCTTAAATTCTAATGGAGGAGCTGAGTGA | 3342 |
| | 4 | MEELSEQIHHMWVRVKC* | 3343 | ATGGAGGAGCTGAGTGAACAAATACATCATATAATGGGTCAGGGTTAAATGCTAG | 3344 |
| | 1 | MNCN* | 3345 | ATGATAAACTGTAATTAG | 3346 |
| | 2 | MWTVKYLRAKPLTSLSISIRLAAHLEHRSSMLPRAGLLAHHSQDSSGQGLC* | 3347 | ATGTGGACAGTGAAGTATTTGCGTGCAAAGCCCTCACCTCTGAGCATTCCATCAGGCTCGTGCTGTCACCTGGAGCACAGGTCATCTATGCCCGGGCAGGACTCCTCGCCATCACAGCCAGCCAAGACTCCTCAGTCAAGGCCTCTGCTGA | 3348 |
| | 3 | MLTSVLLQLPHRDAQQVGFPKQKLGSPPGRGKGQAGAAGRAHHDTV* | 3349 | ATGCTGACCTCTGTTCTTTACAGCTTCTCATCGGGATGCAAGCAGCCAGGTGCTGA | 3350 |

Figure 1 (Continued)

| | | | | |
|---|---|---|---|---|
| hsa-mir-187 | 4 | MHSKSDSPSRSWAAHLEEEARQVLQVGLTMTQCETSG YNTGPQRCSDFSCLVLQPEGRRSAAEPAPLVLRDSTQG TAQRPWESPGSGQVGGVLGERPTRTTPGVTHSAPFFV LVSSLRTQLGSPLAQCR* | 3351 | ATGCACAGCAAGTCGGATTCCCAAGCAGCAAGCTGGGCAGCCACCTGGAAGAGGA GGCCAGGCAGGTGCTGCAGGTGGGCCTCACCATGACACAGTGTGAGACCTGGGCT ACAACACAGGACCGGGGCGCTGCTCCTGGACCCTCGTGTCTTGTTGTTGCAGCCGGAGG GACGGCAGGTCCGCAGAGACCATGGGAACCCTGTCCTGAGGGACTGCGACACAGGGG ACTGCACAGAGACCAGAGTCCAGGCTCAGGTGGGCCAGGTGGGTGGGTGTT GGGAGAGAGGCCGACCGGACCCAGTGTCACCCATTCAGCCCCCTTTTTGT CCTAGTTTCGTCCTCCTCGTACACAGCTTGGCTCACCTCTGGCCCAGTGCAGGTAG | 3352 |
| | 1 | MILPQYPE* | 3353 | ATGATTCTCCACCTCAGTATCTGAGTAG | 3354 |
| hsa-mir-18b | 2 | MLPNLALNSQPQANLPPCSPKVLGLQV* | 3355 | ATGTTGCCAAACTGGCCTTGAACTCCAGCCTCAAGCAAACCTCCACCTTGTTCTC CCAAAGTGCTGGGACTACAAGGTGTGA | 3356 |
| | 3 | MQRYK* | 3357 | ATGCAAAGATATAAATAG | 3358 |
| | 4 | MILPDKIDYKTMSHREKEEYFTIKRRSIYQKEM* | 3359 | ATGATATTACCAGACAAAATAGACTATAAGAGACAATGAGTATTATCAGAGAGAAAGA AGAATATTTCACCATAAAAAGGAGGTCAATATATCAGAAAGAAATGTAG | 3360 |
| hsa-mir-191 | 1 | MGGGCQLIHRPWFGGAQEHSSLFLLGC* | 3361 | ATGGGTGGGCAAGGCAACTGATACAAGACCATGGTTTGGCGGTGGTGCTCAAGA ACATAGCTCCCTCTTCCTTCTGGGGTGCTGA | 3362 |
| | 2 | MVWGWCSRT* | 3363 | ATGGTTTGGGGGTGGTGCTCAAGAACATAG | 3364 |
| | 3 | MCLRLPWALHFCTCTCGGE* | 3365 | ATGTGCCTGAGGCTGCCCTGGGCACTGCACATGCACGTGCACATGTGGGGGTGA GTAG | 3366 |
| | 4 | MHVHMWG* | 3367 | ATGCACGTGCACATGTGGGGTGA | 3368 |
| hsa-mir-194-1 | 1 | MLKLGWKNSKTTDALQKAYRGISSLQINNLP* | 3369 | ATGTTAAAACTTGGGTGGAAAATAGTAAAATCACTGATGCTTTACAAAAAGCTTAC AGAGGCATAAGTAGTTTACAAATAAATAACTTGTTTAA | 3370 |
| | 2 | MLYKKLTEA* | 3371 | ATGCTTTACAAAAGCTTACAGAGAGGCATAA | 3372 |
| | 3 | MRQC* | 3373 | ATGAGACAAATGTGA | 3374 |
| | 4 | MLKIKPIAADHPH* | 3375 | ATGTTGAAGATAAAGCCATAGCAGCAGACCATCCACATTGA | 3376 |
| hsa-mir-196a-2 | 1 | MSPSERGVPKEQYYSGGADHFPPHPGGARLEGREEKE GEGGKYQLRNYPRIRFSPCDG* | 3377 | ATGTCATTTCAAGAGAGGAGTGTTTAAGGAGCAATACTACAGCCGGAGGAGCTGA CATCTCTTTTTTTTTTCCCATCCGGAGCGGGAGCGGGCCGCGGTTGGAGRGGAGGAAA AAGAAGGCATGAAGGAGGGGGAAAATATCAGCTCCGTAATTATCCGCCATTCCGGTTCTCA CCATGTGACGGCTAG | 3378 |
| | 2 | MGFENGLDDSDGRDVSGVKLSAGGARRVE* | 3379 | ATGGGATTTGAAAATGGCTTGATGATTCAGACGGCCGTGACGTCAGCGGGGTCAA GTTGTCGGCAGGCGGAGCGGAGCGGCAGAGTGGAGTAA | 3380 |
| | 3 | MALMIQTAVTSAGSSCRQAERAEWSNSAI* | 3381 | ATGGCCTTGATGATTCAGACGGCCGTGACGTCAGCGGGGTCAAGTTGTCGGCAGGC GGAGCGCGAGAGTGGAGTAACAGCGGCCATCTAG | 3382 |
| | 4 | MRERGKERGNPGLKTVKFLKLKGRDTNQVLLPTLHLPFP YPRTRLPLLILGMGVG* | 3383 | ATGCGGGAGAGAGGGAGAGGGAACCCGGGACTCAAGGTCAAGTTTCAAGTTTAAGCTCTCAAATTCA AATTAAAAAGGTCGAGACAACGTAGGTACTACTCTCCCACTCTTCATCTCCCTTCC ATATCCCCGACCCTCTTACCTTGCGGATGGGAGTGGGGTGA | 3384 |
| hsa-mir-196b | 1 | MINPCINFAFFSKIPYK* | 3385 | ATGATTAATCCATGTATAAATTTCGCTTTTTTTTCTAAATTTTCTACAAATAA | 3386 |
| | 2 | MYKFRFF* | 3387 | ATGTATAAATTTCGCTTTTTTTTCTAA | 3388 |
| | 3 | MAIANIC* | 3389 | ATGGCAATTGCTAATATTTGTGA | 3390 |
| | 4 | MSQALC* | 3391 | ATGAGCCAGGCATTATGCTAA | 3392 |
| hsa-mir-194-2 | 1 | MKSLSMPMS* | 3393 | ATGAAGTCTTTGTCATGCCATGTCCTGA | 3394 |
| | 2 | MVLPRFSSRVFMVLVLHLSLNPS* | 3395 | ATGGTATTGCCTAGGTTTTCTTCTAGGGTTTTATGGTTTAGTCTTACATTTAAGTC TTAATCCATCTTGA | 3396 |
| | 3 | MASQFSQHRLLNKGSFPHFLFLSGLSKIRWL* | 3397 | ATGGCTAGCCAGTTTTCCCAACACCGTTTATTAAATAAGGGATCTTTCCCCATTTCT TGTTTTTGTCAGTTTGTCAAAGATCAGATAGGTTGTAG | 3398 |

Figure 1 (Continued)

| | | | | | |
|---|---|---|---|---|---|
| | 4 | MVVDVWCYF* | 3399 | ATGGTTGATGTGTGGTGTTATTCTGA | 3400 |
| | 1 | MILPPQYPE* | 3401 | ATGATCCTCCCAACTGGCTACCTGAGTAG | 3402 |
| hsa-mir-19b-2 | 2 | MLPNLALNSQPQANLPPCSPKVLGLQV* | 3403 | ATGTTGCCCAACTGGCCTTGAACTCCCAGCCTCAAGCAAACCTCCCACCTGTTCTCCAAAGTGCTGGGACTACAGGTGTGA | 3404 |
| | 3 | MQRYK* | 3405 | ATGCAAAAGATATAATAG | 3406 |
| | 4 | MILPDKIDYKTMSHREKEEYFTIKRRSIYQKEM* | 3407 | ATGATATTACCAGACAAAATAGACTATAAGACAATGAGTATTATCAGAGAAAGAAGAATATTTCACCATAAAAGGAGGTCAATATATCAGAAGAAATGTAG | 3408 |
| | 1 | MFYICFDFPCTVHELEMIWQ* | 3409 | ATGTTTTACATCTGCTTTGATTTTCCCTGTACAGTACATGAACTAGAGATGATATGGCAATAA | 3410 |
| hsa-mir-205 | 2 | MAINFPVNTH* | 3411 | ATGGCAATAAATTTCCTGTGAATACACACTAA | 3412 |
| | 3 | MRQHIS* | 3413 | ATGAGGCAACACATTAGTTGA | 3414 |
| | 4 | MSSNPDISDSLQNIDS* | 3415 | ATGTCAAGCAATCCAGATATTTCTGATTCCCTCCAAAACATAGACTCTGA | 3416 |
| | 1 | MILPPQYPE* | 3417 | ATGATCCTCCCACCTCAGTATCCTGAGTAG | 3418 |
| hsa-mir-20b | 2 | MLPNLALNSQPQANLPPCSPKVLGLQV* | 3419 | ATGTTGCCCAACTGGCCTTGAACCTCCCAGCCTCAAGCAACCTCCCACCTGTCTCCAAAGTGCTGGGACTACAGGTGTGA | 3420 |
| | 3 | MQRYK* | 3421 | ATGCAAAGATATAATAG | 3422 |
| | 4 | MILPDKIDYKTMSHREKEEYFTIKRRSIYQKEM* | 3423 | ATGATATTACCAGACAAAATAGACAATAAGACATATAGACTATAAGGAGTAAGAATGAGTATTATCAGAGAGAAAGAAGAATATTTCACCATAAAAGGAGGTCAATATATCAGAAGAAATGTAG | 3424 |
| | 1 | MAQRIK* | 3425 | ATGGCACAAGAATAAATTGA | 3426 |
| hsa-mir-21 | 2 | MNDFSEVPHLSPLVPVRTGLNQLIRK* | 3427 | ATGAATGACTTCTCAGAAGTCCCACATTTATCACCACTAGTTCCTGTAAGAACTGGTTTGAACCAATTAATAAGGAAATGA | 3428 |
| | 3 | MITSQKSHIYHH* | 3429 | ATGACTTCTCAGAAGTCCCACATTATCACCACTAG | 3430 |
| | 4 | MTYACVIPS* | 3431 | ATGACTTATGTTGTGTCATTCCTAGTTAA | 3432 |
| | 1 | MGVHYFILLNCRD* | 3433 | ATGGGTGTTCACTATTTCATTCTTCTCAACGTAGAGATTAG | 3434 |
| | 2 | MNHLTQYSAYNRLSNNKM* | 3435 | ATGAATCACTTAACACAGTACTCAGCATATAATAGGCTTCAAACAACAAGATGTAG | 3436 |
| hsa-mir-214 | 3 | MTQSMKYRNMAGCGGSCL* | 3437 | ATGACTCAGTCTATGAAGTATCGAAATATGGCAGGGTGTGGTCATGCCTGTAA | 3438 |
| | 4 | MPVILALWEAKAGGSPDIMSSRPACPTWCNPISTKKLQKLARRGDYCL* | 3439 | ATGCCTGTAATCCTAGCACTTTGGGAAGCCAAGGCGGGTGGATCACCTGATATCATGAGTTCGAGACCAGCCTGCCCAACATGGTGTAACCCCATCCTCTACTAAAAATTACAAAAATTAGCCAAGGCGTGGTGATGTGCCTGTAA | 3440 |
| | 1 | MLKLGWKNSKITDALQKAYRGISSLQIMMLF* | 3441 | ATGTTAAAACTTGGGTGGAAAATAGTAAATCACTGATGCTTTACAAAAGCTTACAGAGGCATAAAAGCTTACAGAGGCATAA | 3442 |
| hsa-mir-215 | 2 | MLYKKLTEA* | 3443 | ATGCTTTACAAAAGCTTACAGAGGCATAA | 3444 |
| | 3 | MRQC* | 3445 | ATGAGACAATGTGA | 3446 |
| | 4 | MLKIPIAADHPH* | 3447 | ATGTTGAAGATAAAGCCATAGCAGAGACCATCCACATTGA | 3448 |
| | 1 | MVGFSFVPDLFLGAVFSFIQRGFSPFCALGSSYLPLKCRPNDLSPLTSYQNPTGPLRTLCPYKTLFKSLYNHICHTVEIYLFHCLSPSLDQELTEDQYQAALMYLSLNEWNYECTLLS* | 3449 | ATGGTGGGCTTTCATTCCTTCGTCCCAGATTTATTCCTTGGGAGCAGTGTTTCTTTTATCCAAAGAGGCTTTCTCCCTTTCTGTGCCTTGGGAAGCCAAGGCTCTACCTACCTTTAAAGTGCCGCCCAAATGACCTGTCCTTCTTACCTCTTATCAGAATCCTGTAATCCTGTGATCATTGAGGTATTTGCCACATTGTTGAAATTTATCTTTTCACTGTGTCTCCATGCTAAGATTTAAATAACTTGTTTAACCATGTGTCCTAGCCTCAGAATCAACAGAGCTCACAGAGGCACCAGTACCAGGCAGCAGCCTCAGTGATCCGCAGCTGAATGAATTATGACCATGAATGCACCCTGCCTCTCTTGTTCTTAA | 3450 |

Figure 1 (Continued)

| | | | | |
|---|---|---|---|---|
| hsa-mir-216a | 2 | MTCPFLPLIRIQQGSSTLCAPTRLCSNPCHTFATLLKFIPF TVCLHR* | 3451 | ATGACCTGTCTGTTCTTCTTACCTCTTATCCAGAATCCAACAGGGTTCCTCCACACTCTGTG CCCCTACAAGACTTGTTCAAATCCCTGTCTCTTGTCTCTTGTCTTGTCTTGTATAATCACATTGCCACATTGTTGAAATT TATCTTTTCACTGTCTGTCTCCATCGCTAG | 3452 |
| | 3 | MNGHMNAPCSLCLNPTQGSRPGSVPSPFPGLSQPLTPGY ECLPSLK* | 3453 | ATGAATGGAATTATGAATGCACCCTGCTCTTGTCTTAATCCTACCCAAGGTTCCA GGCCTGGCTCAGTCCGAGCCCTTCTCCGGACTTTCTCAGCCACTCACTCCAGGCT ATGAGTGTCTCCTTCTCTGAAATGA | 3454 |
| | 4 | MHPALFVLILPKVPGLAQSRAPSLDFLSHSLQAMSVSLL* | 3455 | ATGCACCCTGCTCTCTTTGTCTTAATCCTACCCAAGGTTCCAGGTTCCAGTCC GAGCCCCTTCTCCGGACTTTCTCAGCCACTCACTCCAGCTATGAGTGTCTCCTTCT CTGA | 3456 |
| | 1 | MVGFSFVPDLFLGAVFSFIQRGFSPFCALGSSYLPLKCRP NDLSFLTSYQNPTGFLHTLCPYKTLFKSLYNHCHIVEIY LPHCLSPSLDQELTEDQYQAALMYLSLNEWNYECTLLS LS* | 3457 | ATGGTGGGCTTCTCATTCGTTCCAGATTTATTCCTGGGAGCAGTGTTTTCTTTTATCC AAAGAGGCTTTTCTCCCTTTCTGTGCCCTGAGCTCTACCTACCTTAAAGTGCC GCCAAATGACCTGTCCTTTCTTACCTCTTATCAGAATCCAACAGGGTTCCTCCACAC TCTGTGCCCCTACAAGACTTTGTTCAAATCCCTGTATAATCACATTGCCACATTGTT GAAATTTATCTTTTCACTGCTCTACCTATCTCAGTCTGAATGAGCTCAGAGAGAC CAGTACCAGGACAGCACTCCAATGTATCTCAGTCTGAATGAATGATTATGAATGCACC CTGCTCTCTTGTCTTAA | 3458 |
| hsa-mir-216b | 2 | MTCPFLPLIRIQQGSSTLCAPTRLCSNPCHTFATLLKFIPF TVCLHR* | 3459 | ATGACCTGTCTGTTCTTCTTACCTCTTATCCAGAATCCAACAGGGTTCCTCCACACTCTG CCCCTACAAGACTTGTTCAAATCCCTGTATAATCACATTGCCACATTGTTGAAATT TATCTTTTCACTGTCTGTCTCCATCGCTAG | 3460 |
| | 3 | MNGHMNAPCSLCLNPTQGSRPGSVPSPFPGLSQPLTPGY ECLPSLK* | 3461 | ATGAATGGAATTATGAATGCACCCTGCTCTCTTGTCTTAATCCTACCCAAGGTTCCA GGCCTGGCTCAGTCCGAGCCCTTCTCCGGACTTTCTCAGCCACTCACTCCAGGCT ATGAGTGTCTCCTTCTCTGAAATGA | 3462 |
| | 4 | MHPALFVLILPKVPGLAQSRAPSLDFLSHSLQAMSVSLL* | 3463 | ATGCACCCTGCTCTCTTTGTCTTAATCCTACCCAAGGTTCCAGGCTGCTCAGTCC GAGCCCCTTCTCCGGACTTTCTCAGCCACTCACTCCAGCTATGAGTGTCTCCTTCT CTGA | 3464 |
| | 1 | MVGRSFVPLFLGAVFSFIQRGFSPFCALGSSYYLPLKCRP NDLSFLTSYQNPTGFLHTLCPYKTLFKSLYNHCHIVEIY LFHCLSSPSLDQELTEDQYQAALMYLSLNEWNYECTLLS LS* | 3465 | ATGGTGGGCTTCTCATTCGTTCCAGATTTATTCCTGGAGCAGTGTTTTCTTTTATCC AAAGAGGCTTTTCTCCCTTTCTGTGCCCTGAGCTCTACCTACCTTAAAGTGC GCCAAATGACCTGTCCTTCTTACCTCTTATCAGAATCCAACAGGGTTCCTCCACAC TCTGTGCCCCTACAAGACTTTGTTCAAATCCCTATAATCACATTGCCACATTGTT GAAATTTATCTTTTCACTGCTCTACCTATCTCAGTCGAATGAGCTCAGAGGAC CAGTACCAGGACAGCACTCCAATGTATCTCAGTCTGAATGAATGATTATGAATGCACC CTGCTCTCTTGTCTTAA | 3466 |
| hsa-mir-217 | 2 | MTCPFLPLIRIQQGSSTLCAPTRLCSNPCHTFATLLKFIPF TVCLHR* | 3467 | ATGACCTGTCTGTTCTTCTTACCTCTTATCCAGAATCCAACAGGGTTCCTCCACACTCTGTG CCCCTACAAGACTTGTTCAAATCCCTGTATAATCACATTGCCACATTGTTGAAATT TATCTTTTCACTGTCTGTCTCCATCGCTAG | 3468 |
| | 3 | MNGHMNAPCSLCLNPTQGSRPGSVPSPFPGLSQPLTPGY ECLPSLK* | 3469 | ATGAATGGAATTATGAATGCACCCTGCTCTCTTGTCTTAATCCTACCCAAGGTTCCA GGCCTGGCTCAGTCCGAGCCCTTCTCCGGACTTTCTCAGCCACTCACTCCAGGCT ATGAGTGTCTCCTTCTCTGAAATGA | 3470 |
| | 4 | MHPALFVLILPKVPGLAQSRAPSLDFLSHSLQAMSVSLL* | 3471 | ATGCACCCTGCTCTCTTTGTCTTAATCCTACCCAAGGTTCCAGGCTGCTCAGTCC GAGCCCCTTCTCCGGACTTTCTCAGCCACTCACTCCAGCTATGAGTGTCTCCTTCT CTGA | 3472 |
| hsa-mir-218-1 | 1 | MCSLEVSSCSINVSPEYYLLSVVNCILFHTSICGILQLLS VSY* | 3473 | ATGTGTTCCCTGGAAGTTAGTAGTTGCTCAATAAATGTTAGCTTTGAGTATTACCTTA TTTATCAGTTGTAAATTGCATACTTTTCACACTTCCATCGTGGAATTTTACAGTT ATTGTCAGTAAGTTATTGA | 3474 |
| | 2 | MLALSITLFYQL* | 3475 | ATGTTAGCTTTGAGTATTACCTTATTTATCAGTTGTAA | 3476 |
| | 3 | MKEIITVFNKTVAEN* | 3477 | ATGAAAGAGATTATTATTACTGTTGTTCAACAAAACTGTTGCTGAGAACTAG | 3478 |

Figure 1 (Continued)

| | | | | | |
|---|---|---|---|---|---|
| | 4 | MHINQEATVKVVIKTYPERNRHKQ* | 3479 | ATGCATATAAATCAAGAAGCAACAGTCAAGGTGGTGATAAAAACATACCTGAAAG AAACAGAATTATCATAAAGCAATGA | 3480 |
| hsa-mir-218-2 | 1 | MGRRRRLQGRQDPGSSVSPRAKEKVGLGRPLHMCLLQ AKIYIFRFQSVLPKGQVEKY1* | 3481 | ATGGGGAGGAGGAGGACGGTTCGAGGGGAGACAGGACCCAGGCAGCAGCGTCTC CAAGAGCTAAGGAGAAGGTGGGCTGGGGCGGCCTTTGCACATGTGCCTGTTACAG GCTAAGATTTTATATTTTCGTTTCCAAAGTGTGCTCCCAAAGGGCAAGTAGAGAAA TACATATAG | 3482 |
| | 2 | MVQPFDHSML* | 3483 | ATGGTACAGCCCTTTGACCACAGTATGTTATAG | 3484 |
| | 3 | MPTKNTFTSLAPPSLITVF* | 3485 | ATGTTCACGAAAAACACTTTCACTAGCTTCACCTCCTCCATCCCTGATTACTGTGTTCTGA | 3486 |
| | 4 | MGENSRGHLSLSWKEK* | 3487 | ATGGGGAAAACAGCAGGGGAATTCTCAGCTATCTTGGAAGAAGAAGTAG | 3488 |
| hsa-mir-221 | 1 | MQSIKVSLQGPSQGKK* | 3489 | ATGCAGTCCATAAAGGTTAGTCTCCAGGGCCAGTCAGGGCAAAAATGA | 3490 |
| | 2 | MRGKICACTCTCVRACAHVFVEGSKEQMEKKQLD* | 3491 | ATGAGAGGGAAGATCTGTGCGTGTACGTGTACATGTGTGCGTGCATGTGCACATGTC TTTGTTGAGGGAAGCAAGGAACAAATGGAGAAAAAACAGTTGTGA | 3492 |
| | 3 | MCACMCTCLC* | 3493 | ATGTGTGCGTGCATGTGCACATGTCTTGTGA | 3494 |
| | 4 | MSLLREARNKWRKNSLTDKYSQ* | 3495 | ATGTCTTTGTTGAGGGAAGCAAGGAACAAATGGAGAAAAACAGCTTGACTGACAA ATATAGCCAATAA | 3496 |
| hsa-mir-222 | 1 | MQSIKVSLQGPSQGKK* | 3497 | ATGCAGTCCATAAAGGTTAGTCTCCAGGGCCAGTTCAGGGCAAAAATGA | 3498 |
| | 2 | MRGKICACTCTCVRACAHVFVEGSKEQMEKKQLD* | 3499 | ATGAGAGGGAAGATCTGTGCGTGTACGTGTACATGTGTCGTGTGCATGTGCACATGTC TTTGTTGAGGGAAGCAAGGAACAAATGGAGAAAAACAGTCTTGTTGA | 3500 |
| | 3 | MCACMCTCLC* | 3501 | ATGTGTGCGTGCATGTGCACATGTCTTGTGA | 3502 |
| | 4 | MSLLREARNKWRKNSLIDKYSQ* | 3503 | ATGTCTTTGTTGAGGGAAGCAAGGAACAAATGGAGAAAAAACAGTTGACTGACAA ATATAGCCAATAA | 3504 |
| hsa-mir-23b | 1 | MPYLCNHKFICHAGHSILRSHINLHKVNSLQCIVLWILT NGWARCSGSGL* | 3505 | ATGCCATACCTTTGTAATAATAATTAAGTTCATTGTCATGCGGCCATTCTATCCTAA GATCCCACATTAATTGCATAAAGTTAACTCTCTGCAGTGTATTGTTCTGTGGATTTT GACAAGATGGGGCCAGGTGCAGTGGCTCAGGCCTGTAATCCCAGCACTTTGGGAGGTCG | 3506 |
| | 2 | MPAILS* | 3507 | ATGCCGGCCATTCTATCCTAA | 3508 |
| | 3 | MDGRPGAVAQACNPSTLGGRGGRIT* | 3509 | ATGGATGGGCCAGGTGCAGTGGCTCAGGCCTGTAATCCCAGCACTTGGGAGGTCG AGGTGGGAGGATCACTTGA | 3510 |
| | 4 | MGGYQWLRPVIPALWEVEVGGSLETRTSREIGSYASTA TRP* | 3511 | ATGGGCCAGGTCAGTGGCTCAGGACCAGGACTTCAAGAGACTTCATCAGGAGGTCGAGGT GGGAGGATCACTTGAGACCAGGAGTTCAAGAGAAATAGGTAGTTATGCATCTACTG CCACAAGACCCTAA | 3512 |
| hsa-mir-24-1 | 1 | MPYLCNHKFICHAGHSILRSHINLHKVNSLQCIVLWILT NGWARCSGSGL* | 3513 | ATGCCATACCTTTGTAATAATAATTAAGTTCATTGTCATGCGGCCATTCTATCCTAA GATCCCACATTAATTGCATAAAGTTAACTCTCTGCAGTGTATTGTTCTGTGGATTTT GACAAGATGGGGCCAGGTGCAGTGGCTCAGGCCTGTAA | 3514 |
| | 2 | MPAILS* | 3515 | ATGCCGGCCATTCTATCCTAA | 3516 |
| | 3 | MDGRPGAVAQACNPSTLGGRGGRIT* | 3517 | ATGGATGGGCCAGGTGCAGTGGCTCAGGCCTGTAATCCCAGCACTTTGGGAGGTCG AGGTGGGAGGATCACTGA | 3518 |
| | 4 | MGGYQWLRPVIPALWEVEVGGSLETRTSREIGSYASTA TRP* | 3519 | ATGGGCCAGGTGCAGTGGCTCAGGCCTGTAATCCCAGCACTTTGGGAGGTCGAGGT GGGAGGATCACTTGAGACCAGGAGTTCAAGAGACCAGCAGTGCCAGTGCAGTGCAGTGCATTATGCATCTACTG CCACAAGACCCTAA | 3520 |
| hsa-mir-24-2 | 1 | MPYLCNHKFICHAGHSILRSHINLHKVNSLQCIVLWILT NGWARCSGSGL* | 3521 | ATGCCATACCTTTGTAATAATAATTAAGTTCATTGTCATGCGGCCATTCTATCCTAA GATCCCACATTAATTGCATAAAGTTAACTCTCTGCAGTGTATTGTTCTGTGGATTTT GACAAATGGATGGGGCCAGGTGCAGTGGCTCAGGCCTGTAA | 3522 |
| | 2 | MPAILS* | 3523 | ATGCCGGCCATTCTATCCTAA | 3524 |

Figure 1 (Continued)

| | | | | |
|---|---|---|---|---|
| hsa-mir-27b | 3 | MDGFGAVAQACNPSTLGGRGGRIT* | 3525 | ATGGATGGGCCAGGTGCAGTGCAGTGGCTCAGGCCTGTAATCCCAGCACTTTGGGAGGTCG AGGTGGGAGGATCACTTGA | 3526 |
| | 4 | MGQYQWLRPVIPALWEVEVGGSLETRTSREIGSYASTA TRP* | 3527 | ATGGGCCAGGTGCAGTGGCTCAGGCCTGTAATCCCAGCACTTTGGGAGGTCGAGGT GGGAGGATCACTTGAGACCAGGAGTTCAAGAGAATAGGTAGTTATGCATCTACTG CCACAAGACCCTAA | 3528 |
| | 1 | MRKK* | 3529 | ATGAGGAAGAAATAA | 3530 |
| | 2 | MRKFITTRQS* | 3531 | ATGAGGAAATTCATCACTACTAGACAGTCTAG | 3532 |
| hsa-mir-29b-2 | 3 | MFDQGSPTSGNKKMHTIMKTHKIMNSLID* | 3533 | ATGTTCGATCAAGGTAGTCCTACATCTGAAAACAAAAGATGATAATCACTATCATG AAAACACATAAAATTATGAACTCATTGATAGACTAG | 3534 |
| | 4 | MENKKYDPTICCLK* | 3535 | ATGGAGAATAAGAAATATGACCAACTATATGCTGTCTTAAATAA | 3536 |
| | 1 | MRKK* | 3537 | ATGAGGAAGAAATAA | 3538 |
| | 2 | MRKFITTRQS* | 3539 | ATGAGGAAATTCATCACTACTAGACAGTCTAG | 3540 |
| hsa-mir-29c | 3 | MFDQGSPTSGNKKMHTIMKTHKIMNSLID* | 3541 | ATGTTCGATCAAGGTAGTCCTACATCTGAAAACAAAAGATGATAATCACTATCATG AAAACACATAAAATTATGAACTCATTGATAGACTAG | 3542 |
| | 4 | MENKKYDPTICCLK* | 3543 | ATGGAGAATAAGAAATATGACCAACTATATGCTGTCTTAAATAA | 3544 |
| | 1 | MGICIISALMWPEIGGLVSPSLLLVAKQQS* | 3545 | ATGGGTATTTGCATAATCAGTGCTTTGATGTGGCCAGAAATCGGAGGTTTGGTCTCC CCAAGTCTGCTATTAAGGAATGTCAAAAAGGAGGGATG | 3546 |
| | 2 | MIKLKECPKKEG* | 3547 | ATGATTAAACTTAAGGAATGTCCAAAAAGGAGGGATGA | 3548 |
| hsa-mir-302a | 3 | MSKKGGMKDQLSHHSTDTPRPPPPPCFLLFSAVSFPKR LVWGMVHLPWGRPTWHRVGKGRGPLGPRRGQVCRSGS PCPQRVFSPV* | 3549 | ATGTCCAAAAAGGAGGGATGAAAGACCAGCTTCTCATCACTCCACGGACACC CGCCCCCCCGCCCCCTGCCTTTCTATTATTCTCTGCAGTTCTTCTTTCCAAAG CGCTTGGTTTGGGGGATGGTGCATCCACGTGGCACCGAGTG GGCATCGGACAGGGTCCCTAGGGCGGGCAAGGTCTGCAGGAGCGGTTC TCCTTGCCCCCAACGCGTTTTTCCTTCCCCAGTTGA | 3550 |
| | 4 | MLLIILCSFFSKALGLGDGASPLGPPHVAPSGHRQGSPR AKEGPGLQERFSLPPTRFSFPSLIFPAGMGFILWRTLK* | 3551 | ATGCTTCTTATTATTCTCTGCAGTTCTTTCCAAAGCGCTTGGTTTGGGGATGGTG CATCCACGTGGCACCGAGTGGCATCGGACAGGCGTTCCTCTTGCCAACGCGTTTT CCTTCCCCAGTTGATTTGCAGCCGGGATGCGGTTCATCTTATGGAGGACGTTGA AGTGA | 3552 |
| | 1 | MGICIISALMWPEIGGLVSPSLLLVAKQQS* | 3553 | ATGGGTATTTGCATAATCAGTGCTTTGATGTGGCCAGAAATCGGAGGTTTGGTCTCC CCAAGTCTGCTATTAAGGAATGTCAAAAAGGAGGGATG | 3554 |
| | 2 | MIKLKECPKKEG* | 3555 | ATGATTAAACTTAAGGAATGTCCAAAAAGGAGGGATGA | 3556 |
| hsa-mir-302b | 3 | MSKKGGMKDQLSHHSTDTPRPPPPPCFLLFSAVSFPKR LVWGMVHLPWGRPTWHRVGKGRGPLGPRRGQVCRSGS PCPQRVFSPV* | 3557 | ATGTCCAAAAAGGAGGGATGAAAGACCAGCTTCTCATCACTCCACGGACACC CGCCCCCCCGCCCCCTGCCTTTCTATTATTCTCTGCAGTTCTTCTTTCCAAAG CGCTTGGTTTGGGGGATGGTGCATCCACGTGGCACCGAGTG GGCATCGGACAGGGTCCCTAGGGCGGGCAAGGTCTGCAGGAGCGGTTC TCCTTGCCCCCAACGCGTTTTTCCTTCCCCAGTTGA | 3558 |
| | 4 | MLLIILCSFFSKALGLGDGASPLGPPHVAPSGHRQGSPR AKEGPGLQERFSLPPTRFSFPSLIFPAGMGFILWRTLK* | 3559 | ATGCTTCTTATTATTCTCTGCAGTTCTTTCCAAAGCGCTTGGTTTGGGGATGGTG CATCCACGTGGCACCGAGTGGCATCGGACAGGCGTTCCTCTTGCCAACGCGTTTT CCTTCCCCAGTTGATTTGCAGCCGGGATGCGGTTCATCTTATGGAGGACGTTGA AGTGA | 3560 |
| | 1 | MGICIISALMWPEIGGLVSPSLLLVAKQQS* | 3561 | ATGGGTATTTGCATAATCAGTGCTTTGATGTGGCCAGAAATCGGAGGTTTGGTCTCC CCAAGTCTGCTATTAAGGAATGTCAAAAAGGAGGGATG | 3562 |
| | 2 | MIKLKECPKKEG* | 3563 | ATGATTAAACTTAAGGAATGTCCAAAAAGGAGGGATGA | 3564 |

Figure 1 (Continued)

| | | | | |
|---|---|---|---|---|
| hsa-mir-302c | 3 | MSKKGGMKDQLSHHSTDTTRPPHPPPCFLLFSAVSFPKR LVWGMVHLPWGRPTWHRVGIGRGPLGPRRGQVCRSGS PCPQRVFFSPV* | 3565 | ATGTCAAAAAGGAGGATGAAAGACCAGTTCTCATCACTCACGGACACC CGGCCCCCGCCCCCCCATGGTGCATCCCTTGtGCGCCGCCCACGTGGCACCGAGTG CGCTTGGTTGGGGATGGTCCCTAGGGCAAGGAGGGCATCGGCAGGtGTCCCTA TCCTTGCCGCCAACGCGTTTTCCTTGCCCAGTTGA | 3566 |
| | 4 | MLLHLCSFFSKALGLGDGASPLGPPHVAPSGHRQGSPR AKEGPGLQERFSLPPTRFSFPSLIFPAGMGFHLWRTLK* | 3567 | ATGCTTCTTATTCTCTGCAGTTCTTTTTCCAAAGGCGCTTGGTTGGGGATGGTG CATCTCCTTGGGGCCCGCCACGTGGCACCGAGTGCGCATCGGCAGGGGTCCCTA GGGCCAAGGAGGGGCCAGGTCTGCAGGAGCGGTTCCTTGCCCAACGCGTTTT CTTCCCCAGTTGATTTTCCAGCCGGATGGGGATTCATCTTATGAGGACGTTGA AGTGA | 3568 |
| | 1 | MGHCHSALMWPEIGGLVSPSLLLVAKQQS* | 3569 | ATGGGTATTTGCATAATCAGIGCTTTGATGGTGGCCAGAAATCGGAGGTTGGTCTCC CAAGTTGCTATTGGTAGCGAAGCAACAAAGCTAG | 3570 |
| | 2 | MIKLKECPKKEG* | 3571 | ATGATTAAACTTAAGGAATGTCCAAAAAGGAGGGATGA | 3572 |
| hsa-mir-302d | 3 | MSKKGGMKDQLSHHSTDTTRPPPPPPPCFLLFSAVSFPKR LVWGMVHLPWGRPTWHRVGIGRGPLGPRRGQVCRSGS PCPQRVFPSPV* | 3573 | ATGTCAAAAAGGAGGGGATGAAAGACCAGCTTCTCATCACTCACGGACACC CCGCCCCCGCCCCCCCATGCTTCTATTCTCTGCAGTTCTCTTTTCCAAAG CGCTTGGTTGGGGGATGGTGCATCTCCTTGGGGCCGCCCACGTGGCACCGAGTG GGCATCGGCAGGGGTCCCTAGGGCCAAGGAGGCGCCAGGTCTGCAGGAGCGGTTC TCCTTGCCCCCAACGCGTTTTTCCTTCCCCAGTTGA | 3574 |
| | 4 | MLLHLCSFFSKALGLGDGASPLGPPHVAPSGHRQGSPR AKEGPGLQERFSLPPTRFSFPSLIFPAGMGFHLWRTLK* | 3575 | ATGCTTCTTATTCTCTGCAGTTCTCTTTTCCAAAGGCGCTTGGTTGGGGATGGTG CATCTCCTTGGGGCCGCCCACGTGGCACCGAGTGGGCATGGCAGGGGTCCCTA GGGCCAAGGAGGCGCCAGGTCTGCAGGAGCGGTTCTCCTTGCCCCCAACGCGTTTTT CCTTCCCCAGTTTGATTTTCCAGCCGGATGGGGTTCATCTTATGAGGACGTTGA AGTGA | 3576 |
| | 1 | MLNVRFTLLR* | 3577 | ATGTTAAATGTACGCTTTACGCTGTTAA | 3578 |
| | 2 | MYALRC* | 3579 | ATGTACGCTTTACGCTGTTAA | 3580 |
| hsa-mir-30a | 3 | MHVEIHLSNLATCLFTSCG* | 3581 | ATGCATGTTGAAATCATATAAGTAACCTGGCCACTTGCCTATTTACTTCTTGTGGCTAA | 3582 |
| | 4 | MLKSY* | 3583 | ATGTTGAAATCATATTAA | 3584 |
| | 1 | MYPNKVL* | 3585 | ATGTATTTAATAAAGTTTATAA | 3586 |
| hsa-mir-32 | 2 | MGQAQWLMPVIPALCEAKVGRSLEPRSSKPAWPKW* | 3587 | ATGGGCCAGGCACAGTGGCTCATGCCTGTAATCCCAGCACTCTGTGAGGCCAAGGT GGGCAGATCACTGAGGTTCAAAACCAGCCTGGCCAAAATGGTAA | 3588 |
| | 3 | MVKPRLY* | 3589 | ATGGTAAAACCCGTCTCTACTAA | 3590 |
| | 4 | MPVIPATQEAEAGE* | 3591 | ATGCCTGTAATCCCAGCTACTCAGGAGGCTGAGGCAGGAGGAATGA | 3592 |
| hsa-mir-328 | 1 | MMWPGRGTVDGGGGESQANILDFYKRETFILSAPSSPP SPQFVSSSRQGCYPVWGHAGPPGQACLDPGS* | 3593 | ATGATGTGGCCAGGACGAGGAACTGTAGATGGAGGAGGGGAAAGCCAGCCA ATATTTTGGATTTTTACAAAAGGGAAACTTTCATATTAAGTGCTCCTCTCACCTCC AAGCCACAATTCGTCTCCAGCAGCAGGAGGTCTGTTACCCAGTCTGGGGCCACGC AGGACCCTGCAGGGCAGGCTGGATTTTGGATTTTTACAAAAGGGAAACT | 3594 |
| | 2 | MEEEGKARPIFWIFTKGKLSY* | 3595 | ATGGAGGAGGAGGAGCCTCTCTGTTAAACAGGCTGTCCCTGGGTCCATTTAACAGCC TTCATATTAA | 3596 |
| | 3 | MQGGASSVKQSCPWVHLTAKK* | 3597 | ATGCAGGGAGGAGCCTCTCTGTTAAACAGGCTGTCCCTGGGTCCATTTAACAGCC AAAAATAG | 3598 |
| | 4 | MLFSPAAYNFLLPKIWGTKFKLYYYHLAASNIY* | 3599 | ATGTTGTTTCACCAGCTGCTATAACTTCTTATTACCAAAATTGGGGACAAAG TTTAAGCTGTATTACTATCATTTAGCAGCATCCAACATTTATGA | 3600 |
| | 1 | MGHCHSALMWPEIGGLVSPSLLLVAKQQS* | 3601 | ATGGGTCATTGCATAATCAGTGCTTTGATGTGGCCAGAAATCGGAGGACAAAGCTAG | 3602 |
| | 2 | MIKLKECPKKEG* | 3603 | ATGATTAAACTTAAGGAATGTCCAAAAAAGGAGGGATGA | 3604 |

Figure 1 (Continued)

| | | | | |
|---|---|---|---|---|
| hsa-mir-367 | 3 | MSKKGGMKDQLSHHSTDTPRPPPPPCFLLLFSAVSFPKRLVWGMVHLPWGRPTWEHRVGJGRGPLGPRRGQVCRSGSPCPQRVFFSPV* | ATGTCAAAAAAGGAGGAATGAAAGACCAGCTTCTCATCACTCCACGACACCCCGCCCCCCGCCCCCCCCATGCTTCTTATTATTCTCTGCAGTTCTTTCCAAAGCGCTTGGTTTGGGGATGGTGCATCTCCTGGGGCGCCAGGGGTCCCCATGGCATCGCAGGGGGTTCCCCTAGGGCCAAGGAGGGGCCAGTTCGCAGGTCGCAGGAGGCGGTTCTCCTTGCCGCCCAACGCGTTTTCCTTCCCCAGTTGA | 3605 / 3606 |
| | 4 | MLLHLCSFFSKALGLGDGASPLGPPHVAPSGHRQGSPRAKEGPGLQERFSLPPTRFSFPSLIFPAGMGFILWRTLK* | ATGCTTCTTATTATTCTCTGCAGTTCTTTTCCAAAGCGCTTGGTTTGGGGATGGTGCATCTCCTGGGGCGCCAGGGGTCCCCATCGGCAGGGGGTCCCTAGGGCCAAGGAGGGGCCAGTTCGCAGGTCTGCAGGAGGCGGTTCCTTGCCCCAACGCGTTTTTCTTCCCCAGTTGATTGATTTTCCAGCGGGATGGGGTTCATCTTATGGAGGACGTTGAAGTGA | 3607 / 3608 |
| hsa-mir-451 | 1 | MLPFLALFLFCFK* | ATGTTGCCTTTTTTAGCCCTCTTTTTATTTGTTTAAGTGA | 3609 / 3610 |
| | 2 | MTDTEQKFMVRSYVGNSHYHSQDTFAQEGTPSQLVKLLGGK* | ATGACTGATACTGAGCAAGATACTTTTGCCCAGGAGCGGCACCCCATCCCAGCTTGTAAAATTGCTGGGACAAAATGA | 3611 / 3612 |
| | 3 | MRVEEVLLLALKFLL* | ATGATTATCGTAGAGGAAGTTTTGCTCTGCTGGCTTTAAAATTTTTATTATGA | 3613 / 3614 |
| | 4 | MYTRTEL* | ATGTATACCAGGACTGAGTTGTAG | 3615 / 3616 |
| | 1 | MFFG* | ATGTTCATTGGATGA | 3617 / 3618 |
| hsa-mir-455 | 2 | MSQASSPGALTSCVRHLAFHRSQHFQEYLPSGSGTVAHACIPSTLGAQGWMFT* | ATGAGCCAAGCATCAAGTCCAGGAGCACTCACCTCTGTGTGAGGCATCTTGCTTTTCACAGATCTCAGCATTTTCAAGAATATTTACCTTCTCGGGTCAGGACACAGTTGCCTCACGCCTGTATTCCCAGCACTTTGGAGCCCAAGCTGGATGATCACTTGA | 3619 / 3620 |
| | 3 | MPSP* | ATGCCATCTCCTTAA | 3621 / 3622 |
| | 4 | MLFQYL* | ATGCTTTTTCAGTACTTATAG | 3623 / 3624 |
| | 1 | MGLMREPRNKPMHLWSHQHRCQDHTVGKRQFLQ* | ATGGGACTGAATAGAGAACCCAGAAACCCACACAGATGTGGAAAAAGACAGTTCAACAACAGCCAAGATCACCAGAATGTGGGAAAAAGACAGTTTCTTCAATAA | 3625 / 3626 |
| hsa-mir-499 | 2 | MVNYYSTQMPRSHSGKKTVSSINYFSETKNPHVEE* | ATGGTCAATTATTATTATTTCAACACAGATGCCAAGATCACACAGTGGGAAAAGACAGTTTCTTCAATAAATTATTTTCACACTAGAAGAATGA | 3627 / 3628 |
| | 3 | MRPSFRTVPKNQHTHKN* | ATGAGACCCTCATTTCGTACTGTACCCAAAAATCAACACACACAAATTAA | 3629 / 3630 |
| | 4 | MTLVWAKIFYMTLKAWTNT* | ATGACATTGTTTGGGCAAAGATTTTATATGACTCTGAAAGCATGGATAACAAACACATAA | 3631 / 3632 |
| hsa-mir-499 | 1 | MGGRESSESGVEEALVFEGVHVCWALTQGRGJGSQRESPSIWSCGLGJDRALVQLPCRCHLPVPAALGRLEPPGFPAPPPSPQCHCHDGCE* | ATGGGTGCCGCGGAGTTCTCGAATCTGGAGTGGAGGAAGCCCTGTGTTTGAGGGTCGTGCATGTATGTTGGGCACTCACCCAAGGAGCTGCATTGGAGCCAGAGGAGTCGGCTATATCTGGTCTTGGTCTTGTGGGTTGGGGATCTGGGGGTGCCTTGGGCGCCTGTCAGTTCAGGTTTCCAGACTGCCATCTTCCTCCACCCGAGTGCCACTGATGATGTGAGTGACTCCTCCTCCTCCTCCTCACCCGGCACTCACCAAGGAGGCTGCATTGGGAGCTGCATTGGGAGGATGGGGAGTCGCCTAG | 3633 / 3634 |
| | 2 | MYAGHSPKEAALGARGSRLVSGLVGWGIVP* | ATGTATGGTGGCACTCACCAAGGAGGCTGCATTGGGAGCCAGAGGAGTCGCCTAG | 3635 / 3636 |
| | 3 | MLGTHPRRLHWEPEGVA* | ATGCTGGGCACTCACCAAGGAGGCTGCATTGGGAGCCAGAGGAGTCGCCTAG | 3637 / 3638 |
| | 4 | MMDVSELGESARYLRQCYQEMTKVHTIPWDGKWRQRGRGHSHRDALMDSDQELGGVAPAQG* | ATGATGGATGTGAGTGAACTGGGAGAGTCTGCCCGCTACCTCCGCCAGGCTACCAAGAATGACGAAGGTGCACACTATCCATGGGACGGTAAGTGGAGACAGAGGGGGAGGGCGTCATAGCCACGAGAGATGCCCTTATGGACTCAGACCTCAGAGAATTGGGAGAGGGGGGGCACCAGCTCAGGGCTGA | 3639 / 3640 |
| hsa-mir-551b | 1 | MKFLFNLANK* | ATGAAATTTTTATTCAACCTGGCAAATAAATGA | 3641 / 3642 |
| | 2 | MMTPMFLSRIKCWKNEQLHLMTSFAIVPNQSDFGLSQA* | ATGATGACATTCATGTTCTTAAGTCGTATAAAATGCTGGAAAAATGAATAAATCTGGAAATAGAATAAAAAATCTGGAAATTGCTTAAGCCAAGCTTAA | 3643 / 3644 |
| | 3 | MLEK* | ATGCTGGAAAAATGA | 3645 / 3646 |

Figure 1 (Continued)

| | | | | | |
|---|---|---|---|---|---|
| | 4 | MNSSTL* | 3647 | ATGAACAGCTCCACCTTATGA | 3648 |
| hsa-mir-555 | 1 | MSRMVSVWPQHQNVFSKKRCAEYPLIVGPAVGEEVTK MGNNKPLP* | 3649 | ATGAGCAGGATGGTGTCTGTATGGCCCAGCACCAAAATGTGTTAGCAAGAAGCG ATGTGCTGAATACCCACTCATAGTGGTCCTGCAGTGGGTGAAGAAGTCACAAAGA TGGGCAATAACAAGCCCTGCCCTGA | 3650 |
| | 2 | MAPAPKCV* | 3651 | ATGGCCCCAGCACCAAAATGTGTTTAG | 3652 |
| | 3 | MCLARSDVLNTHS* | 3653 | ATGTGTTTAGCAAGAAGCGATGTGCTGAATACCCACTCATAG | 3654 |
| | 4 | MLSAGREDM* | 3655 | ATGCTGTCTGCTGGGAGGAGAAGACATGTAG | 3656 |
| | 1 | MLSSITND* | 3657 | ATGCTGAGTTCCATCACCAACGATTAG | 3658 |
| hsa-mir-559 | 2 | MIQKVWTRLRNMPSPPFI* | 3659 | ATGATTCAGAAGGTCTGGACTAGGCTGAGGAACATGCCCTCTTTCCTTTTTATCTAA | 3660 |
| | 3 | MYLCYLNQGEHR* | 3661 | ATGTATCTCTGCTATCTGAACCAAGGTGAGCACAGATAA | 3662 |
| | 4 | MFIVHYFLKVKFYLIF* | 3663 | ATGTTCATAGTACATTACTTTTAAAGTCAAGTTCTACTTAATTTCTAA | 3664 |
| hsa-mir-568 | 1 | MTQPGSASLSQHAFLGTGGQPDAKRGIKVVSLRVEVSR SKM* | 3665 | ATGACACAGCCGGGCTCTGCCTCTCTATCTCAAATCATTGCTCTTAGGACTGGG GGCCAACTTGATGCAAAGAAGAGGCATAAAGGTGGTGAGCCTGAGGTTGAGGTCTC ACGAAGTAAAATGTGA | 3666 |
| | 2 | MQREA* | 3667 | ATGCAAAGAGAGGCATAA | 3668 |
| | 3 | MRLPREHTANTA* | 3669 | ATGAGGCTGCCAAGAGAGCACACTGCTAACACTGCCTGA | 3670 |
| | 4 | MDGSRGAGTQRREMAVGGVKAPQPSGRWGKRPLSTR DLAHLLFDSVDYPSKCSL* | 3671 | ATGGATGGGAGCAGGGGGCAGGGACCCAAAGGAGGGAAATGGCTGTGGGTGGTG TGAAGGCCCCCCAGCCTCAGGAAGGTGGGCAAGAGACCACTGAGCACAAGGGAT CTTGCCCAACTCTCTTTTGACTCTGTGGATTATTCCATCTCACTGTGA | 3672 |
| hsa-mir-615 | 1 | MFQRRTASGPEPVTRATRLWNSRKNSTLTATSLAAGA* | 3673 | ATGTTCCAAGAGACGGACGGCAAGGTGACCAGATGGCTTAACGCTGAACGGCTACCAGACT CTGAACCTGAGAAGAATTCCACTTTAACCGCTACCTCACTGGCGCAGGCGCATA G | 3674 |
| | 2 | MRDRSRSGSRTAG* | 3675 | ATGAGAGACAGATCAAGATCTGGTTCAGAACCGCACGATGA | 3676 |
| | 3 | MKWLKDSKMKSKEAL* | 3677 | ATGAAGTGGAAGAAGATTCCAAAATGAAAAGCAAAGAGGCTCTTTAG | 3678 |
| | 4 | MNDLHMKGEHRPRAPTVALCFPNLISTTSSPQNPGTSPA CACCMPSQAGSPSLLASSTSGVSWHWTPASGPRGPLLS HSPCREFLCPPFDFLLLSNYLLTLGFS* | 3679 | ATGAATGATTTGCATATGAAAGGAGAGCATCGCCTAGGGCCCACAGTTGCTCTA TGCTTTCCAAACCTTATCTCACTACATCTTCCCCTCAAAACCCGGGAACCTCCCAG CCTGCGCCCTGCTGCATGCCCTCAGGCGGCAGCCCAGCTGTCCAA CTAGTGGGGTTTCCTGGCACTGGACCCCAGGAAGTGTCCTTAGAGGCCCTTTGCGT CCTATAAGTCCATGCCCGCAATTTCTGTGCCCTCTGACCCATTGCTGTTGTCCAACTA TTTATTGACTCTGGGCTCCTTCTGA | 3680 |
| | 1 | MGTFCPQSSSHSNCFVGLAKPQRERKQRHSP* | 3681 | ATGGGCACCTTCTGTCCCCAGTCCTCTCCCAGTCACATCAAATGCTTTGTGGGACTGGCTA AGTTTCAAAGGGAAAGAAAACAAAGGCACAGTCATAG | 3682 |
| | 2 | MCVCVVCLWACMYYVRGLSYFTRVFTRVCMCACGVCV HTRVSCMCMWSVCAYACVCTQVCGVGAVSPHSLL* | 3683 | ATGTGTGTCTGCGTGGTATGTTTGTGGCATGCATGTACGTGCGTGGCGTGTGTG TTCACACGTGTGTTCACACGTGTTCATGTGTGTCCTGTGGGGTGTGCGTTCACACG CGGTATCATGCATGCATGTGGAGTGTGTCTCGCGCCTATGCCTGTGTGCACACAG GTGTGTGAGGGTGGGAGCTGTCTCGCACTCTCCTTTAG | 3684 |
| hsa-mir-671 | 3 | MFVGMHYRAWLVCVHTCVHTCVHVCLWGVRSHARIM HVHVECVVRLCLCVHTGVWGGSCLSALSPLAFLTLCQDT LRSHSPGRTALRPYRIPQGANPGNPATPGVRTAVTWEG SAAFLPPPSSTSLHLASGLSMPALVPLSLVT* | 3685 | ATGTTTGTGGGCATGCATGCATGTACGTGCGTGGCTTGTCGTGTTCACACGTGTTCAC CATGTGTGTGGCATGTGCGTCTGCGTTCACACGCGTATCATGCATGTG CTGTCTCCGAGTGTTGTGCGCTATCCTGTGGGCGTCGTTCCTGACTCTGTGCCAGGAGTAC CCGGCTGTGCAGCTCCAGGACACCCTAGGC TCCAACTCTCCAGGAATGCTGCCACCCGTCAGCACCAGCTGTCAACTGGAGGCCAGTG CTGCTTTTTCTCCCCCCTCGGTTCTTCTTCCACTGGTGACATGA | 3686 |

Figure 1 (Continued)

| | | | | | |
|---|---|---|---|---|---|
| | 4 | MPVCAHRCVGWELSLRTLSFSLPDSLPGHPTLPLSRKNS TETLQNTPGSEPGESCHPWSEDSCHLGGQCCFSPPSVQH QPPPGQWPFYACAGSSFTGDMRASHQLRLGQASQRTP GPFPSQPPALASSEHRHEPGRGGLSLTPYCFPRNCLAGK RPRMPPALYESRATSADSHGNPGRLEELLSPPASDK* | 3687 | ATGCCTGTGTGTGCACAGGTGTGTGGGGTGGAGTGTCTCCGCACTCTCC TTTAGCCTTCCTGACTCTGCAGAACCACCTACGCTCCCACTCTCCAGGAAGAAC AGCACTGAGACCCTACAGAGATACCCACCTGGGAGGAGGGCAGTCCTGCCACCG CTGGAGTGAGGACAGCCTCCACCTGGCCAGTGGCCTTTCTATGCCTGCGCTGGTTCCTTCTC CAGCACCAGCCTCCACTGGCCAGTGGGCTTTCTATGCCTGCGCTGGTTCCTTCTC ACTGGTGACATGAGGGCGAGTCACCAGCTCCATCTGGGACAGGCCTCCCAGCGAAC TCCTGGCCCCTTCCCCTCCAACCCCTGCCTGGCAGTCAGCAGAGCACAGACATGA GCCAGGTAGGGGGGGTCTCAGCTCACTCTTTACCAGTCTACCAAGTGCCACTGGC AGGAAAAGGACGCCTGCCGATGCCCCCAGCTCTTTACCAGTCTACCAAGTGCTGA CTCTCACGGGAACCCTGGGAGACTAGAAGAGTGTTATCACCACCAGCATTGACAA GTAA | 3688 |
| hsa-mir-7-1 | 1 | MFLTVIQHCLSSTYALASHLSYINDNPVFFLHTLFPLSFF FPNYFSLCLSYRDFFSL VILG* | 3689 | ATGTTCTTACTGTAATACAACACTGCTGTCTTCCACATATGCATTAGCTTCTCATC TCTCATATATTAATGATAATTTGTCTTCTTCCTGCATACTTTATTTCCTCTAAGTTTT TTTTTTTTCCTAATTATTTCAGTCTCTCTGTCTTCATAGAGATTTCTTCAGTCTGGT GATTCTTGGCTAG | 3690 |
| | 2 | MHLSSSCLYFL* | 3691 | ATGATAATTTGTCTTCCTGCATACTTTATTTCCTCTAA | 3692 |
| | 3 | MGFQRVIDLRLCAHDRGLSNVRFTAGRASWTT* | 3693 | ATGGGGTTCCAAAGAGTGGATCTAAGGCTCTGTGCTCATGATAGGGGTTTGTCAAAT GTTCGCTTCACTGCTGGGAGAGCCAGCTGGACCACTTAG | 3694 |
| | 4 | MGVCQMFASLLGEPAGPLSQ* | 3695 | ATGATAGGGGTTTGTCAAAGTTCGCTTCACTGCTGGGAGAGCCAGCTGGACCACTT AGTCAGTGA | 3696 |
| hsa-mir-875 | 1 | MLSSITND* | 3697 | ATGCTGAGTTCCATCACCAACGATTAG | 3698 |
| | 2 | MIQKVWTFLRNMPSFPFFI* | 3699 | ATGATTCAGAAGGTCTGGACTAGGCTGAGGAACATGCCTCTTTCCCTTTTTATCTAA | 3700 |
| | 3 | MYLCYLNQGEHR* | 3701 | ATGTATCTCTGTATCTGAACCAAGGTGAGCAGATAA | 3702 |
| | 4 | MFIVHYFLKVKFYLIF* | 3703 | ATGTTCATAGTACATTACTTTTTAAAGTCAAGTTCTACTTAATTTCTAA | 3704 |
| hsa-mir-9-1 | 1 | MVSIS* | 3705 | ATGGTCTCCGATCTCCTGA | 3706 |
| | 2 | MSHCAQPRHFLTTHGTPTKTNHHLGHKENY* | 3707 | ATGAGCCAACTGCGCCCAGCTCGCCCAGAATTCACTTCTTTTAACTACTCATGGAACCCT ACAAAACACTAACCATATTTAGTCACAAAGAAAATGTTAA | 3708 |
| | 3 | MEHLQKLTIF* | 3709 | ATGGAACACTTACAAAAACTAACCATATTTTAG | 3710 |
| | 4 | MFKNHKCNEFFKSQN* | 3711 | ATGTTTAAAAATGCAATGCAATGAAGTCAATTTTTAAATCACAAAATTAG | 3712 |
| hsa-mir-9-2 | 1 | MSVLVFHKLDNRK* | 3713 | ATGAGTGTATTGTTCTTCATAAAGCTTAGATAACCGAAAGTAA | 3714 |
| | 2 | MKDYSRETVKTRKVRMTY* | 3715 | ATGAAAGACTACAGCCGAGAGACAGTAAAACCAGAAAGGTCAGGAATACTTATTGA | 3716 |
| | 3 | MIKGGMREN* | 3717 | ATGATTAAAGGTGCGATGCGATGAGAGAAATTAA | 3718 |
| | 4 | MTHTC* | 3719 | ATGACACACATGCTAA | 3720 |
| hsa-mir-99a | 1 | MFLNKCKNNF* | 3721 | ATGTTTCTAAACAAGTGTAAAATAATTTTAA | 3722 |
| | 2 | MLLKNSASINENYNLHTKN* | 3723 | ATGCTTTTGAAAATTCAGCAAGTATCAATGAAGTATCAAGAATTTGCATACTAAGAAT TGA | 3724 |
| | 3 | MKTHCILRIDVHFR* | 3725 | ATGAAAACTATAATTGCATACTAAGAATTGACGTTATATATTCGGTAA | 3726 |
| | 4 | MLLKSYFLILQICRVNNEKCRTD* | 3727 | ATGCTTTTAAAATCATATTTCTTATATTACAAATGTAGGGTAAACAATGAAATGAAAAA TGTAGAACTGATTAA | 3728 |

Figure 1 (Continued)

| | | | | | |
|---|---|---|---|---|---|
| hsa-let-7a-1 | 1 | MGLRAFRGARPCIGLPATALLSLRPPRRPPAPPSGSWR GALPAATGARAGAFPRPRRFPSPRARGGYGGRGSERGSV AILFRGDSRQRYVGRMGEPCAGPRLSG* | 3729 | ATGGGCTTGCGGGCTTTCGCGCGCGCCGCCCTGCATCGGCCTCCGGCGACCGCG CTGCTTTCCGCTCAGCCCCGGCACGCCGGCAAGCGACGGGCGCGGCCATTCCACGGCCGCG CGGGGTGCTCCCGGACGGCGAGGTGGTATGGCGAGCGCGGGCAGCGAGCGCGGGT ACGGGGCCTGCCGAGCGGAGGTGGTATGGCGAGCGCGGGCAGCGAGCGCGGGT CCGTGCGCCATTTATTTCGCGGAGACTCGCGCAGCGGGTGCGCAGAATGGGAGAG CCGTGCGCCGGCCGCCGGCCGCCGGCCTGCCGGCTAA | 3730 |
| | 2 | MADAAASAGPSPFYFAETRGSGWAEWESRAPARACPA NAGWDWWGGLPPPAGGWPRGAGGHLLAEVAGARGTGE GCRVAAAGPAPTPSASRPAPHRQGGGGVILHIPYPALP PASIKLGAGGRPAFRPAPVGRRRL* | 3731 | ATGGCCGACGGCAGCGCAGCCGTAGCAGAATGGCAGAAGCGCGGTCCGTGCGCCATTTATTTCGCGGAGACTCG CGCAGCGGACTGTGTGGGCGCGCCTGCCCCTCCAGCGGCGGTGGCCCGG GGGGCCGGCCGGGCCGCGTGCTAGCGAAGTCGCGGCGCGCGGGCGGCGAGGGGT GCCGGTGGCGCGCCAGGGGCCCGGGGCTCAAACCCCCCGGCCGCCCAGTTCTC ACCGACAGGGCGGGGAGGGGGGGGGGTCATTCTTCACATCTTACCCGGCCTTCCC GCTTCAATCAAACTTGGGGCGGCGGAAGGCCGGGCCGGCCGGCGCCGTTTG GCCGCGCCGCTCTGA | 3732 |
| | 3 | MKEGR* | 3733 | ATGAAGGAGGAAGGTAG | 3734 |
| | 4 | MPLLPAAKCSLPS* | 3735 | ATGCCCCTGCTCCCGGCGCCAAGTGCAGCCTCCCTTCCTGA | 3736 |
| hsa-let-7a-2 | 1 | MGPLIQGFHRPAGADGVRDLTMAPARSCCVLSEA* | 3737 | ATGGGACCCTTGATACAAGGCTTTCATAGACCAGCCGGTGCTGATGGGGTCCGGGA CTTGACGATGGCCCGTGCTCGTTCCTGTGTTCTATCTGAGGCATGA | 3738 |
| | 2 | MGSGT* | 3739 | ATGGGGTCGGGACTTGA | 3740 |
| | 3 | MIPPRFWEVESTGQRLHLTH* | 3741 | ATGATTTTCTTTCGTTTTTGGGAGGTAGAGAGCACGGGCAGAGTTGCACTGACA CATTAG | 3742 |
| | 4 | MGVTVPPCLPLYLDKDLLYPDF* | 3743 | ATGGGGTTACTGTGCCCCCTGTCTACCCTGCTTTATCTGATAAGGACTTGCTTT ATCCTGATTTCTAA | 3744 |
| hsa-let-7a-3 | 1 | MPGTVAAPLSFLIEGQLLLGPGVVDSALDLSQGTGLPS WLGRRITGGHLNKPLPLSGSQFTHL* | 3745 | ATGCCCGGCACCGTGGCTGCTCCCCTGTCCTTCCTGATCGAAGGCCAGCTGCTG GTCCTCGGTGTCGTGGACTCAGCCCTGGATCTGAGTCAGGGCACTGGGCTCCCATCC TGGCTCGGGCGTAGAATCACTGGTGGGCACTTGAATAAGCCCCTTCCTCTCTCCGGG TCTCAGTTTACCCATCTGTAA | 3746 |
| | 2 | MKSSIYFLSSLQCREERKTKRK* | 3747 | ATGAAAAGCTCCATCTATTCTTGAGTTCCTTGCAATGCCGAGAAAAGACAAAG AGAAAATGA | 3748 |
| | 3 | MPRKKDKEKMKPQYTVAAGFSRLGFLFAFKEGFPPLGK ESWNLTRDDCLRGGEPARAHGHAAWKV* | 3749 | ATGCCCAGAAAGAAGGATAAAGAAATGAAGCCACAGTACACTGTTGCTGCCGG GTTCTCAGAACTGGGATTTCTTGTTTGCTTTCAAAGAGGGTTTTTTCCTCTAGGGAAA GAGTCATGGAATTTGACCAGAGATCACTGGTGAGCGGCCAAGAGCCAGCCAGAGC CCACGGACATTGAGCATGAGAGGTGAA | 3750 |
| | 4 | MEFDQR* | 3751 | ATGGAATTTGACCAGAGATGA | 3752 |
| hsa-let-7b | 1 | MPGTVAAPLSFLIEGQLLLGPGVVDSALDLSQGTGLPS WLGRRITGGHLNKPLPLSGSQFTHL* | 3753 | ATGCCCGGCACCGTGGCTGCTCCCCTGTCCTTCCTGATGAAGGCCAGCTGCTG TGGCTCGGGCGTGGAACTCAGCCCTGGATCTGAGTCAGGGCACTGGGCTCCCATCC TGGCTCGGGCGTAGAATCACTGGTGGGCACTTGAATAAGCCCCTTCCTCTCTCCGGG TCTCAGTTTACCCATCTGTAA | 3754 |
| | 2 | MKSSIYFLSSLQCREERKTKRK* | 3755 | ATGAAAAGCTCCATCTATTCTTCTGAGTTCCTTGCAATGCCGAGAAAAGACAAAG AGAAAATGA | 3756 |
| | 3 | MPRKKDKEKMKPQYTVAAGFSRLGFLFAFKEGFPPLGK ESWNLTRDDCLRGGEPARAHGHAAWKV* | 3757 | ATGCCCAGAAAGAAGGATAAAGAAATGAAGCCACAGTACACTGTTGCTGCCGG GTTCTCAGAACTGGGATTTCTTGTTTGCTTTCAAAGAGGTTTTTTTCTAGGGAAA GAGTCATGGAATTTGACCAGAGATGATTGTTTGAGGGGCCAAGAGCCAGCCAGAGC CCACGGACATGAGCAGCAGAGATGA | 3758 |
| | 4 | MEFDQR* | 3759 | ATGGAATTTGACCAGAGATGA | 3760 |

Figure 1 (Continued)

| | | | | |
|---|---|---|---|---|
| hsa-let-7c | 1 | MRLLCPCCRKEPADWPLSAAHSTGWL* | 3761 | ATGCACCTATTGTGTCCCTGCTGCAGAAAGGAGAGCCTGCCGATTGGCCACTGTCTGCAGCACATAGCACTGGCTGGTTATAA | 3762 |
| | 2 | MTAFFLQGGWRESGEGGGVSSTVKAAQIFFLSLSLPLHRLFLPHALSHFA* | 3763 | ATGACTGCATTCTTTTGCAAGGGGGTGGAGGGAAGGGAAGGAGGGGTGTCAGCTCAACTGTAAAAGCTGCACAGATTTTTCTTCTCTCTCCATCAGATTGTTTCTGTTTCATTCGCTGTCTCATTCGCATAG | 3764 |
| | 3 | MPCLISHS* | 3765 | ATGCCCTGTCTCATTCGCATAGCTAA | 3766 |
| | 4 | MLIKIPCLNLKNNDSAVIRNLYRV* | 3767 | ATGCTAATTAAGATCCCTTGTCTTAACCTGAAAAATAATGACTCGGCTGTAATTAGAAATCTGGTGAGAGTTTAA | 3768 |
| hsa-let-7c | 1 | MVCERISVCLGRKLFDLQKSQKTSR* | 3769 | ATGGTTTGTGAAAGATATCGTGTGCTTAGGGAGGAAACTTTTTGATCTGCAGAAAAGCCAGAAGACATCTAGGTAA | 3770 |
| | 2 | MFTFVEVQNVLTIVCLFFVCLFKS* | 3771 | ATGTTCACTTTTGTAGAAGTCAAATGTACTGACGATTGTTGCTTATTTTTGTTGTTTGTTAAATCTTAA | 3772 |
| | 3 | MLLWKEY* | 3773 | ATGTTGCTTTGGAAGGAATATTAA | 3774 |
| | 4 | MRPLCT* | 3775 | ATGAGGCCCTTGCACATGA | 3776 |
| hsa-let-7c | 1 | MLLLDSSCLIFLLLWLF* | 3777 | ATGCTTCCTAGACAGCAGTTGTCTGATATTTCTCCTTTGTGGTTGTTTTAG | 3778 |
| | 2 | MDMKSEESDHRRKPFQVKIK.NKEQIRFTVFKEKQHSFDCVLL* | 3779 | ATGGATATGAAAAGTGAAGAAAGTGATCATAGGAGAAAGCCATTTCAGGTAAAAAATAAAAAACAAAGAGCAAATAAGATTTACTGTTTTAAAGAAAAACAACATTCTTTTGACTGTGTTTGTTATAA | 3780 |
| | 3 | MSVTVEHLMVFI* | 3781 | ATGAGTGTAACTGTGGAAATTTTATTGATGGTTTTCATTTGA | 3782 |
| | 4 | MCAMTYLCEKFLVVNWAVCVPLNICLCIHTLKIGAIRFTRKLYRKRKKLYPLICCTI* | 3783 | ATGTGTGCTATGACCTACCTTTGTGAAAATTTCTTGGTCAATTGGGCAGTTTGTGTCCCATTGAATATATGTCTGTGTATCCATACGCTTAAGATAGGTGCAATACGGTTACTAGAAAAGCTTTATAGGAAAAGAAAAAATTATATTTCTTATTTGTTGTACCATATAA | 3784 |
| hsa-let-7d | 1 | MGLRAPRGARPCJGLPATALLSLRPPRRRPPAPPSGSWRGALPAATGARAGAFPRPRRPSPRARGGYGRGSERGSVAILFRGDSRQRVGRMGEPCAGPRLSG* | 3785 | ATGGGCTTGCGCGCTTTCCGGGCAAGGCCTTCCCTCAGGCGCCGGCGCCATCGGGTCTGGCTGCTTCGCTGTCTCCGCGGCGACGGGCGCTGCAGGGCGCTCCATCCCACGGCGCGCGGGTGTCCCTCGCGAGCGCGAGCGGGTGGTATGCGGACGGCAGCGAGCGCGGGTCCGTGCCGCCTCGCCAGCGGAGACTGGCGCCAGCGGTGGGCAGAATGGGAGAGCCGTGCGCGCCGCGCTGTCCGGGCTAA | 3786 |
| hsa-let-7d | 2 | MADAAASAGPSPFYFAETRGSGWAEWESRAPARACJPANAGWDWWGGLPPPAGGWPRGAGGLLAEVAGARGTGEGCRVAAAGPAPTPSASRPAPHRQGGGGGVILHPYPALPPASJKLGAGGRPAFRPAPVGRRRL* | 3787 | ATGGCGGACGGCGGCGGCAGCGGCGTCGTGCCATTTTATTTCGCGGAGACTCGCGGCAGCGGGTGGGCAGAATGGGAGAGCCGTGCGCCGCGTGCCTGTCCGGCTAACGCGGGCCGGAGACTGGTGGGACTGTGGCTAGCGGAAGTCGCGGCAGGTTGGCCGGGGCACGCCGGGGTGCCGGTGCCGCCCGGGGCGCCGGAGCGCGGAGGGGGAGGGGGGGTCCAACCCCTCGCGCTCGCAACCCCTCGCCTCCTCACATTCTTCACGCTCCTACCGCGCCTCCCCACCGACAGGCGGCGGGAGGCGGCCCAATCAAACTTGGGCGGCGGGAAGGCCGCCTTCCGGCCCGGCCGCCTGTTGGCCGGCGCCGGCCTCTGA | 3788 |
| | 3 | MKEGR* | 3789 | ATGAAGGAGGAAGTAG | 3790 |
| | 4 | MPLLPAAKCSLPS* | 3791 | ATGCCCCTCCTCCCGCGCCAAGTGCAGCCTCCCTTCTGA | 3792 |

Figure 1 (Continued)

| | | | | |
|---|---|---|---|---|
| hsa-let-7e | 1 | MGDTDNAPQAEKEDGDRERAKGRTDVQRQKGGQTER DTERQQKQPRMTGAERRRERGRERERERERECGREG ERERESTHRARRRRREEGGRPARDRTGRRGGGELGKA GEERFWPRRAGERERRPRRLPASFVPSLLCVRLLWPG LPLPLPPPRGWAMEFPPLDIGQLRCRGEARPDWAGRW GEAGAGGPLLGRGLVRRPRSRRGPGRGSPGPQSRGGGD GRREESGRREGGWRGRREEGERPPCGEGGERMESARRR WGPACGPGAAEKTPSLRRGSRGSRESAEREGGGLGPAL LGP* | 3793 | ATGGGAGACACAGATAATGCCCACAGGCAGAGAAAGAGGATGGAGATAGGGAGA GGGCGAAAGAGAGGCAGCAAAAGAGAACCAAGAGAATGACGAGGACCAGAGGAGGAGGAGGAGGAGGAGAGGAGGAGAGAGGAGGAGAGGAGGAGAGGAAGAG GAGAGGCAGCCAGTGAGGCGAGGGGTCGGAGGAGGCGAGGAGCTAGGGG AAAGCCGGGGAGGAGAGCCGAGACTGGCCGAGGAGGGGCCGGCGAGCGAGCGCC GCCCCGGGCCTCCGGCTCTTTGTCCCTCTCCCGGCCTCCTCGTCAGGCTTCTCTG GCCGAGGCCCTCCCCCTGCCTGCCTGCCGGAGGAAGCCAGGCGGGAGCCGGCTGGC CTGGACCTGGGCAAGGCTCCGGCAGGGGTGAAGCCAGGCCGGGACTGGCTGGC GCGCAGCGCGGCGGGTCCAGGAGGGGAGCCCGGGCGGCGGAGCCGCAGAGCCGGAGGA GGTGACGGCGGAGGCCGCGCGCGTCGCGAAGGCCCGGGAGGATGCGGGGACGGCGG AGGAAGGGAGAGAGGCCGCGCGTCGCGAAGGCGGAGAAGGATGGAGAGCGCTCG GCGCGGGTGGGCCTCGGGGAGCGCGTGAGTCTGCGAAAGGGAGGTTGGGGTGGG GCCGCACTCCTGGGTCCCTGA | 3794 |
| | 2 | MPHRQRKRMEIGRGRKEGQMCRDRREDRRKETQRGSK SNQE* | 3795 | ATGCCCACAGGCAGAGAAAGAGGATGGAGATAGGGAGAGGCGAAAGGAAGGAC AGATATGCAGAGAGAAGGGAGGACAGGACGGAAAAGAGACACGAGAGGCAGCAA AAGCAACCAAGAATGA | 3796 |
| | 3 | MAGTAGRGEAAVRRRGEIDGERSAAVGPGLRARGG GEDPFPATREPREP* | 3797 | ATGGCGGGGACGGCGGGGAGGGGAGAGGCGCCGTGCGAAGGCGGGGGCGG AGGATGGAGAGCGTTCCCTGCGACGCGTGGGCCGGGCCCGGCCTGCGGCGGGCGG AGAAGACCCCTTCCCCGACGACGCGACCGAGCCGCGGAGCCGTGA | 3798 |
| | 4 | MGAGAGRIVAGRD* | 3799 | ATGGGGCTGGGCTGGTAGGATCGTGGCTGGAAGAGACTAG | 3800 |
| hsa-let-7f-1 | 1 | MGLRAFRGARPCIGLPATALLSLRPPRRPAPPSGSWR GALPAAYTGARAGAFPRPRRPSPRARGGYGGRGSERGSY AILPRGDSRQRYVGRMGEPCACGPRLSG* | 3801 | ATGGGGCTGCGGGCCTTCCGCGGTGCGCGCCCCTGCATCGGCCTCCCGGCCACCGCGCTG CTGTCGCTCTCCCGGCCACGGCGCCGCGCCCACCGCGTCGAGGCCGGCGAGCATTCCACGCGCGCG CCGGGCCCTTCTCCGGAGCGCGGAGTCGGCGCAGCCGAGCGCGGAGGGCGGGGTG CCGTCGCCATTTATTTCCGCGCGCCTGTCCGGCTAA | 3802 |
| | 2 | MADAAASAGPSFYFAETRGSGWAEWESRAPARACPA NAGWDWWGGLPHPAGOWPRGAGLLAEVAGARGTGE GCRVAAAGPAPTPSASRPAPHRQGGGGGGVILHIPYPALP PASIKLLGAGGRPAFRPAPVGRRRL* | 3803 | ATGGCGGACGCGGCAGCGAGCGGGGTTCGGTCGGCCATTTTATTTCGCGGAGACTCG ACCGCGCGGTGGGCAGATGGTGGGCGCAGAATGGGTCGGCCGGTGCCCGGCTA CGCCGCGGGGCGAGTGCTGCTAGCGCAAGTCGCGGAGCGGCCGGGCACGGGGAGGGGT GGGGGCCGGCGGCTGCTGTCGCGCGCCGGGCGGCTCGGCGCTTCCCGGCAGTCTC GCCGCGTGGCCGCGGGGGGGCGGAGGGGGGTCATCCCATCCCGGAGGCCCCCCC CGCTTCAATCAAACTTGGGGCGCGGGCGAAGGCCCGGCTCGGCCTGCGCCGTTG GCCGGCGCCCCTGA | 3804 |
| | 3 | MKEGR* | 3805 | ATGAAGGAGGGAAGTAG | 3806 |
| | 4 | MPLLPAAKCSLPS* | 3807 | ATGCCCTGCTCCCCGGCGGCCAAGTGCAGCCTCCTTCCTGA | 3808 |
| hsa-let-7f-2 | 1 | MKVDRTKLKKTPEAVSIQKFTLLIFSSLKNKKIFVNSSSS MLFKSHHPYTQKAVKQQLV* | 3809 | ATGAAAGTTACTTGCTTATTTTTCTCATTCATTAAACTGAAGAACAACCACTGAGGCTGAAGTATCCA AAAGTTTACTTGCTTATTTTCTCATCAAATCTCATCACCCATATATACAAAAGGCAGTAAAACAACAA CTTGTCTAG | 3810 |
| | 2 | MDSQETSGK* | 3811 | ATGGATAGCCAAGAGACCAGTGGAAAGTGA | 3812 |
| | 3 | MQKGCVV* | 3813 | ATGCAGAAAGGATGTGTGGTATAA | 3814 |
| | 4 | MCGHMERADMGSDF* | 3815 | ATGTGTGGTCATATGGAAAGAGCAGATATGGGTTCAGATTTTTAA | 3816 |

Figure 1 (Continued)

| | | | | | |
|---|---|---|---|---|---|
| hsa-let-7g | 1 | MKLTDSVLRSFRVAKVFRENSDKINCTDFSPNGETVISS SDDDISIVLYIDCQEGK* | 3817 | ATGAAGCTGACCGACAGCGTGTTGCGGAGCTTCCGCGTTGCTTAAGGTGTTCCGGA AAACTCGGACAAGATTAACTGCTTCAGATTTCAGCCCAACGGCGAGAGGGCAAGTGA GAGTAGCGACGACGACTCCATCGTGCTCTATGACTGCCAGGAGGGCAAGTGA | 3818 |
| | 2 | MTARRASECCGCGPGPESQCLPPVAQHRSLGLPSVPTSAP SLFCTRSCQGRLHPAAVQETYFFLLKKR* | 3819 | ATGACTGCCAGGAGCGCCGGTGCCCAGCACAGTCCCCTGCCCGTGGCCCAGCACCGG CCCTCCCTCCGGTGCCCAGCACAGTCCCCTGCCCGTGGCCCGAGTTCAGG CCCAGCTCTATTGCACGGTTCTGCCAGGGCGCTCACCCGGCAGCCGTCCA GGAGACCTTTTATTTTTTCTTCTTAAAAAAAAGATAA | 3820 |
| | 3 | MSSVSPERYASLAKPHLDLDL* | 3821 | ATGTCTTCGGTCCTTGAGCGCTATGCATCACTTGCCAAACCCCACTTGACCTTG ACCTTTAA | 3822 |
| | 4 | MHHLPAFTLTLTFKRPVRPPWAHQVAFSAPQAVKGAGL LRPRRTAGAAFLPPSAASALSCALSTVTSIPPWHSAHPL PLSFRPPFCRQTAWVALLSCQDLPVVPL* | 3823 | ATGCATCACTTGCCAAACCCCACCTTGACCTTGACCTTTAAACGCCCGGTCAGGCCCA CCCTGGGCCACCAGGTAGCGTTTTCAGCTCCAGCTGTCAAAGGTGCTGGTCTG CTCTGGAGGCAGGACTGCAGGGGCTGCTTTCCTCAGCACTGCACCTGCAGCGTA GCTCTCTGTGTCTCAGCTGCCTCCTGCGCCTTCTGCGTGACACTGGCTGTGGGTTGCACTTCT CCCGGCCCCCAGCTTCTGCGTCAGATTATTGTTTGTGCGCCCTTTA TAGCTGTCAGGATTATTGTTTGTGCCCCTTTGA | 3824 |
| | 1 | MAARGAAWRGGHYVRSSARASLSDL* | 3825 | ATGGCGGCGCGGGCGCGTGGCGGCGGTCAGTGTGGCGAGTAGCGCGC GAGCCCTTCCTTAAGTGAATCTCTAA | 3826 |
| | 2 | MPWLLPGGAGGSLCGMPAGDYRRRERAGGGFDSAAR VGARVPDSAAAQPPPGTRSREGRERRSSGRGGSS* | 3827 | ATGCCCTTGGCTGCTGTTTGGCGGAGCCGGCGGAGCCTCCGCGATGCCGCCGG CGATTACGGCGCCGAGAGCGGGCGCCGGTGGACAGCGCCGGCGCGGTGG CCCCGCAGTACCGGACTCGGCGCAGCGGGACGTGGGAGCAGG GAGGCGCCGAGCGCCAGCCGGTGAGCAGTCCTAG | 3828 |
| | 3 | MALAEVYYCAVGRVVTLPAVETTAQATALLVLVMLSA AEDNGWESPLFSGALPGDSPRSLGARPARPPRKPLVSHF PRRN* | 3829 | ATGGCCCTGGCTGAGGTAGTAGTTGTGTGTGCTGAGTAGTCTTGTGACATTGCCGCT GTGGAGATAACTGCTGCAAGTAACTGCCTAGTGGTGATGCTGCTAGGCGCCG GAGGCAATGGCTGCGAATCCCCTTGTTTTCCGGGCGCTGGCTAGTCAGGGGACAGCC GCGAAGCCTCGGCGCCGCCGGCCACCACGGAAACCGTTAGTTTTCACATTT TCCTAGAAGGAATGA | 3830 |
| | 4 | MAGNPLCFPGRCLGTAREASAPGRRGHHGNR* | 3831 | ATGGCTGGGAATCCCCTTGCTGTTTTCCGGGGCGCTGCCTGGGGACAGCCCCGGAAGCC TCGGCGCCGGCCGGCCACCACGGAAACCGTTAG | 3832 |
| hsa-mir-100 | 1 | MGPLIQGFHRPAGADGVRDLTMAPARSCCVLSEA* | 3833 | ATGGGACCCCTTGATACAAGGCTTTCATAGACCAGCCGGTGCTGATGGGGTCCGGGA CTTGAGAGATGGCGCCGTCGGACTTGA | 3834 |
| | 2 | MGSGT* | 3835 | ATGGGGTCGYGGACTTGA | 3836 |
| | 3 | MIFFRFWEVESTCQRLHLTH* | 3837 | ATGATTTTCTTCGTTTTGGGAGGTAGAGAGCACGGGCAGAGGTTGCACCTGACA CATTAG | 3838 |
| | 4 | MGVTVPPCLPLLYLIDKIDLLYPDF* | 3839 | ATGGGGGTTACTGTGCCCCGTGCTACCGCTCTTATCTTGATAAGGACTTGCTTT ATCCTGATTTCTAA | 3840 |
| | 1 | MTQASRGRGAHAAARPSPHRHSSMV* | 3841 | ATGACGCAGGCCTCGCTGCGGGAGCACATGCACATCTTCCCTCCACATCGT CACTCTTCTATGGTTTAG | 3842 |
| hsa-mir-10087-1 | 2 | MQPVPLHIVTLLWFRSFSRTLLPGSELAQAVTSSCRTFY LSISVLGPETRGCLLTLCNKPGHCHSEGFVIFYPF* | 3843 | ATGCAGCCGTCCTCCTCACATGTCACTCTTCTATGGTTTAGAAGTTTCAGTCGCA CACTCCTACCCGGGTCGGAGTTAGCTCAAGCGGTTACCTCCTATGCCGGACTTCT ATCTGTCCATCTCGTGCTTGGGTTCGAGACCCGGCTTACTGACCCTTTAT GCAATAAATTCGGTATAATCGGTATAATCGTCACTCTGAAGGCTTTGTTATTTTTATCCCTTTTA | 3844 |
| | 3 | MPDFLSVHLCAGVRDPRVLTDPFMQ* | 3845 | ATGCCGGACTTTCTATCTGTCCATCTCGTGCTTGGGTTCGAGACCCGGGTGCTT ACTGACCCTTTATGCAATAA | 3846 |

Figure 1 (Continued)

| | | | | |
|---|---|---|---|---|
| | 4 | MEAGHWSYRACVTSLYCQYGRMGTKKCLCSSRDTPGS SETPQLRTAECVMDFVPSRTEV* | 3847 | ATGGAGGCTGGCCACTGTTCTTACAGGGCGTGCGTGACCAGCCTGTACTGCCAGGT AGGACGCATGGGACAAAAATGCTTGTCAGTTCACGAGACACACTGGAAGCT CCGAGACCCACAACTTCGGACCGCGAGTGCGTTATGAGTTCGTCCAAGTAGGA CGGAAGTTTAA | 3848 |
| hsa-mir-101-1 | 1 | MRPGSFFFFFP* | 3849 | ATGAGACCGGAAGTTTTTTTTTTTTAA | 3850 |
| | 2 | MAEIE* | 3851 | ATGGCAGAGATAGAATAA | 3852 |
| | 3 | MATYTLWRALLRH* | 3853 | ATGGCGACGGTCATGTTGTGGCGAGCCTTGCTGCGTCATTAG | 3854 |
| | 4 | MQJAGRTKEGEPGTPGGAGGCGGGGRARGRRGARGRA PAGGGLRGACGRARLGAQSVDVRVRARAPPWSAGCCA PGPVSRRVGAGLGTREAVGRTERLRRGWPRRTRTRSRG ARPARHPHWGLGAGQAAPGAEGAPLPSA* | 3855 | ATGCAAATAGCGGGAAGAACAAAGGAAGGAGGCGGGGACCCGCGGGGGCGCAG GTGGTGTGGGGCGGGGCGGGCGGGGCGCGCGGGGCGCGCGGGGGCCGAG AGTGTGGACGTTCCGAGTTCGCGCCGTGCGCCGCCCGTGCGCCGAGGCGCTGCTGCGC TCCCGGACCCCCTCGCGGCGCGTCGGAGCCGGCGTGGGGACGGGGAAGCCGTGG GGCGCACAGAGCGGCCGTAGCATCGGCGAGCACTGGGGTCTGGGGACGCAGCCGT GGGGCTCGGCCGTGGCCACTGCGCCCAGCGCCTAG | 3856 |
| hsa-mir-101-2 | 1 | MATJAHSLSYAGCNFLRQRLVLSTLSGRPVKIRKRARD DNPGLRGMLVWAARGVGAGAEGRPS* | 3857 | ATGGCGACTCAGGCGCCACTCCTCAGCTACGCAGGGTCAACTTCTTGCCCAACGT CTGGTCCTGTCTACCCTGAGCGGGCGCCCCGTCAAAATCGAAAGATTYGGCCAGA GACGACAACCCGGGACCTCCGAGTTAACTTGTGTGGCGGCGGCGTGGGCGC GGGGGCTGAGGIGAGACCGAGCTGA | 3858 |
| | 2 | MPWGPARCWLGGSASGERVGEGRWRVASKAGGAGTV GEAGSGPEGSAQLQAALGYSSGALVYNSCTESSFTCSNK SLASPLRVPSAPLALAINLSKEKNSLLDRNMVNEPGEKH WERKVPWVGSLPCLKAVLRSSCPLGHRLFLSP* | 3859 | ATGCCGGTGGGGGCCCGCGGTGTTGGTTGGCCGGCTCGGCGTCGGCGAGCGCGT GGGGGAGGGCAGGTGGCGGCGTCGCTCCAAAGCCGGAGGGGCAGGCACAGTGGG GAGGCGGCTGGTAGTAAACAGTCGACGTTCCACGTTTACGTGAGCCTCGGCGTCTC CTCGGCGCGTCGGCGTCGCCCTTGCGCCCTTGCCCTGCCATAAACCTCA AGGAGAGAAAACAGTTGTTGACCGAAATATGGTGAATAGCGGGGGAGAGACA TTGGGAGAGCTGCCCCCCTTGGACACCCGGCTGTTCCTGTCCAAGCAGTTCTCAG AAGCAGCTGCGGGGGAGAGACATTGGGAGGAAGACATTGGGAGAAGTACCTTGGGTTGGTTCTCTGCCC | 3860 |
| | 3 | MSRGRDIGREKYLGLVLCPVSKQPSEAAAPLDTGCSCR HDFSAALTLYLGCG* | 3861 | ATGTCTCAAAGCAGTTCTCAGAAGCAGCTGCCCGTGAGCAAACAGCCGTCTTCCTGTCG CCATATTCTCGGCCGCTGCCCCACACTTGTCCTTGGGTGTGATAAAGAAATTTTAAA | 3862 |
| | 4 | MISRLPSHLSLGVDKEIFKILCLFSAVTYIDVRRTGALR* | 3863 | ATGATTTCTGTGTTTGTTTCAGCCGTGACTGATGATGTGCGCAGGACAGGAGCTTTG AGATAG | 3864 |
| hsa-mir-101-2 | 1 | MLFLHFFSSKYIAIS* | 3865 | ATGTTATTTCTCCATTTTTAGTTCAAATATAGCCATCTTGA | 3866 |
| | 2 | MCGWGMPASVIKSSFRQ* | 3867 | ATGTGTCGTTGGGAATGCCAGCTTCGTTGTATAAAGTCTAGTTTAGGCAATAA | 3868 |
| | 3 | MRKTFLYIYK* | 3869 | ATGAGAAAACCTTTTTATATTTATAAATAG | 3870 |
| | 4 | MFFH* | 3871 | ATGTTCTTTCACTGA | 3872 |
| hsa-mir-103-1 | 1 | MHRGPSSEAPQLPQHASEWSQREEGWVLVTPARRRPMAV TEMGVLGKSGSDLSRSRREGGMNSSRGLSWLFGHSQIS P* | 3873 | ATGCATCGGGGCCCCTCCTCCGAGGCCCCTCAGCTTCCGCAGATGGCCCAGAGTGG GACTGAGATGGGAAGAAGAGGGTCTTAGTCACGCAGGAGGAGCTCAGCAATGGT AAGGGGGAATGAACTCTTCGAGAGGACTGTTCATGGCTGTTGCCATTCTCAGATTT CCCCTTGA | 3874 |
| | 2 | MAVRPFSDFFLRQESWSSGHGKRYNQGSRAVLKIDP* | 3875 | ATGGCTGTTCGCCATTCTCAGATTTCCCTTGAGACAGGAAAGCTGGTCGTCAGGC CATGGAAAGCGCTACAATCAGGGCTGTGCTTAAGATAGACCCTTGA | 3876 |
| | 3 | MESATIRALELCLR* | 3877 | ATGGAAAGCGCTACAATCAGGGCTCTAGAGGCTGTGCTTAAGATAG | 3878 |
| | 4 | MLGSE* | 3879 | ATGTTAGGGGTCGGAATGA | 3880 |

Figure 1 (Continued)

| | | | | |
|---|---|---|---|---|
| hsa-mir-103-2 | 1 | MFGLSRLLSACVGERGTRRNERTGACLHGN* | 3881 | ATGTTTGGGCTAAGCGCCGCTCCTTTCCGCCTGCGTTGGAGAGAGAGGTACCAGAAGG AATGAAAGGACTGGGGCTTGTCTGCCATGGCAACTGA | 3882 |
| | 2 | MKGLGLVSMATERKRWVINPSPPSCGEGGEVGAGK* | 3883 | ATGAAAGGACTGGGGCTTGTGTCTGCAACTGA AGAAAGAGGTGGGTTATAAA TCCTTCGCCACCTCCTGTGGCGAAGGAGGGAAGTGGGAAGTGGGAAGTAG | 3884 |
| | 3 | MHWGP* | 3885 | ATCCATTGGGGGCCATAG | 3886 |
| | 4 | MDFFFNHLPFSFGEKNWSPPGLRP* | 3887 | ATGGATTTTTTTTTAATCATCTTCCTTCTCTTTTGGAGAGAAAAATTGGTCACCTC CAGGACTGAGACCCTGA | 3888 |
| hsa-mir-105-1 | 1 | MFLLPPPPSSGLL* | 3889 | ATGTTCCTTCCCCCCTCCCCAAGCTCAGGTCTCCTTTAG | 3890 |
| | 2 | MLCSCDAILGSPVGLVEAQRRHLSRETLG* | 3891 | ATGCTCTGCAGCTGTGATGCTATCCTGGGTTCCCAGTGGGCTGGTGGAAGCCCAG AGGCGGCATCTGAGCAGGAGACACTGGGGTAA | 3892 |
| | 3 | MLSWVPQWGWWKPRGGI* | 3893 | ATGCTATCTGTGGTTCCCCAGTGGGGCTGGTGGAAGCCCAGAGGCGGCATCTGA | 3894 |
| | 4 | MWYMRDLLHCQ* | 3895 | ATGTGGTATATGCGTGATTTGCTTCATTGTCAGTGA | 3896 |
| hsa-mir-105-2 | 1 | MFLLPPPPSSGLL* | 3897 | ATGTTCCTTCCCCCCTCCCCAAGCTCAGGTCTCTTTAG | 3898 |
| | 2 | MLCSCDAILGSPVGLVEAQRRHLSRETLG* | 3899 | ATGCTCTGCAGCTGTGATGCTATCCTGGGTTCCCAGTGGGGCTGGTGGAAGCCCAG AGGCGGCATCTGAGCAGGAGACACTGGGGTAA | 3900 |
| | 3 | MLSWVPQWGWWKPRGGI* | 3901 | ATGCTATCTGTGGTTCCCCAGTGGGGCTGGTGGAAGCCCAGAGGCGGCATCTGA | 3902 |
| | 4 | MWYMRDLLHCQ* | 3903 | ATGTGGTATATGCGTGATTTGCTTCATTGTCAGTGA | 3904 |
| hsa-mir-106a | 1 | MGGGE* | 3905 | ATGGGGGGTGGCGAATAG | 3906 |
| | 2 | MSCLMNC* | 3907 | ATGTCTTGTTTAATGAACTGCTAA | 3908 |
| | 3 | MSLLGSYPYLFPLIG* | 3909 | ATGTCACTCTTGGGAGTTACTTCTACTTGTTCCTTTAATAGGATGA | 3910 |
| | 4 | MFSSPTFFCLSNQDT* | 3911 | ATGATTTCATCTTTTCATCTTTTCAACCTTCTGTCTCTCCAACCAAGACACATAG | 3912 |
| hsa-mir-106b | 1 | MSGSFPLEDRMENWEIMAVLESRQEDGESRAACPALRPR NKRTRYRWPFFKSDSPPPAPARTAGNPAPALPRPEIPFKRP HRLPVTHSRPAR* | 3913 | ATGAGCGGGTCCCCCTTGGAGGACAGAAGTGAAGAATTGAAGAATCATGGCCGTTCT GGAGAGTAGACAAGAAGACGGCGAAAGTCGGACTGCCCGCCCTGCCGCCCTCCGGA ACAAAAGAACGCGTGTGCGCTGKGCCTTTAAGAGCGATTCTCTCCGCCGCCGCCAG GTCGGACCGCGGAAAACCGCGCTGCACTACCCGCCCGGAGATTCCCTTCCGAC GCCGGACCGCCACCGCCCGTCCGTCACTCATTCTAGGCGCCGCACGGTGA | 3914 |
| | 2 | MALKDYALEKGTGLRAREGVLRGEPPGEHLLV* | 3915 | ATGGCACTGAAGGACTACGCGCTAGAGAAGGGTACGGGTCTACGAGCCCGGGAGGG CGTCCTGCGCGGGAGGGAGCCTCCCGGGGAAACACTGTTGGTGTGA | 3916 |
| | 3 | MLKKS* | 3917 | ATGTTGAAGAAAAGTAG | 3918 |
| | 4 | MANGWIGSRPGRRNPEL* | 3919 | ATGGCCAATGCTGGACTGGCTCCCGCCTGGCGGAGGAATCCGAGCTGTGA | 3920 |
| | 1 | MTILQRYLAHWGQD* | 3921 | ATGACCCTTGCAAAGGTATCTTGCTCAGGATCTGGGGACAGGATTAG | 3922 |

Figure 1 (Continued)

| | | | | | |
|---|---|---|---|---|---|
| hsa-mir-107 | 2 | MLKLVGGGGQDWACSVAGTSLGGEEAAPEVARPGD QGKAGGGSPGWGCAGIPDSAPGAGVLQAGAVGPARGG QGAEEVGGESAGGGEERRVRHPQAPALRLLNRKPQGGS GEJKTPENDLQRGRLSRGPRTAPPAPGMGJDRSGQQERS VPHSPGAPVGTSAAAVNGLLHNGFHPPPVQPPHVCSRG PVGGSDAAPQRLPLLPEIQPQPLLPQHDSPAKKCRLRRR MDSGRKNRPRKSRWEGSAGARQTQRAGPGTGSG* | 3923 | ATGTTGAAACTCGTCGGTGGCGGTGGCGGGCAGGACTGGGCATGCTCAGTGGCGGG GACCAGTCGGGAGGTCTGGGAGGCGAGGAAGCCGCGTTTGAAGTCGCGCGGGATCCAGG GGAAGGCGGGCGGCCGRGAGCCCCGGCTCGGGGTCCGCGGGGATCCCGATTCCGCG CCCGGGGCTGGCCTGCTGCCCAGGCCGGCCGTGGGGCCGGCCGGGGCGGGCAGG GCGCAGGAGGAGGTGGGGAGTCGGCAGGAGGTGGCCAGGAGGGGAGGAGGCGCCGGTTCGCCA TCCCCAGGCGCCGGGCTCTGCGGCTGCTGAATCGGAAGCCGGCAGGGAGGATCGGGG AAATAAAGAGCCGAGAATTGACCTTCAGGGAGGCCCTGAGCCGGGCCCCGCG ACAGACCTCAGGCCATGGCGCTCCCGTGGCACCGGCAGGGAGCCAGCAGAGGCGCCCGT CCCGACACTCTCCAGGGCCCCCTGGGCACCGGCACCAGCCGCCGCCGCCGTTGAACGGGCTGC TGCACAACGGCTTCCATCCGCGCACAGTTCAGCCGTCAGCCAGGTC CAGTGGGGCAGCGGCAGGAGGCGCGCCCAGCGCCCAGCATGACCTCCCGGCCTGCTGCCAG CGCAGCCACTGCTCCCTCAGCACGTCCCGGGCCAGAAATGCCGCTGCGGAG GAGGATGGACTCGGGAGAAGAACAGCCGCCCTGGTGGGGAGAAGTCCCGCTGGGAGGGGAGC GCGGGCAGCCAAGGCAGGCCAGCGTGCGGGGCCGGGACTGGGAGCGGGTGA | 3924 |
| | 3 | MLSGGDQSGRRGSRV* | 3925 | ATGCTCAGTGCCGGGGACCAGTCTGGCAGGCGAGGCGAGAAGCCGGTTTGA | 3926 |
| | 4 | MTSSEAA* | 3927 | ATGACCTCCAGCACGAGCGCCCTGA | 3928 |
| hsa-mir-10a | 1 | MIPSGLGTPGRRRVAGRGEVTLATCGCQEKAAGKPRKID PGAQGRWLSSRAAPALILLCVLLFVSFWAVKGRGSLPL R* | 3929 | ATGATTCCTAGCGCTAGCAACCTGTGGCTGACGCCTGGACGCTGGAGGTGGCTGGGAGGGCGA GGTCACGCTAGCAACCTGTGCAGGAGAAGGGCGGCTGGGAAGCCACGGAAAG ACCCGGAGCGCAGCGGAGGTGCTGGTCGCCGCCGCAGCCCTGCTCTTATTTTAC TATTAGTCGTGTTGCTGTTCGTATCCTTCGGGGCGTGAAGGGAGAGGCAGCCTCC CGCTCCGGTGA | 3930 |
| | 2 | MRVAVRILLGGEGERQPPAPVKPVLGVAHKPCSPSQAA GGVRGVRRLGGHGRW* | 3931 | ATGCGTGTTGCTGTTCGTATCCTTCTGGGCGGTGAAGGGAGAGGCAGCCTCCGCT CCGGTGAAACCCGTTCCTGGAGTCGCGCCATAAACCCTGTTCCATTCCAGRCGGCT GGAGGGGTGAGGGGTGCGGCGCCCTTGGTGAGTCGGTTCCTGGGAGACCGTAA | 3932 |
| | 3 | MPTGWTGFRELAS* | 3933 | ATGCCGACGGGTTGGACGGGTTGGACGCCTGAGTTGA | 3934 |
| | 4 | MGWGRGLDRWSGSWRP* | 3935 | ATGGGGTGGCGGGAGGGCCTGACGTTGGAGTGGTCCTGGAGACCCTAA | 3936 |
| hsa-mir-10b | 1 | MSGSLRPRVSAAGQRLVDYSRRPDRPPPVARQPSGKNR PLPAPQHATKKPGAPTPLGSSVRLLPYISRGSGGRSLSKPL PPITSFLGRPLGPGVESGWVQKSKGAVLFQKF* | 3937 | ATGAGCGGGTCTCTGCGTCCCAGAGTGAGCGCAGCGCCTAGTGGATTA CAGCAGACGCCCGGACGCCCGCGTTAGCTCGGCAGCCTTCGGCGTAAGAATC CAGCCCTGCCGCTGTCCCAGCATGCACCAAGAAGCTGGGGCGCCGACCCCTTGG GCAGCTCAGTCGGTGCTCCCACATTCCAGGAGGCGTCCTCGTGTCTA AGCCCCTTGCCCAATCACTTCGTTCTAAGGGGCAGTATTATTTCAAAAATTCTGA | 3938 |
| | 2 | MPPRSLGRRPPWAAQSGCSPTFPGEVGGRCLSPFPQSLR S* | 3939 | ATGCCACCAAGAAGCTGGGCGCCGACTCCCTTGGCAGCTCAGTCGGCTCC CCTACATTTCCGGGGAAGTGGGGGTCGCTGCCTCTAAGCCCTTCTGCCAATCACTT CGTTCCTAG | 3940 |
| | 3 | MESPSILP* | 3941 | ATGGAGAGCCCCTCAATCTACCCTAG | 3942 |
| | 4 | MCLVFESRL* | 3943 | ATGTCTTGTGTTTGAATCTAGCCTTTAG | 3944 |
| | 1 | MVRERSPRGPLGQGRVFGMLGRVYKNCKGEAGS* | 3945 | ATGGTTCAGGGAGCGCAGCCGAGGGCCACTGGCCAGGGCGCGTTTGGGAT GCTTGGCCGGGTATATAAGAACTGCAAAGGTGAGGGGCCTGA | 3946 |

Figure 1 (Continued)

| | | | | |
|---|---|---|---|---|
| hsa-mir-1-1 | 2 | MAWGLRGIWAGGAIHLPLRNKAPAAGRGAKLTLNLQYPPLRCWWGAGHPELSGGEAAPGIRDSALLQLSQPRQCQEAFTGAGRGGGRGAHVGGD* | 3947 | ATGGCATGGGRGCTTCGGGCTRGGCTGGAGGCGGATTCACCTGCGCTCCGCAACAAAGCCCCGGCCAGCCGGCCGTGGGGGCTAAACTTACCTTGAACTTGCAGTATCCCCACTGAGGTGCTGCTGCGGCAGGATTCCGAGCTCCGAGCTGAGCGCGCGCGAGGCTGCGCCGGCCGGAGGACTCGCACTTCTGCAGCTCTCCCAGCCACGCAGGTGCAGGAGGCGCAGGGGCGGGACTCCGGAGGGGCAGGGCGAGGGCGAGGTGGGGGCACATGTGGCGGAGACTTTACACAGRGGCAGGGCGGCGAGGTGGGGGCGGATTCACCTGCCGCTCCGCAACAAAGAG | 3948 |
| | 3 | MGASGLGWGRDSPAAPQQSPGSRAWG* | 3949 | ATGGGGCTTCCGGGCTGGCTGGGCGGGRDSPAAPQQSPGSRGGGCTAA | 3950 |
| | 4 | MWAETRGASGRAALVVGVCAGPCWGA* | 3951 | ATGTGGGCGGAGACTAGGGAGGGGTTCGGGGAGAGCAGCCCTGGTGTGGGTCAGCCTGTG | 3952 |
| hsa-mir-122 | 1 | MAVFP* | 3953 | ATGGCAGTCTTCCGTGA | 3954 |
| | 2 | MYSLGDLSSLPRWPPWLPAGRTPPLSRGMDFPILLSVFDQRWC* | 3955 | ATGTATTCACTAGGTGACCTGTCTTCTCTGCCTCGGTGGCCTCCATGGCCTGCTGCTGGCCGCACACCCCACTCAGCAGAGAATGGACTTTCCAATCTGCTGAGTGTGTTTGACCAAAGGTGGTGCTGA | 3956 |
| | 3 | MAACWPHTPTQQRNGLSNLAECV* | 3957 | ATGGCTGCCTGCCTGCCGCACACCCCACTCAGCAGGAATGGACTTTCCAATCTTGCTGAGTGTGTTGA | 3958 |
| | 4 | MRLIRKRKNCLLLNPGSHKGRGERPKATEAVEGAILPATGRALD* | 3959 | ATGCGACTTATCAGAAAGAGAAAGAATGTTTACTTTTAAACCTGGATCCATAAGGGAGAGGGGAGAGGCCTAAAGCCACAGAAGCTGTGAAAGGCGCCATCCTGCCTGCCACAGGAAGGGCCTTGGACTGA | 3960 |
| hsa-mir-124-1 | 1 | MVGVLNQATASVVFPQCKYPSLREETLSEW* | 3961 | ATGGTGGGAGTCTTGAACCAAGCCACTGCCAGTGTAGTTTTTCCACCACAAAAGTATTTTAGTTTGAGGGAAACGTTATCAGAATGGTAA | 3962 |
| | 2 | MVSFSLKDSPNDGFPQSGMVFRN* | 3963 | ATGGTAAGTTTTCCCTGAAAGACAGCCCAAATGATGGCTTTCCAATCAGGCATGGTCTTCAGAAATTAA | 3964 |
| | 3 | MMAFSNQAWSSERKHQLQAMVYFLRFFFFRLLLLLFPLLLLFLFPPSLSD* | 3965 | ATGATGGCTTTTTCCAATCAGGCATGGTCTTCAGAAATTAAACATCAGTTGCAGGCAATGGTTTATTTCTCCTTATTTTCTTTCCTCTCCTCTTCCCCTCCTCCTCCTCTGATTAA | 3966 |
| | 4 | MASKREGPRPGHPSCSHSCWVGASAATLAGCVVSAGLLLAGGACSPHL* | 3967 | ATGGCCTCGAAGGAGAGGCCTCGCCGGGTACCTCTTGTGCAGCCACTCTGCTGGGTCGGGGCGTGTGTGCAGGGGCTGCTTTAGCTGGCGCAGGGCTTGTTCTCCCCATCTCTAG | 3968 |
| | | MTTGLTPHPSAGCPEQSWTVFLAPSPEGRPSWETGFSSNSN* | 3969 | ATGACGACTGGCCTGCCTGACACCTCATCCATCAGCAGGGTGCCAGCAGGGTGCCAGAGAGTTGGACAGTTCCTTGCTGCATCTCCAGAGGGGAGGCCAGTTGGGAAACAGGATTCTCTTCCAATAGCAATTAG | 3970 |
| | 2 | MRRRNPGLRGLIRNFVVSNKLWPLEESTPWLLWL* | 3971 | ATGAGGAGAAATCAGGTCTCCGTGGCTGATTAGAAACTTGTTGTGTCAAATAAACTTTGCCACTGGAGGAAAAGTACCCATGGTTGCTCTGGCTTTAG | 3972 |
| | 3 | MYALALERSVQGFSIFFSPLSLSLPLSLSLPSSLVSKGASGQR* | 3973 | ATGGTTGCTCTGGCTTTAGAAAGATCTGCCAGGCTTCCAATCTTCTTTTCACCCTCTCTCTGCCACTTTCCCCGACATTTTCCCTCCTGCCATTTAAACAGCGCTGA | 3974 |
| hsa-mir-124-2 | 4 | MAGDPVRTKPCAGLLWQAEKGALGPGPQALTRTHPADRLFIRTALQSPRLPLFAEQWRFRRESKALFRFLSDVLHLGKHRPPLFPPTFSLLAPKAVRFRGNFCEFRACSTNTSVRRRRDRWKKESPRDPCVCVCVCVCVCVCVMHLEDGSCL* | 3975 | ATGGCCGGTGACCCAGTAAGGACTAAACTTGCGCTGGTTATTGTGGCAAGCTGAGAAAGGGCTTTAGGCCCGGACCCCAGTGCCCAGCCACTGACCGCACATCCCGGGATCGCCTATTCATTCGCACAGCCCGGACCCCAGTCGCCCAGCCACTGACCGCACCATTGTTGCTGAGCAACAATGGAGATTTCGCAGGGAAAAGTAAACTCTTTCAGATTTCCCGACATTTTCCCTCCTGCCATTTAAAGCTGTTCGTTTTGGGGAAACCTTCGTGAGTTGCGCCTTGTTGACCAACACAGTGTAGGAGAGGGCGAGACCGGTGTGTGTGAAAAGAGAGAGCCCAGAGATTTCCGTGTGTGTGTGTGTGTGTGTGAATGCATTTAGAGGACGGGAGCTGCCTCTAG | 3976 |

Figure 1 (Continued)

| | | | | | |
|---|---|---|---|---|---|
| hsa-mir-124-3 | 1 | MADKREGEGVGVGVSARVSSPPPAPAPAGAT* | 3977 | ATGGCGGACAAGAGAGGAGGGGAGGGGTGGGGGTCTCGGCCCGTGTTCTCCCC TCCTCCGCTCCCGCCCGCCGGAGCCAACCTGA | 3978 |
| | 2 | MKPTKLAGPPKRSPPERTLRGGRGRGCRRAPLPARLLP AGSAPKPWTALPPARLAGGRCTPGVEVGSRGPRSSLLRT PRGAGPP* | 3979 | ATGAAACCTACGAAGCTCGCGGGCTCACCGAAAAGTTCCCAACTGGAGCGGACTCT GGGGGGCCGGGGCAGAGGCTGCAGGCGGGCCTTCCCCTTCCGCGCGGCTCCTAC CGGCTGGCTCCGCCCCAAGCCTGACGGCGCCCTTCCCAGCCGCTGGCTGGGG GCGCTGCACCACGGGTGAATTGRAGCCGGGGACCCGATCGCTACTCAGG ACTTCAAGAGGGGCCGGTTCTTCTAG | 3980 |
| | 3 | MYKNLG* | 3981 | ATGTACAAAAATCTAGGGTGA | 3982 |
| | 4 | MCGAKESFPLEWEQAPRSWNPEASWTRPGS* | 3983 | ATGGGGGGTGCTAAGGAGTCTTTCCCCTTAGAATGGGAACAAGCTCAAGGAGCTG GAATCCTGAGGCGTCCTGAATCCGTCCAGGAAGCTAA | 3984 |
| hsa-mir-124-3 | 1 | MAQGLGWP* | 3985 | ATGGCGCAGGGCTGGTTGGCCTAG | 3986 |
| | 2 | MGTEACRPRRPALLAV* | 3987 | ATGGGGAACAGAGATGCCTCGCGGCCGCGGCCTGGCTCTTGCAGTCTAA | 3988 |
| | 3 | MGAGKDIL* | 3989 | ATGGGGGCGGGAAGCGACGACCTTTAA | 3990 |
| | 4 | MCSWRGCARGCRRAM* | 3991 | ATGTGCAGCTGGAGGGCTGCGTGCGTCAGGAGGGCCATGTGA | 3992 |
| hsa-mir-125a | 1 | MGIDTFNAPOAEKELDGDRERAKGRTDVQRQKGGQTER DTERQQKQPRMTGAERRRERGRERERREGGREG ERERESTHRARRRRREEGGRPARDRTGRRGGEGELGKA GEERDWPRRAGERERRPRRLPASFVPSLLCVRLLWPG LPLPLPPPRGWMEFFPLDLGQLRGRGEARPDWAGIRW GGAGACGPLGRGLVRRPRSRRGPGRGSPGPQSRGGGID GRRESGRREEGWRGRREEGERPPCGEGGERMESARRE WGPACCGPGAAEKTPSLRRGSRGSRRESAEREGGGHLGPAL LGP* | 3993 | ATGGGAGACACAGATAATGCCCACAGGCAGAGAAAGAGGATGGAGATAGGGAGA GGGCGAAAGAGAGGAGCAGATGTGCAGAGACAGAAGGGAGGACAGACGAAAGAGA CACAGAGGAGCAGCAAACCAAGAGAGAGCAGAAGAATGACAGGAGCAGAGGAGGAGGAA GAGAGAGGAGAGAGGAGAGAGCAGAGGCGCACAGACGAGAGGAGCGCAGAAGAAGAGG GGAGGGAGGAGGCCAGCGAGGGACAGAGGGTCGGAGGCCGAGAGGGAGCTAGG AAAGCCGGGAGGAGCGAGACTGGCCGAGAGTCCTTTGTCCCTTCCGGCCTCTGTGCTCAGGCTTCTCTG GCCCCGGCCCTCTCGGCCTCGGCCTTTGTCCCCTCTCCGGGCGTGGATGGAATTTTTTCCC CTGGACTTGGGGCAGTCTCCGGGCCAGGGCAGGGAAGCCAGGCCGACTGGGCTGGGCG GGTGGGGAGGGCCGGTCCAGGGAGTCCGGGGCGGAGGTCCAAGGGCGGCTGGCTGTCCGACGCC GCGCAGCGCGGGCGGGGTCCAGGGAGTCCAGGGGCGCGAAGGGCCGGCGGGAGGCCCGAGAGC CGGAGGA AGGAAGGGAGAGGGCCGCCTGGCCGTCCGGAGGGCCGAAGAGGATGGAGAGCGCTCG GCCGGTTGGGCCTCCGCCCGGGAGCCGTGAGTCGGAAAAGGAGGGTGGGGGCTGG GCCGCCACTCCTGGGTCCGTGA | 3994 |
| | 2 | MPHRQRKRMEJGRGRKEGQMCRDRREDRRKETQRGSK SNQE* | 3995 | ATGCCCCACAGCCAGAGACAGAAGGCAGAAAGAGGATGGAGAGGGCGAAAGGAAGGAC AGATGTGCAGAGACAGAGGGAGGACAGACAGAGGGCGAAAAGAGACACAGAGAGGCAGCAA AAGCAACCAAGAATGA | 3996 |
| | 3 | MAAGTAGGGEAAVRRRGEDGERSAAVGPGLRARGG GEDPFPATREPREP* | 3997 | ATGGCGGGGACGGCGGGAGGGGAGGAAGGGGAGGCCGCCGTGCGCGGAAGGCGGGGAG AGGATGGAGAGCGCTCGGCGGCTGCGAGCCGGGAGCCGCGCGGAGCCGTGA AGAAGACCCCTTCCCTGCAGCGGACGCGCGGAGCCGCGGGAGCCGTGA | 3998 |
| | 4 | MGAGAGRIVAGRLD* | 3999 | ATGGGAGCTGGCGCTGGTAGGATTGTGGCTGGAAGAGACTAG | 4000 |
| hsa-mir-125b-1 | 1 | MVPQEAVRAPLRFEWVSSERYSSLHFYSLRILLLGLLI* | 4001 | ATGGTGCCACAGGAGGCTGTGCGGGCCCCGCTCGCTTCGAATGGGTGAGTTCAGA ACGCTATTCGTCTTTACACTTCGTCTATAGCCTCCGAATCCTACTTCTTGGTCTTCTCCTTT GA | 4002 |
| | 2 | MGFRTLFVFILL* | 4003 | ATGGGTGAGTTCAGAACGCTATTCGTCTTTTATACTTCTATAG | 4004 |
| | 3 | MFPACGILALGERDASYFLFSHLC* | 4005 | ATGATTTTTGCATGGGCATACTTGCCCTGGGGAAAGAGATGCCTCCTATTTTCTC | 4006 |
| | 4 | MRHTCPGGKRCLLFSLQSFVLVVN* | 4007 | ATGCGGCATACTTGCCCTGGGGGAAAAGGATGCCTCCTATTTCTCTTCAGTCATTT GTGCTAGTCGTAAATTAA | 4008 |

Figure 1 (Continued)

| | | | | | |
|---|---|---|---|---|---|
| hsa-mir-125b-1 | 1 | MGPLKQGFHRPAGADGVRDLTMAPARSCCVLSEA* | 4009 | ATGGGACCCTTGATACAAGGCTTTCATAGACCAGCCGGTGCTGATGGGTCCGGGACTTGACGATGGCGCCGCTGCCTCGTTCCTGTTGTCTATCTGAGGCATGA | 4010 |
| | 2 | MGSGT* | 4011 | ATGGGGTCCGGACTTGA | 4012 |
| | 3 | MIFPRFWEVESTGQRLHLTH* | 4013 | ATGATTTTTCTTCGTTTTTGGGAGGTAGAGAGCACGGGGCAGAGGTTGCACCTGACACATTAG | 4014 |
| | 4 | MGVTVPPCLPLLYLDKDLLYPDF* | 4015 | ATGGGGGTTACTGTGCCCCCGTCACCCCTGCTTATCTGATAAGGACTTGCTTTATCCTGATTTCTAA | 4016 |
| | 1 | MHLLCPCCRKEPADWPLSAAHSTGWL* | 4017 | ATGCACCTATTGTGTCCCTGCTGCAGAAAGGAGCCTGCCGATTGGCCACTGTCTGCAGCACATAGCACTGGCTGTATAA | 4018 |
| hsa-mir-125b-2 | 2 | MITAFFLQGGWRESGEGRGGVSSTVKAAQIFFLSLSLPLHRLFLFHALSHFA* | 4019 | ATGACTGCATTCTTTTTGCAAGGTGGGTGGAGGGAGAGCGGGAAGGAGGGGTGTCAGCTCAACTGTACACAGATGTGCCATCTCTCTGCCTCTCCATAGATTGTTTCTGTTTCATGCCCTGTCTCATTCGCATAG | 4020 |
| | 3 | MPCLISHS* | 4021 | ATGCCCTGTCTCATTCGCATAGCTAA | 4022 |
| | 4 | MLKIPCLNL KNMDSAVIRNLVRV* | 4023 | ATGCTAATTAAGATCCCTTGTCTTAACCTGAAAATAATGACTCGGCTGTAATTAGAAATCTCGTGAGAGTTTAA | 4024 |
| hsa-mir-125b-2 | 1 | MVCERISVCLGRKLFDLQKSQKTSR* | 4025 | ATGGTTTGTGAAAGAATATCTGTGTGCTTAGGGAGGAAAACTTTTTGATCTGCAGAAAAGCCAGAAGACATCTAGGTAA | 4026 |
| | 2 | MFTFVFVEVQNVLJTVCLFFVCLFKS* | 4027 | ATGTTCACTTTTGTAGAAGTTCAAAATGTACTGACGATTGTTTGCTTATTTTTGTTTGTTTGTTTAAAATCTTAA | 4028 |
| | 3 | MLLWKEY* | 4029 | ATGTTGCTTGGAAGGAATATTAA | 4030 |
| | 4 | MRPLCT* | 4031 | ATGAGGCCCTTGCACATGA | 4032 |
| | 1 | MLLLDSSCLIFLLLWLF* | 4033 | ATGCTCCTAGACAGCAGTTGTCTGATATTTCTCTTTGTGTTGTTTAG | 4034 |
| hsa-mir-125b-2 | 2 | MDMKSEESDHRRKPQVKIKNKEQRFTVFKEKQHSFDCVLL* | 4035 | ATGGATATGAAAAGTGAAGAAAGTGATCATAGGAGAAAACCATTCAGGTAAAAATAAAAAACAAAGAGCAAATAAGATTTACTGTTTTAAAGAAAAACAACATTCTTTGACTGTGTTTGTTATAA | 4036 |
| | 3 | MSVTVEILLMVFI* | 4037 | ATGAGTGTAACTGTTGAAATTTTATTGATGTTTTCATTTGA | 4038 |
| | 4 | MCAMTYLCEKFLVVNWAVCVPLNICLCIHTLKIGAIRFTRKLYRERKKLYFLICCTI* | 4039 | ATGTGTGCTATGACCTACCTTTGTGAAAATTCTTGTGGTCAATTGGGCAGTTGTGTCCCATTGAAAATATGTCTGTGTATCCATACGCTAAGATAGTGCAATACGTTTACTAGAAAAGCTTTATATGGAAAAGAAAAAATTATTCTTATTGTGTACCATAA | 4040 |
| hsa-mir-125b-2 | 1 | MLCLASRCVSVCLCARACSLGHPCLAEGRGWRVSAWRVKASQSVRSKGTLESN* | 4041 | ATGCTTTGCCTCGCCTCGCTGTCTATCGTGAGGGGAGGGGTGGCGTGAGTGCCGTGGAGGGTATCGGGCATCCGTGTCTAGCGCAGGGAGAAGCAAAGTACGTTGGAGAGCAACTAA | 4042 |
| | 2 | MPVCARVLARASVSSRGEGVACECVEGKSQSVSEKQRYVGEQLKSD* | 4043 | ATGCCTGTGTGCGCGCGTGTTAGCCGCGTGGAGTGCGTGGAGGGTAAAAGCCAGTCAGTCAGTGAGAAGCAAAGGTACGTTGGAGCAACTAAATCTGACTGA | 4044 |
| | 3 | MYSLRRMGLRDGGHMLMSFLWRGEIFHSDNWLNAMVKNCKAIFSFREKHGLRSKGCFIFSLFVSAAFLFFWFLFFNYLF* | 4045 | ATGTATTCCTAAGGAGGATGGGATGGTTCCGTGATGGCGGTGTATAATTATGTAAATGTCATTTTATGGAGGGTGAGATTTTCATTCTGTCGATAATTGGTCAATAAGTCAAAAATTGTAAAGCCATATTCAGTTTAGGAAAGCATGGACTAGACTAAGGGCTGTTTATTTTTCGCTGTTTTGAGTGCTGCTTTTTGTTTTTGTTTGTTTTAACTATTATTTAA | 4046 |
| | 4 | MGV* | 4047 | ATGGGGTGGTATAA | 4048 |

Figure 1 (Continued)

| | | | | |
|---|---|---|---|---|
| hsa-mir-125 | 1 | MSGEGDTQMQSRWGPAKKPAHKAMDSSTPSAGAVGSPRKGDSCGQGKGEGSPGRPPRLRRPDSSPGPPFSTLEQAASTCEPAASSENGSPSTQRVSLWDVGQGPEQAGRGERKGWGPSLLPAQTLAREQTAPLPAGTPAWQLPPAPVGSGTSSDGKVPPHPWLTEPARPRPGGARGKQEAPSLPHSASLPPPAPPAARLPRPRLVPLCLAPPEMPRLASARGLVCPLLGLQRPKAPW* | 4049 | ATGTCAGGAGAGAAGGGGACAACTCAGATGCAAAGCCGGTGGGGACCTGCCAAGAAGCCAGCCCACAAGGCCATGGACTGCTCCACGCATCAGCTGGAGCAGTGGGGCAGCCCAGGAAGGGAGAGCCATGGAGCGGGAAGGCGAGGGCTCCCGGGACCCCCGAGGGCTCAGGGCCCGGACTTCAGGGAGCCCCTGAGCCCCTGAGCTCCAGTCTGCCTCCTGTTTCCACCCTGAACAAGCGGCTTCCACCTGTGAGCCAGGCAGCTGCTCTCTGAAATGAAGCCCTCAACTCAGAGGGTGTGCTCCTCGGGACCCTCACTCTCCCTGCCACTTCCCTGCCCAAACCCTCGCTGGGAGCCAGGCAGACGGCTAAAGGCTGGGACCTGTGGTCAGGGCGACCCTCAAACCCTCCTCAGCTCCCAAGGCTGGGGACCACCCTGCCCCCGGTCTGGGACCCCTGCCAGCCCCCATCGGTGCTGACAGAGCCCAGTCCGAGGCTGGACCAGCCAGCCCACCCATCCTCCTGTCCACCACATCGTGGTGAGAGCCAGCCCGTCCGAGGCAGCCCTGATGGGAAGGTTCCACCACATCGTGGTGAGAGCCCATCCTCCTGCCCTGATGCCTCTGAGCCCCGGCCTCCGACCCGGCCGCCTCCAGGGGCTTAGTCTGCCCTCTGTCTCGCCCACCTGAGATGCCCCAGCTGCCTCTGCCCGCCAGGGGCTTAGTTCTGCCCTCTCCCTGGGCGCTTCAGAGGCCAAAGCCACCCTGGTGA |
| | 2 | MEAPQLRGCRSGTWVRGRSRQGEVRGKAGDPHFSLPKPSLGSRRLLCPQAPLPGSSLQPPSGPGRPLMGRFHHIRG*PSLGSRRLLCPQAPLPGSSLQPPSGPGRPLMGRFHHIRG* | 4051 | ATGGAAGCCCCTCAACTCAGAGGCTGTCGCTCTGGGACCTGGGTCAGGGGTCGCGGAGCCAGGCAGGAGAGGTGAGAGGAAAGGCTGGGGACCCCCACTTCTCCCTGCCAAACCCTCGCTCGGGAGCAGGCGACTGGGGACCTGGGTGCGGGAGCCAGGCAGGAGAGAGGTGAGAGGAAAGGGCTGGGACCCCACTTCTCCCTGCCAAACCCTCGCTCGGGAGCAGGCGACTGGGTCCGGGACTTCCTGGGACTTCCCTGCCCTGCTGCAGGCACCCTGCTCTGCCAGCTCCCTCCAGCCCCGTGGGGTCGGGACTTCCTGGGAGTCCAATGGGAACCAGGACAATGGGAAACTGAGGCCTGTGTGGGGCACAAAGCTGGTGA |
| | 3 | MALLTRETMGKLRPVWGTKLGPELQLPAPAGPPPLTPPQAG* | 4053 | ATGGCCCTGACCAGAGAAACAATGGGAAACTGAGGCCTGTGTGGGGCACAAAGCTGGGACCAGAGTTCCTGCCTCGGCACCGCCCTCCACCTCTGACACCACCCCAGGCAGGGTGA |
| | 4 | MRKTGAGLGVATILSHQVSPSVLGP* | 4055 | ATGAGGACAAGGCGCAGGCCTTGGGGTTGCCACACTCTCCCACCAGGTCTCCCCCTCTGTGCTGGGCCCCTGA |
| | 1 | MGAGRGRQVGRGRGRGGGAGLGAPTARARAAVAAARARPGSGCECGASGARRGRGPVAARACSRACGPAEPPGAGNLAARGAGHGSGTRQRDRWGRGRSGPGRPRLGRAGPGEWAQRPREPAPPAGGGRAGGAAGRAGVAAAPRPTRDSAPRGPACAACSAPREPRSQQRGWEGAAGRSVSLRLCALPRGPRGPQPCSRREGSASACGAARPLPLRTRPLAGGGCGAAAGGQVGREPVGAGGTGTGLLVHLAPPPPRPAPLGRGRGPPRGNGACSTGSESTTGFLWPRENMTFKN* | 4057 | ATGGGGGCCGGGCGCGGCCGCCAGGTGGGCCGCGGCCGCGGGGGCGGCGGCGGGGCCCTGGGGCTCGGGGCCCCCACGGCGCGGGCGCGCGTGGCGGCCGCGCCCGGATCCGGCTGTGCGGCGTGAGTGCGAAGCCGGGAGCCGGAGCGCCCGGGGCGGGGAACCTGCCCGCGGCGGGGAGCCCGGGAGGCGGCGTCCGGGACGCAGAGGCAGGCCGACGCTGGGGAGGGCGGGGTGAGCGCCGGTCGGGCGTCGGGCGGAGAATGGCGGGCCCAGCGGCCCGAGCCCGCCACCGGCCGGGGCGGACTCAGCGGGCGCGCCCGGCCTCGGGGCCCCAGCGGAGAACCCCGGCCCCAGAACCCCGAGCGCCGACTCAGGCGGCTCGGGGAGGGCCCAGCGAGGGCCCGAGCCCCAGGCCAGCCCGCGGAGCCCCAGTGCTCTCGCGGGACCAGCCAGGCCGCTGTCTCCGCGGTGGGGGCTCGGGGGGCGGCGCCGAACCCCGGAGCCTGGGAGGAGCCCGGTGGCGCTGGGAGCAGGGCTGACCGGACTGTGCTGCCACTGGTGGGGAAATGCCGGAGCCCGGCCGCCAGTGCCCGCCCTCGGGGCCCCCCGAGGGGTTCCGCGGTGGGGCTCACGGGGGCTTCCCCAGCCGGGAAAATGGCGCTGGGACGCCACCCCTGGGCGGCGGCCGGGTCCTGGGGCACGGGTCGGGACTGTGCTCGGTCACCTCGCTGTCCTTGCAGCACCGGCTCGGAGAGCACCCACGGGGCTTCCTCTGGCCTCGGGAAAACATGACTTTCAAAAATTGA |

Figure 1 (Continued)

| | | | | | |
|---|---|---|---|---|---|
| hsa-mir-126 | 2 | MGPAAPGTGSPCRRRAGGRRGGEGERGRRGPSSDPARLS ASGPSLCRLLRPPRTPEPAARLGGGGQVRLAPPLRPPS WAPRSPALLPPRGVRQCLRRSQAPPSADPASRGWGLRG CCRAGGEGAARGRWGHGDRTACiPPGAAAPSPPGTPGSR PWPPPGKWGHQHRLGEHHGLPLASGKHDFQKLSLHLAP LPVQATLRNCGGELCQYVWGAMRSGRFAYPQARPGIP LPTSSRRAAALPLPSRVPLPNVPRLRVLP* | 4059 | ATGGGCCCAGCGGCCCCCGGAACCGGCTCCCCCTGCCAGCGGGGGGCGGCCGGGCG GCGCGCCGGGGAGRGCCGGGGTCCGCCCCCTTCGCGCCCCCGACCGGGCGACTCA GCGCCTGCGGGGCCTGTGCCCCTGCTCCGCCTCCGCGGAACCCCGGAGCCAG CAGCCGCGGTGGGGGGGGCCGGTCCCGGCCAGCCTCTGGGGCGGCAGCCTGGGGGCT CCCTCGTGGGCCCGGCGGCCCAGCCCTGTGCGGGACCCGGCTCTGGCGGTGGGGCT CTGCCGCAGCCAGGCCTGCCGGCCAGGTGGGAGGGAGCCCGTGGCGCTGGGGCACGGG GCGGGGGCTGCTGCCTGGTCCACCTGGCCCGCCCCCCTCCGGCACCCCTGG GACCGGACTGCTGGTCCACCTGGCCGCCCCTCCCGCCCGCCCGGCACCCCTGG CCAGGGCCGTTCCCTCGTGCAGGCGACTCTGGAGAATGGGCTTGCAGCACCGCTGTGCAAT AGCACCGCCTTCCTGTGCAGGCGACTCTGGAGATTTCAAAATTGAGTCTCCACTT ATGTGGGGGGCCCACATCAAGCGCGCGGAGCCGGCGCTGCCCTGCCCCTACCCCCGCCCTGGC ATCCCCCTGCCCACATCAAGCGCGCGGAGCGCGCTGCCCTGCCGCCCTTCCTTCCCGGGTC CCACTCCCCAATGTCCCCGACTTCGAGTCTTGCCTGA | 4060 |
| | 3 | MGLAAPARRAPRASSGLGKT* | 4061 | ATGGGGCTTGCAGCACCGGCTCGGAGAGCACCACGGGTCTTCCTCTGGCCTCGGGAA AACATGA | 4062 |
| | 4 | MCGGQ* | 4063 | ATGTGTGGGGGCAATGA | 4064 |
| hsa-mir-127 | 1 | MVNPILCT* | 4065 | ATGTTAATCAATTCTGTGCACTGA | 4066 |
| | 2 | MTERMNGHMND* | 4067 | ATGACAGAAAGAATGAATGGACACATGAACGACTGA | 4068 |
| | 3 | MEMPGTARKELPMGLSFISLWAPEVHKREKRQEEKCQ GVKDRAKERQK* | 4069 | ATGGAAATGCCTGGCACAGCCAGGAAGGAGCTGCCCATGGGATTGTCATTCATCTCA CTCTGGGCACCTGAGTCCATAAGCGTGAAAAGGGCAGGAAGAGAAGTGTCAGGG AGTTCAAAGATAGAGCTAAGGAAAGGCAAAATGA | 4070 |
| | 4 | MKLNFSERENKFKPIKKRTNTWVYL* | 4071 | ATGAAACTAAACTTCGAAAGCGAAAATGAAAAGCCAAAATAAAGAAAACCAATAAAAAGAGAA CGAATACGTGGGTGTATCTGTAA | 4072 |
| hsa-mir-128a | 1 | MSLRGRTTYE* | 4073 | ATGTCACTCCGGGACGTACAACCTATGAATAG | 4074 |
| | 2 | MNSRLPLKENEEAGLVRGGKGRDSASRGCRWSRCPGW* | 4075 | ATGAATAGTCGGCTGCCGCTCAAAGAACGAAGAGGCGGGGCTAGTGCGTGGG GAAGGGGCGGGATTCTGCCAGCGGCGGAGCCGGTGCCGGAGGCCGGTGTCCGGGCTGGT GA | 4076 |
| | 3 | MGLIPFRKTLTCTHPAPPSPRRAALQPPPPQ* | 4077 | ATGGGGTTAATTCCCTTTCGTAAGACTCTTACTTGCACCCACCCAGCCCGCCGTCG CCCGCCGCCGCCGCCTGCCCCTAACGCGCCTTGCTCCTCCTCAGTAA | 4078 |
| | 4 | MPFPPPSSSPGITRLAFLPRPPTGSANGEGGRQGRDVVC GKVAFPAGSSALQPGRPSDVPLLPARR* | 4079 | ATGCCCCTCCAACCGCTAGCGCTAACGGAGAAGGAGAGGCAGGGGGAGAGATGTGT GTGTGGAAAGGTGGCCTTCCAGCCGGTCGTTCAGCCAGGGAGAGATGTGT CGTCCGGCTGCTAGCCAGCCGGCGTTCAGCCAGGGAGCCTTCAGCTATTGA | 4080 |
| hsa-mir-128b | 1 | MFMHRNIAEVDVVAVSYSGLLPDHLLKM* | 4081 | ATGTTTATGCATAGAAATATAGCTGAGGTGGATGTGGTTGCTGTCAGCTATTCAGGT TTGCTACCTGATCACCTCTGAAGATGTAG | 4082 |
| | 2 | MWLLSAFQVCYLITS* | 4083 | ATGTGGTTGCTGTCAGTACAGATATTCATTTAA | 4084 |
| | 3 | MCLEYRYSF* | 4085 | ATGTGTTTAGAGTACAGATATTCATTTTAA | 4086 |
| | 4 | MFDFLPV* | 4087 | ATGTTTGATTTTCTACCAGTATGA | 4088 |

Figure 1 (Continued)

| | | | | |
|---|---|---|---|---|
| hsa-mir-129-1 | 1 | MLHMIQPPRSTPVAALRPRRRDPSPCLPDDLCLTPSCLL LYSHKFAASSPTSVLRGQPPSTSQQHCEASVPSPTCSSLS LLQSNSQYFPKTFRDCPLPVEEKQALRLARTTKVCLNRLS HLFSHFSPSCAYKSAPLCMSRP* | 4089 | ATGCTGCATATGATCCAGCCACCTCGCTCTACTCCTGTGGCTGCCTTCGTCCTCGTC GCCGGGACCCCTCTCCCTGCCTCCCAGACGACCTGTCGTTCCACCCCTTCGTCTCTT ATATTCTAACTCTCAGCAGCATTGCGAAGCCTCGTTTTCTCCCGACTTGCAGCAGCC TCCATTACCTCCTCCAGTCAATTTGCAGGTTTTTCCGCACACCTTCAGAGACTGCCCATT GCCTGTAGAGGAAAGCAGGCTCTTGCCTGCACGACCACCAAGGTTTGCCTGA ACATCCTTTCCCACCTTTCTGCTCACTTCTCCCCTTCCTGTGCCTACAAATCAGCCCCT CTGTGTATGTCTCGGCCTTGA | 4090 |
| | 2 | MDADFAPSLFVLVPWEEAAQEKDQAPGEADALASGCL VGRAPGTQGEMSTLPF* | 4091 | ATGGATGCTGATTTGCCCCATCATTATTGTGTTGTTCATGGAAGAAGCGGCC CAGGAGAAAGATCAGGCTCCGGGACACCCAAGGAGAAGGCTGATGGCTTGCTTCGGATGTTTAGT TGGAAGGGCTCCGGCACCCAAGGAGAAATGTCCACACTTCCTCTAA | 4092 |
| | 3 | MLLLPHHYLCWCHGKKRPRRKIRLQERLMRLLRDV* | 4093 | ATGCTGATTTTGCCCCATCATTATTTGTGCTGGTGCATGGAAGAAGCGGCCCAGG AGAAAGATCAGGCTCCAGGAGAGGCTGATGCGCTTGCTTCGGGATGTTTAG | 4094 |
| | 4 | MGRSGPGERSGSRRG* | 4095 | ATGGGAAGAAGCGGCCCAGGAGCGACGAAGATCAGGTCCAGGAGAGGCTGA | 4096 |
| hsa-mir-129-2 | 1 | MRAGCVMALVTVHSELRRNRDFAWRRPLHGRWGAGG HQESGDGGGGEDLSNENRCQGGI* | 4097 | ATGCGCGCTGGCTGCGTCATGGCTCTAGTCACAGTTCATTCCGAACTGAGAAGGAAT CGTGACTTCGCCTGGAGACGTCCCTACATGGAGATGCGGGGGAGCACCA AATCAGTGGGACGGGGCGTGCGGGAAGACCTATCCAATGAAAACCGCTGCCAGG GGGCATTGA | 4098 |
| | 2 | MGDGRGGTKSVGTGVGGKTYPMKTAARGAFELRRL LSRCPLSAPRTSLPLPAGARSGPAPARSPAKRRVFNKLEE GRNAGVKLGKPQLPRS* | 4099 | ATGGGAGATGGGCGGGGAACCAAGTCAGTGGGGACGGGGACCTGAACTGCCTGTGT AGACCTATCCAATGAAAACCGTGCCAGGGGAGCCATTGAACTCCGTCTGCT CTCGCTGCCCCTCTCCCCGCCACCTGCCTCGCCGCTCCACCAAACGTCGAGCGGCTCGCA GTGGCGCGCATGCAGGGTTAAGCTCGGAAAGCGCAATTACCAAGATCGTGA GCAGGAACGCAGGGGTTAAGCTCGGAAAGCGCAATTACCAAGATCGTGA | 4100 |
| | 3 | MCKGGGAPNQWGRGWCGRPIQ* | 4101 | ATGGGGGGCGGGGCGCCGAACCAGTGGGACGGGGCGTGGGGCGGCCTAG TCCAATGA | 4102 |
| | 4 | MPWEGEWVAELQEGDGWAKGVGRQGLEDSASTVERR FLRACWARVGVCVRARAPARTSIPGCQRINMATFFPSS CNVCSNPSWVRFPPLGDYTAREGDSQDVP* | 4103 | ATGCCGTGGAGGGTGAGTGGGTCGCGAGCTGCAGGAGGCTGATGGATGCGGA ACGGGGTGGGTCGACAGGGACTTGAAGACAGTGCCTCCACCGTCGAGACGTTT CTCCGCGCCGTCTGCGCGAGGTGCCAAAGAACAACAATATGGCAACTTTCCCCAAGTTCTTG CACGTCGATTCCAGGTCCAGGGTCCAAAGAACAACAATATGGCAACTTTCCCCAAGTTCTTG CAATGTTTGCAGTAACCCATCCTGGGTGAGTTTCCCACTGGGGACTATACTGC TAGGGAGGGAGATAGTCAGGACGTCCTTAG | 4104 |
| hsa-mir-130a | 1 | MGAWGSGSCSLHSRIPSIQDGRQGVWKEKGGEGGRAR SAEERVSAAHRPRNLGPGRRVAGRPLGIQOARPGRGAGG VREGVSEGERGQGGEPRGREGQRKSPGRRRWQAEDPN EEHQCVGIESPPKGNDTDFRPYSLLGKGGGRSGLFLSSSFP PPHESPLVGHFSIFSFGNTVTGKHQACLSEVASLSFSSGGR GGYGMGGSAGHGRAGPSVSTWVVCEGVECSEGDRGP KGWSRAGSSAPPEVVG* | 4105 | ATGGGAGCCTGGAGGGAGTGGGGAGCGGATCGTGCTCACTCAGTCAAGAATCCAAGTATTCAA GATGACGTGGAGTGTGAAGGAGAAAAKGGGGAGGGGAGAAGGAGCGAGAT CGGCAGAGGAGAGGGCTCGGGGACGCGCCAAGCCGGGATCCAAGCCTCCGCCTGGG CGGGTGGCGAGAGGGCAGAGAAGGCGTGAGCGAGGGAGCCAGGAGGGAGCCAAGAGG GAGGAAGGGCAGAGAAGAGCCCGGAAGAAGAGCTTCCGAAGGTAACGACACCGATTT AACGAAGAGCAATGTGTAGGTATCGGGAAGGAGGGGGCATCTTTCTATTTTTCTTTGAA TTCCTTTTTCCTTATTCCTCATTCCTCACTGTGGCAGGCGTGTCTTCTGAGGTGGCCTCACTGTCATTT ACACTGTAACTGTCCCCGTGCGGGCAGTAGGAATGGGGCCTCCGGAGTGTTCCGAGGGGAA GGGCCATCTGTCTCCACCTGTCGGGGTGTGTGCGAGGGTAGGATGGGGCCTCCGGAGTGTTCCGAGGGGAA GGGGGCGAAGGCTGGAGGCTGGAGCAGGGCAGGGAGTTCTGCACCTCCAGAGAAGTGTGTAG GGTGA | 4106 |

Figure 1 (Continued)

| | | | | |
|---|---|---|---|---|
| | 2 | MDGRECGRRKGARGEERDRQRRGSPRPTGLATSVPAG GWRGGRWGSKPGPGEGLAGCERA* | 4107 | ATGGACGGCAGGGAGTGTGGAAGGAGAAAGGGGCGAGGGGGAAGAGCGAGATC GGCAGAGGAGAGGGGCTTCCGCGACCGGCCTCGCAACCTGCGGTCCCGGCCGGC GGGTGGCGGGGCGCTGGCGCTGGGGATCCAAGCCCGGGAGAGGGCTGGCGG GGTGCGAGAGGGCCTGA | 4108 |
| | 3 | MCRYRELPEG* | 4109 | ATGTGTAGGTATCGAGAGCTTCCCGAAGGGTGA | 4110 |
| | 4 | MCVCGGRALTLQFLLFGCVMRAELCSKYG* | 4111 | ATGTGTGTGTGTGGGGGGCGGTGCGCCAACTCCAGTTCTTGTTGTTTGGGTGTGTA ATGAGGGCTGAGTTGTGCCAGCAAGTATGGCTGA | 4112 |
| | 1 | MPGAGPTTYTASHLLLATASPMGQV* | 4113 | ATGCCAGGTGCTGGGCAACAATTTACACAGCATTCATTTGCTGCTGGCAACAGCC AGCCCTATGGGGCAGGTTTGA | 4114 |
| | 2 | MNASPQSGSQSRRNQSLHFRSPYLPQIQKTTGPRTRSP* | 4115 | ATGAATGCTTCTCCGCAAAGTGGATACAATCCACAGATAACGAAGAAACAAAGCTTACACTTC CGTTCCCCATATCTCCCACAGATCCAAAAGACCACGGGGCCAGGACCGGTCTCA TAG | 4116 |
| hsa-mir-139b | 3 | MLLRKVDHNHEETKAYTSVPHISHRSKRPRGPGPGLHS PAIPGGFQESLTRVLPGDPQWLSWEGGYPSL.* | 4117 | ATGCTTCTCCGCAAAGTGGATCACAATCCACGAAGAAACCAAAGCTTACACTTCCGTT CCCATATCTCCACAGATCCCAAAGACCACGGGGCCAGGACCCGGTCTCCATAGC CAGCCATACCCGGGGTTTTCAGGAAAGTCCTCACTCGGTCCTGCCGGCGATCCG GGGTGGTTGAGTGGGAGGGGGCTACCCAGTTGTAA | 4118 |
| | 4 | MHNKAARGRVHSRLGGSGISTGSRPPPLWARAWRPSP GFQALLSVSLENSQRLLERKGGQSSF* | 4119 | ATGCATAACAAAGCAGCCTGCGTTCACAGCAGGCTTGGCGGGAGGGGTTCGGG AATTTCCACAGGGTCTCGGCCTCCCAAGTGTGGGCTCGCCTGGCGCCCCTCACC GGGCTTCCAAGCGCTCTTGTGTGCTAGAAAACTCGCAGAGATTGGAGCTGA GAAAAGCGCGGCAAAGTTCTTTTGA | 4120 |
| | 1 | MNEPPHEYYARL* | 4121 | ATGAATGAGCCGCCACACGAGTACTACGCGCTATAA | 4122 |
| | 2 | MSRRTSTTRAYKSRRAGQAAGGDRAVATRPAR* | 4123 | ATGAGCCGCCGCACCGACCGGGCAGTGCGACGGCCAGTGCGCCGCCAGGTAA | 4124 |
| hsa-mir-132 | 3 | MCGHGREDEEGTGRRRVGRPLRGGIDGGGRGAPGSPRG CGAGARDDTSPRSTCRRPMDTQLLRRSIEWRTDLGDPP PAFLGLLRHSPRKVRRRCWRPRRAPSSPSLRRGDSASL PGPAERGCRRETDAHPRFPGIPPGTPAPHGVGRPFPAGPV QRVPRRFRLPASASGAVLSGPGGRGLPGPAPFPRPRRKC PLWDIFDVTAL* | 4125 | ATGTGCGGACGGGACGAGGAGGAGGGGACGGGACGGCGCCGGCGGGTGGGC GGCCCCTCCCGGGGCGGAGGATGGGGGGACGAGGCCCGGGCAGCAACCCGCCCGGCGCCGAT TGCGAGCGGAGCCGGAGCCAGCTACTTCGGAGGACACGGACCATCGAGTGGAGGACCCCCGCC CCCCGGCTTCTTGCGGCGTCTGCGCCATTCTCCCAGGAAAGTGAGGCGAAGGTGCT GGCGCCCAGGAGACGCGCCCGCCTCCTCTGCGGCGTGACTCAGCCT CCCCCGGGCCGGCCCCGGGCCTGACTGAGAGGACCCGCGCTCGCCAGCT CCCCCGGCCCGGCCCCTGAGCCTGCATGGCGCTCGGCCGCCCTTTCCGGCA GGTCCGTCCAGCAGGCGCAGCAAGCCCCACGAGTGCCAGGGCCCCAGCCCCGCGGAGCT GTCCTCTCAGACGCGGGGAGGCCCCCCTGGGACATCTTTGACGTCACGGCCTCACGGCCCGA | 4126 |
| | 4 | MGADGGHRGPLAAAEPGPETTRAPAAPAGARWTRSYF GGASSGGPTSETPPRLSWJSSCAILPGK* | 4127 | ATGGGGGGCGGACGGGGGACGCAGGGCACTGCGCCGCAGGACGACCAGCAGCTACTTC GAGGAGGACATCGAGTGAAGGACGACGCACCCTGGAGACCCCCGGCTTTCTTGGGG CTCTGCGCCATTCTGCCATTCTCCCAGGAAAGTGA | 4128 |
| | 1 | MVRERSPRGPLGQGRVFGMLGRVYKNCKGEAGS* | 4129 | ATGGTCAGGAGGCGCAGCCCAGCCCACTGGCACGAGGGCCACTTGGCCCTCGCGTGTTTGGGAT GCTTTGGCGGGTATAAGAACTGCAAAGGTGAGGCGGCTCCTGA | 4130 |

Figure 1 (Continued)

| | | | | |
|---|---|---|---|---|
| hsa-mir-133a-2 | 2 | MAWGLRGWAGGAHLPLRNKAPAAGRGAKLTLNLQYF PLRCWWGAGIPELSGGEAAPGRDSALLQLSQPRQGQEA FTGAGRRGGCRGAHVGGD* | 4131 | ATGGCATGGGGCTTCGGGGCTGGGGCTGGAGCTGGGGGCCTGGGGGCCGATTCACCTGCCGCTCCGCAA CAAAGCCCCGGCAGCCGGGCGTGGGCTGGAGCTAAACTTACCTTGAACTTGCAGTATCCCC ACTGAGGTGCTGTGGGGGCAGGATTCGGAGGCTTCGGAGCTGAGGCGACTGGGAGCTGCC CCGCCGGGACTCGGCACTTCTGCAGCTCTCCAGCCACGTCAGGTCAGGAGGCG TTTACAGRGGCAGGGCGCGAGGTRGHGGCGGGGGGCACATGTGGGGGGAGACT AG | 4132 |
| | 3 | MGASGLGWGRDSPAAPQGSPGSRAWG* | 4133 | ATGGGGGCTTCGGGGCTGGCTGGCGCGGCGCGATTCACCTGCCGCTCCGGAACAAAG CCCCGCAGCCGGGCGTGGGCTAA | 4134 |
| | 4 | MWAETRGASGRAALVVGVCAGPCWGA* | 4135 | ATGTGGGCGGAGACTAGGGGCGCTTCGGGAGGCAGCCCTGGTGGTCGCGTCTG TGCAGGTCCCTGCTGGGGAGCTTGA | 4136 |
| hsa-mir-133b | 1 | MVQSRPANFLYF* | 4137 | ATGGTGCAATCTCGTCCGGCTAATTTTCTGTATTTTAG | 4138 |
| | 2 | MEFHHVVQAFLELLTSGDPAALASQSVGITGVSHRARPI STYYIR* | 4139 | ATGGAGTTTCACCATGTGTCCAGGTTTCTTGAACTCCTGACCTCAGGTGATCCA GCTGCTCTGGCCTCCAAAGTGTGGGATTACAGGCGTGAGCCACCGCCCGGCC CATAAGTACCATATATATAAGATGA | 4140 |
| | 3 | MLSRLFLNS* | 4141 | ATGTTGTCTCCAGCTTTTCTTGAACTCCTGA | 4142 |
| | 4 | MRASPPLRNL* | 4143 | ATGAGAGCTTCCCACCCTAAGAAACTTGTAG | 4144 |
| hsa-mir-134 | 1 | MDQGVEGGCGPGVGRQSACSL* | 4145 | ATGGACCAGGGGTAGAGGGGTGGGTGTGACCTGGGGTCGGGCGCAGTCAG CTTGCAGCCTATGA | 4146 |
| | 2 | MKIDGKEGYRIDRGRVGLRIARAAWHTVLG* | 4147 | ATGAAGGACGGGAAAGGAAGGAGGCTACAGAGATAGGGAAGAGTGGGGCTGAGGATAG CCAGAGCCGGTTGGCACAGTTTAGGGTAA | 4148 |
| | 3 | MTEPVTPGSSFKACLMGDSVVPVTKLGPESQGRAHQV AALP* | 4149 | ATGACTGAGCCGTCACTCCAGGTCTTCCTCAAAGCGTGTCTAATGGAGACAGC GTTGTCCCAGTAACCAAATTGGACCAGAGTCCCAGGGAAGGCTCATCAGGTGGC CGCTCTGCCTTGA | 4150 |
| | 4 | MILFPLDPAPL VPFSL * | 4151 | ATGATTCTTCCCTCTGATCCAGCCCTAGTTCCCTTTCACTTTGA | 4152 |
| hsa-mir-135a-1 | 1 | MGWPEPWGAGRWGECFSAPGSGEQQWTASFRSPGGQ QEWEAEGWPVSREGQGWPGAGRLRSCLGAWLLWVAL G* | 4153 | ATGGGGTGGCCGGAGCCCTGGGGGGCAGGCAGATGGGGAGAATGCTTCTTGCCC AGGCAGTGGGGAGCAGCAGTGACTGAACTTCAGCTTCCCCGGGGGTCAGCAGG AGTGGGAGGCAGCAGCGGTGACCAGTTAGCCGCAGTTAGCCGGACAAGGCTGGCGGGAGC TGGCAGGCCTCCGTTCTGCCTGGGTGCCCAGGCAGTGGGGACGCAGTGGACTGGACTGCCAGCT TCAGGTCCCGGGCTCAGGGGGTCAGAGAGTGGAGGCAGAGGGCGTGGCCAGTAG | 4154 |
| | 2 | MGRMLLCPRQWGAAVDCQLQVPRGSAGVGGRGVAS* | 4155 | ATGGGGAGAATGCTTCTCTGAGTCCAGGCAGTCTGACTTGGGGACCGTGACTGGCTGCTGCTATG CAGGTCCAGTGCTGGTACAGGGGGTTGGCCAGCAGGGCCACGTTGCGCCCTCACAAGTGC | 4156 |
| | 3 | MPSPGVQGSDPTSDWAAAMGLLGASSGTVQGTVTLTS ACASRGVGGWLECAGATPTAQVESLSGGRDLPPAIGSQ VLLQATDPQTHRPTW* | 4157 | ATGCCCAGTCCTGGGGTTCAGGGGTCAGATCCTAGTGACTGGGCCGCCGCAATGC GGGTTGCTGGCTAGCAGGGGGTTGGCCGCTGGCCAACGTTGCCCTGGGAATGTGCTGGGGACTGTGCTGCTGGAACCCCCACTG CTCCTGGAGAGTCTGAGTGGAGGAGAATCTCCCGTGCCGCCATAAGGCTCACAG GTTTTACTCAAGCTACTGATCCCAGACCCATAGACCCACATGGTAA | 4158 |
| | 4 | MCWGYSHCPGGESEWRERSSPCHRLTGFTPSY* | 4159 | ATGTGTGGGGCTACTGCCACTGCCAGGTGAGAGTCTGAGTGGAGGGAGAGATC TTCCCCTTCCATAGGCTCACAGTTTTACTCCAAGCTACTGA | 4160 |
| hsa-mir-135a-2 | 1 | MVKFRNQKS* | 4161 | ATGGTTAAATTCAGAAATCAGAAGAGTTGA | 4162 |
| | 2 | MWKKNCFY* | 4163 | ATGTGGAAAAAAAATGTTTTATTGA | 4164 |
| | 3 | MSNVFFKFNFSVMSLK* | 4165 | ATGTCCAATGTCTTCTTCAAATTTAATTTAGTGTCATGTCTAAAGTAA | 4166 |
| | 4 | MSSNLILVSCL* | 4167 | ATGTCTTCTTAATTTAATTTAGTGTCATGTCTAA | 4168 |
| | 1 | MALCRAWVWGSGGP* | 4169 | ATGGCTTTATGCAGGGCTGGGTCTGGGTTCTGGGGGCCATGA | 4170 |

Figure 1 (Continued)

| | | | | |
|---|---|---|---|---|
| hsa-mir-135b | 2 | MQGLGLGFWGPMREEGKENQRGLGLGQMAQSSGGRP QDAWLFGPEGWACLECVEGRAVLCCVLCCAVV GECRIPVQ* | 4171 | ATGCAGGGCCTGGGTCTGGGTTCTGGGGCCCATGAGAGAGGAAGGAAAGGAGA ACCAGAGGGGTTGAGCTGGGGCAGAATGGCCCAAAGTTCAGTGGGAGGCCGCA GGATGCCTGGTTGTTTGGCCCTGAAGGTTGGGCATGTCTGAGTGTGTGGAGGGGC GTCGTGTCGTGCTGTCGTGCTGTGTGCTGCTGTCGTGTGTTGTGGAGGATTCCTGTCAGTGA | 4172 |
| | 3 | MPGCLALKVGHVVWSVWRGVLCCAVCCVLCCAVLLLG NAGFLSSENRLLLPGLCREPASVALGLRVQLGWERQLL PGJKGRA* | 4173 | ATGCCTGGTTGTTTGGCCCTGAAGGTTGGGCATGTCTGAGTGTGTGGAGGGGCGT GCTGTGCTGTCGTGCTGTGTGCTGTGTGCTGTGTGGCGGTAGTGCTGTTGGGAATGC AGGATTCCTGTCCAGTGAAAACAGGTTGCTTCTACCAGGGTTGTGCAGGAGCCAGC AAGTGTTGTCCCTGGGCTGAGGGTACAGTGGGGTGGGAGAGGCAGCTACTCCCTG GCAGAGGCAGGCCTGA | 4174 |
| | 4 | MSGYVCGGACCAVLCAVCCAVLCCCWGMQDSCPVKTG CFYQGCAGSQQVLPWG* | 4175 | ATGTCTGGAGTGTGTTGTTGAGGGGCTGCTCTGCTGTGTCGTGTGTCTGCT GTGCTGCTGTTGTCAGGGAGCCAGCAAGTGTTGCCCTGGGGCTGA TACCAGGGTTGTGCACGAGGAATGCAGGATTCTGTCCAGTGAAAACAGGTTGCTTC | 4176 |
| | 1 | MVNPLCT* | 4177 | ATGGTTAATCAATTCGTGCACCTGA | 4178 |
| | 2 | MTERMNGHMND* | 4179 | ATGACAGAAAGAATGAATGGACACATGAACGACTGA | 4180 |
| hsa-mir-136 | 3 | MEMPGTARKELPMGLSFISLWAPEVHKREKRQEEKCQ GVKDRAKERQK* | 4181 | ATGGAAATGCCTGGCACAGCCAGGAAGGAGCTGCCCATGGGATTGTCATTCATCTCA CTCTGGCACCTGAGTTCCATAAGCCTGAAAAGAGGCAGGAAGAGAAGTGTCAGGG AGTCAAAGATAGAGCTAAGGAACGACAAAATGA | 4182 |
| | 4 | MKLNESERENKEKPKKKRINTWVYL* | 4183 | ATGAAACTAAATGAAAGTGAAAGGGAAAACCAATAAAAACCAATAAAAGAGAA CGAATACGTGGGGTATCTGTAA | 4184 |
| | 1 | MDLWSRSSSAHPQAGAGSASSKSSGGGGSSSGGGSGSS GSGSSGSGSLVL* | 4185 | ATGGATTATGTCCGGTCAAGCTCAGCCCATCCAGGCAGGGCGCGGCTCAGC GAGCAGCAAGAGTTCTGGTAGCAGCGGCGGCGGAGGGCAGTAGCAGCGGCAGTAGC AGCGGCAGCGGTAGCAGCGGTAGCAGCGGCAGCGGCAGCTTGGTCCTCTGA | 4186 |
| hsa-mir-137 | 2 | MVPVKLSPSPGRGGLSEQQEFWWRRRQ* | 4187 | ATGGTCCCGGTCAAGCTCAGCCCATCCCAGGCAGGGGCGCGGGCTCAGGAGCAGCA AGAGTTCTGGTCGCAGGGCGGCGGAGTAG | 4188 |
| | 3 | MGSSRGRGAR* | 4189 | ATGGGTTCGCAGCGGCGGGCGGCGAGGTGA | 4190 |
| | 4 | MGGERKGVRPEPAGRFGVPSPLLSSPRWGAAGGRDA DGAIF* | 4191 | ATGGGCGGGGAGTCGAAGGGTCCGTTTCCCGAGTCCGTTCCCGAGGCTGCGGGGGTT TCCCAGTTGCGCGCTCCTCTCCCCACGGTGGGTGCGGCTGGAGGGAGAGACGCGG ACGGGGCGATTTTCTAA | 4192 |
| | 1 | MGGCDPLLPCSGPYTYTPPTTCRALRPTARPAGLTWCLR VLLASWGCGNQPWAAFALHEETMRLS* | 4193 | ATGGGTGGGTGTGATCTCCCTCCGTTCCCTGCTGCCGCGGCCCTACACCTCCACC ACCTGCTAGAGCTCCAGCTGGGGCTCTGCCAGCCACGCGTGGGCTCGTCGTCCTCC GTTTTGCTTGCCAGCGAGGAACCAGCCGTGGGCTGCTTTGCCCTACAC GAGGAGCGATGAGAGAGAGAACTGA | 4194 |
| | 2 | MRKVLAKRLRKFATEAHGEEWAQSTSGRQHLFSSTHSP SSP* | 4195 | ATGAGAAAAGTGCTTGCAAAAGCTAAGGCTGCGAAATTGCAAACAGGAGCTCACGGGGA AGAGTGGGCTCAAAGCACCAGTGGCAGGCAGCACCATTCTCATCTACACAGCCC CTCCAGTCCTAG | 4196 |
| | 3 | MPRPLWSWVSLWQKLGFAEPAAF* | 4197 | ATGCCCGTCCTTGTTGGAGCTGGTATCGTTGTGGCAGAAGTTGGGAATTTTTGCA GAGCCTGCTTTTGA | 4198 |
| | 4 | MWVHQ* | 4199 | ATGTGGGTTCACCAGTGA | 4200 |
| hsa-mir-138-1 | 1 | MRIDLLEEQKKPNMEGESLGLIKQGALLEQPPPTELSCCGGAS R* | 4201 | ATGCGTGACTATTAGAGGAGCAAAAGAAGCGAATATGAAGGGAAAGCCTTGG CCTGATCCAGGGTGCTCTAGAACAAATTCCTCCACTGAACTGTCCTGCTGTGGGGC AAGCAGGTGA | 4202 |
| hsa-mir-138-2 | 2 | MHWQQQGDGDSRCGDLEHPHAHLHGETLTDTYLQAR LKKHLGGAG* | 4203 | ATGCACTGGCAACAGCAGGGGGATGGTGACAGCAGGTGTGGGATCTGGAGCACCC ACACGCCCACATCCTCATCGTCATGCCATGTGAGACCCTTACTGACACCTATTTACAAGCAAGGCT TAAAAGAAGCATCTGGGGGGCCGGGTGA | 4204 |

Figure 1 (Continued)

| | | Protein Sequence | SEQ ID | Nucleotide Sequence | SEQ ID |
|---|---|---|---|---|---|
| | 3 | MVTAGVGIWSTHTPTSCMVRPLLTPIYKQGLKRSIWGA PGEGKSSGLSDQTGRFGVGEAGSRK* | 4205 | ATGGTTGACAGCCGGTGTGGGGATCTGGAGCACCCACACGCCACATCCTGCATGT GAGACCCTTACTGACACCTATTTACAAGCAAGGCTTAAAAGAAGCATCTGGGGGG TGCCGGGGTGAAGGCAAATCTTCAGGGCTCTCGGATCAAACTGGGAGATTTGTGGGTT GGAGAAGCAGGCAGCAGGAAATGA | 4206 |
| | 4 | MNLSSVHIWLQSSQTLKLRLQLDVE* | 4207 | ATGAATCTGTCTTCTGTTCATATCTGGCTGCAAAGTCACTAAACGTCAAGCTCAGG CTGCAGCTGGATGTGGAATGA | 4208 |
| hsa-mir-139 | 1 | MRSDGAGMRPLHPLQEPAVPGSATG* | 4209 | ATGAGGAGTGATGGGGCAGGCATGGCCCCACTCCATCCTCTGCAGGAGCCAGCAGT ACCCGGCAGCGCGACCGGCTGA | 4210 |
| | 2 | MGQACGHSILCRSQQYPAARPAEP* | 4211 | ATGGGGCAGGCATGCGGCCACTCCATCCTCTGCAGGAGCCAGCAGTACCCGGCAGC GCGACCGGCTGACCGTGA | 4212 |
| | 3 | MELSHVEGSILFLGTPPPRVARLQPGVGAGYL* | 4213 | ATGGAGCTGAGCCACGTGGAAGGATCGATCCTGTTCCTGGCCACCCCTCCTCCCGC GTTGCCAGACTGCAGCCTGGGGTGGCCAGGTTACCTCTGA | 4214 |
| | 4 | MRVSNVNLVGDEAGVPWKGLLVGGGADNEPEPYLQG LRVYVGRGRSAK* | 4215 | ATGAGGGTGTCTAACGTCAACCTAGTAGGTGATGAGGCTGGGGTTCCATGGAAGGG GCTGCTGTTGGAGGAGGGCGACTGGAAATGAACCTGAACCGGTTCTTCAAGGGCTGA GGGTGTATGTGGGGAGGGGAGGTCTGCCAAGTAG | 4216 |
| hsa-mir-140 | 1 | MGAPAAKGAAGASPPGRGEELRPPGMERSDLCGGHGTR GRGDLELSWKGYPENGPMAWSQREKDAAWTPSESLSL PSCLEMIVTRDFIDGPIQFLNFRRDHRLIJVLLPSRPLSPA WVGHPLLGSLALQLIFL* | 4217 | ATGGGTGCTCCGGCCGCCAAGGGTGCAGCTGGAGCGAGTCCTCCGGAAGGGGAGA GGAGCTAGGTTCCAGGATGGAGCGATCTTTGTGCAGCAGGGCGGACCA GGGGAAGGCGGCGACTTGGAACTGAGCTGGAAGGGGGTCCCTGAAATGGGGTTATG CGGTGGAGCCAGAGGAAATGATTGTTACCCGAGACTTGATGACGGTCCATTCAGTTTT CCTTCCTGTTTGGAAATGATTGTTACCCGAGACTTGATGACGGTCCATTCAGTTTT TAAACTTCAGGAGGCGATCACAGAATCTTGATCGTCTTGCTTCCTCGCGCCACTTA GTCCTGCGTGGGTAGGGTTTCCACTTCTTGGGAGCCTAGCCCTTCAGCTCATTTTCT TTGA | 4218 |
| | 2 | MGLWRGARGKKMLPGPPLRVSPPLPVWK* | 4219 | ATGGGTTTATGGCGTGGAGCGTGGAGGAAAAGATGCTGCCTGACCCCCTCTGAG AGTCTCTCCCTTCCATTCAGTTTTAA | 4220 |
| | 3 | MTVPFSF* | 4221 | ATGACGGTTCCCATTCAGTTTTAA | 4222 |
| | 4 | MAPSLHC* | 4223 | ATGGCTTTTAGCTTACACTGTTGA | 4224 |
| hsa-mir-141 | 1 | MAGGHTCAQGGRRGPGKEPALAARQAEKEGGRAEAR AGSRPWNLGP* | 4225 | ATGGCAGGAGGACACCACCTGTGCGCAGGGTGGCAGGGGAGGCGGGGCCAGGTAACGAGC TGCCGCTGGCCTGCCGGCCAGGCGGAGAAGGAAGGAGGGAAGAGCGGAGGCCAGGGC GGGGCTCTAGGCCGTGAATCTGGGGCCTTAA | 4226 |
| | 2 | MRVGKSVCVAGRERLPGVGEGGSEAACRRKSRGFGGPA WTATWAS* | 4227 | ATGAGGGTGGTGGTAAATCGTGTGTGCGGTCGGGAACGGGGAACTGTCCGCGGGTAGG GGAAGGTGGCTCAGAGCGCGGCCGGCGAAGGTCGAGGGCCTTCGGAGGGCCTGCTT GGACTGCAACCTGGGCTCGTGA | 4228 |
| | 3 | MGIARDLQLFRRDPGPEAA* | 4229 | ATGGGGAGCCAGGGATCTCCAGCTTTTCCGCAGGGATCTGGGCCTGAACCTGCCTGA | 4230 |
| | 4 | MMEAPVPVSATSHASGPQPLAGGSPLPTSHAPRKPLVLS* | 4231 | ATGATGGAGGCCCCTGTCCCTGTGTCAGCAACATCCATGCCTCAGCTCCCAGCCC TTAGTTGGCTGCTGCAGCCCTCCTCCCACTTGCACGCACGCTGGAAGCCCTCGTCTTTG AGCTGA | 4232 |
| | 1 | MTGFLLCPSHYYYTVRFIHYHTSVTQILGKYSVPRFFSP* | 4233 | ATGACTGGATTCTTACTGTGCTTCAGTCATTATTATACTGTTCACTTCACACATT ATCATACTTCAGTGACTCAGGACCTTGGGCAAATACTCGTGCCTCGCTTTTCAGTCC ATAA | 4234 |
| hsa-mir-142 | 2 | MGLLNSCCRTYMR* | 4235 | ATGGGCCTACTTAATAGTTGTTGCAGGACTTACATGAGATAA | 4236 |
| | 3 | MFQSGKFYSVIENQTCHRAHLNTAWDRQQEESPPGSSS RRLLGWNDSAAGPETYIPKLLSDKHK* | 4237 | ATGTTCCAAAGTGGAAAGTTTTATTCAGTGATAGAAAACCAAACCTGTCACAGA GCCCATCTGAACACAGCATGGACCTGCCAACAAGAAGAAAGCCCGGAAGCAG CTCAATCAGGAGGGCTGGGCTGGAATACAGCCAGCGGGCAGGGGCTGAAACTATTTATA TCCCAAAGCTCCTCTCAGATAAACACAAATGA | 4238 |

Figure 1 (Continued)

| | | | | | |
|---|---|---|---|---|---|
| | 4 | | MGPPTRRKPARKQLNQEAGLE* | 4239 | ATGGGACCGCCAACAAGAGAAAAGCCCGCCGGAAGCAGCTCAATCAGGAGGCTGG GCTGGAATGA | 4240 |
| hsa-mir-143 | 1 | | MKMGVYPSFSPF* | 4241 | ATGAAAATGGGAGTTTATCCCTCCTTTCTCCTTCTGA | 4242 |
| | 2 | | MKPSPAFWFLGSRKQRY* | 4243 | ATGAAACCTTCTCCCGCTTTTGTTTTTAGGAAGCAGAAAGCAGAGATATTAA | 4244 |
| | 3 | | MNEVASYHPGRMLGQQFPALADTAKGFPYLIRWLQPP RKVEQDSSSVL* | 4245 | ATGAATGAGGTAGCGTCTTACCACCCTGGCCGCATGCTTGGTCAGCAATTTCCAGCA CTTGCAGACACTGCAAAAGGCTTCCCTATCTCATAAGATGGTTACAACCACCTAGA AAGGTGAGCAGGATTCTTCGTCTGTGTATAA | 4246 |
| | 4 | | MVTT* | 4247 | ATGGTTACAACCACCTAG | 4248 |
| hsa-mir-144 | 1 | | MLYGAGNLAVSASCCCYPWEPGNVALGQGPA* | 4249 | ATGCTTGGTAGGGGCGGGTAATCTGGCAGTTCAGCTTGCTGTTGTTGCTACCCTTGG GAACCTGGCAATGTTGCCCTTGGCCAAGGCCAGCTTGA | 4250 |
| | 2 | | MLPLAKAQLELWQPAPQAKE* | 4251 | ATGTTGCCCTTGGCCAAGGCCCAGCTTGAGCTGTGGCAGCCTGCTCCCCAAGCCAAA GAATAA | 4252 |
| | 3 | | MPVIPALWAPKAGRSPEVRSSRPARPTWRNPISTNNLKI SQTWWWLPVIPATWEAEAGESLESGRRKLH* | 4253 | ATGCCTGTAATCCAGCACTTGGGCACCTAAGGCAGGCAGATCACCTGAGGTCAGG AGTTCGAGACACTGCAAAAGGCTCCTGTCTGCCAACATGGCGAAACCCATCTCTACTAACAATTTAAAA ATTAGCCAGACGACGTGGTGGTGCCTGTACCCAGCCACTTGGGAGGCTGAGGC AGGAGAATCACTTGAACTGGGAGGCGGAAGTTGCATTGA | 4254 |
| | 4 | | MAKPHLY* | 4255 | ATGGCGAAACCCATCTCTACTAA | 4256 |
| hsa-mir-145 | 1 | | MKMGVYPSFSPP* | 4257 | ATGAAAATGGGAGTTTATCCCTCCTTTCTCCTTCTGA | 4258 |
| | 2 | | MKPSPAFWFLGSRKQRY* | 4259 | ATGAAACCTTCTCCCGCTTTTGTTTTTAGGAAGCAGAAAGCAGAGATATTAA | 4260 |
| | 3 | | MNEVASYHPGRMLGQQFPALADTAKGFPYLIRWLQPP RKVEQDSSSVL* | 4261 | ATGAATGAGGTAGCGTCTTACCACCCTGGCCGCATGCTTGGTCAGCAATTTCCAGCA CTTGCAGACACTGCAAAAGGCTTCCCTATCTCATAAGATGGTTACAACCACCTAGA AAGGTGAGCAGGATTCTTCGTCTGTGTATAA | 4262 |
| | 4 | | MVTT* | 4263 | ATGGTTACAACCACCTAG | 4264 |
| hsa-mir-146a | 1 | | MNSVWCHTAQ* | 4265 | ATGAACACAGTGTCTGGTGTATAACATTGTCAATAA | 4266 |
| | 2 | | METLTNCVTLGKSP* | 4267 | ATGGAAACACTTACTAATTGTGTAACTTAGGAAGTCCCCTAA | 4268 |
| | 3 | | MSKRGSQNGDNNSSGYLLWMIAVGLGKMMHVIHLAEC LVPSRCPLKFSYDCSL* | 4269 | ATGAGTAAAAGGGGATCACAAAATGGAGATAATAATTCGGGCTACCTGCTATGAT GATTGCTGTGGGATTAGGGAAGATGATGCACGTGATACATTTAGCAGAGTGCCTGG TGCCTAGTAGTGCCCATTAAAATTTAGCTATGACTGTTCTCTTTAG | 4270 |
| | 4 | | MEHHRATCYG* | 4271 | ATGGAGCATCATAGAGCAACATGCTATGGATAA | 4272 |
| hsa-mir-146a | 1 | | MQGLSCLPLPQQIRVSPERCSFSKTLDRSSFPGWHQQG RLEW* | 4273 | ATGCAAATGCCTTAGCTGCCTTCCTACCCAGCAAATAAGAGTCTCTCCAGAA AGATGCTCTTTCCAAGACGCTTGACGGCTCTCCTTTCCTGGATGGACAGCAG GGCCGATTGGAAGTGGTAA | 4274 |
| | 2 | | MLFLQDA* | 4275 | ATGCTCTTTCTCAAGACGCTTGA | 4276 |
| | 3 | | MAPAGPHGVVNPGPEGMPKGGQDGQETVAQRGGGEQR LNWK* | 4277 | ATGGCACCAGCAGGTCCACATGGAGTGGTAAACCCTGGCCGGAAGGCATGCCAAA GGGTGGACAGGATGGACAGGAGACAGTAGCACAGGAGGGGAGAACAGCGG CTGAATTGGAAATGA | 4278 |
| | 4 | | MDRRQ* | 4279 | ATGACAGGAGACAGTAG | 4280 |
| hsa-mir-146b | 1 | | MGTDSPLPEGTA* | 4281 | ATGGGAACAGACTCCCCACTGCCCTTGGTACTGCTTGA | 4282 |
| | 2 | | MPFHRHSFQ* | 4283 | ATGCCTTTTCACCGCCATTCTTCCAGTGA | 4284 |
| | 3 | | MRNWT* | 4285 | ATGAGAAACTGGACTTGA | 4286 |
| | 4 | | MAGAGSRSGLRLERALWAGPLALPHLPPFSEEPAWGGG GRRLGRGWGPYLRSTG* | 4287 | ATGGCGGGGCGGGTCCGTCTGGCTTGAGGTTAGAAGGGCTCTGGGCAGG GTTCCTGCGCCCTCCACACTTCCTCCTTTCAGAAGAGCCAGCAGCATGCCGGCAGG CGGGAGGCGCTGGGGCGGGCGGGCCTTATTAAGGAGCACCGGCTGA | 4288 |
| | 1 | | MPPAKIL* | 4289 | ATGCCCCAGCCAAAACACTTTAG | 4290 |

Figure 1 (Continued)

| | | | | |
|---|---|---|---|---|
| hsa-mir-147a | 2 | MLLPPFLFLVSFEWSFRNIFSALGEASPDPILGEMPHLCS RSPHITVQIL* | 4291 | ATGCTCCTCCCACCCTTTCTTTTTCTAGTAGTTTGAATGGTCCTTTGAAATATT TTTCTGCCCTTGGGAAGCCTCCTCCTGACCGATACTAGGTGAAATGCCCACCTCT GCTCCTGCAGCCCTCCAGTCCAGCCACCACTGTGCAAATCCTGA | 4292 |
| | 3 | MELPAPEDLAPSSPDTMVRGGDGIALAGSVGCSSPGWES GEWPHATLPVSPSIKRGAEEVGSTDPFCGSCHLCSS* | 4293 | ATGGAATTGCCAGCACTGCAGCCCTCCTCTCCAGACACGATGGTGAGGGG AGGAGACGGGATTGCACTTGCTCTGAAGCGTAGGGTGCAGCAGCCCGGCTGGGAGT CCGGGGAGTGGCCTCATGCCACTTTGCCTGTCCCCATCCATTAAGAGAGGGGCGG AGGAAGTGGGCAGTGACCCTTCCTGCTTCGGTTCTGCCTGTCCATCTGTGCTCTCCT GA | 4294 |
| | 4 | MPLCLSPHPLREGRRKWAVQTLSASYPARCALPEKYLH RCTSVEYVPVCENSD* | 4295 | ATGCCACTTTGCCTGTCCCATCCATTAAGAGAGGGGGCGGAGGAAGTGGGCAGT ACAGACCCTTTCTGCTTCGTCCGCATCTGCCATCTGTGCTCTCCTGAGAATATTGCAC AGGTGTACCTCGGTAGAATACGTACCAGTGTGAAAACTCAAGATTGA | 4296 |
| | 1 | MRAICFRPASSVFRFPLWAGWVS* | 4297 | ATGCGCGCAATCTGCTTCCGGCCTGCGAGCTCGGTTTTCGCTTTTGGGCCGGG TGGGTTTCCTAA | 4298 |
| hsa-mir-147b | 2 | MAPDSDPPFGPLLKLLPLDARDRGTQRCRLGPAALHA LGARLGSAVKISLPDGGSCLCTAWPRRDGADGFVQLDP LCASPGAAVGASRSRSSLSNRLLVPCJPLRRYAVWP VLRERACIAPGARNTAAVLEAAQELLRNRPISLGHVVVA PPGAPGLVAALHVUGGTPSPDPAGLYTPRTRVSLGGEHP SEAQFOPEVPLGLSEAADSLRELLKLPLRYPRALTALG LAVPRGVLLAGPPGVGKTQLVRAVAREACAELLAVSAP ALQGSRPGETEENVRRVFQRARELASRGPSLLFLDEMD ALCPQRGSRAPESRVVAQVLTLLDGASGDREVVVGA TNRPDALDPALRRPGRFDREVNGLGGFAHCRWNLGRF WRHLAAPEAFAS* | 4299 | ATGGCTCCGACTCGATCCTCCCTCGAAGGTCGTCTACCCTTA GACGCTAGAGACCGGGCGCGCCCTGAGCCTCCCGCTGGGCCCGGCCCCCCCACGC CCTGGCCGCAGCTTGGCTCGGCAGTGAAGATCTCGCTACCCGACGGGCGTCCT GCTCCTGAACTGCCGGCCTCGGGCGGCGGGACGGAGCGGAGCGGACTCGTCTGAC CGCTCTGCCGCAGCCCTCCGGCGCCTCGGCGGCGGAGTCCCGGGTGCCGGAGTCC CGGCTCCGAATCGCCTGAAGCCTCCGCCGCCGGTCGCCGGGAAGCCGCGGCCGCGCCT GGAGGGCGGCACAGAGCTGCTCGAGAAACGACGATCTCCTGGGCCACGTGGTG GTGCGCGCCGGCAGGGCCCAGGCCGCACCCTCGCTCCTCGGCCCCAGTCCCGGCGACG CCCAGTCCCGATCCGGAGCCCGGAGTTGCCCCAGAGCCCCTGGGAGGCTTCGGA GAGCCTCCGTCGGAAGCCGGACTCGGAAGCTCCCGCTCGGTCCCCGGGAG GCGGCGACTCGCTAGCGGTGGTGCGGCCGGCCAGGGTTCCGGCTGCAGGGTCAGCCAGCTGCTG GACCCGGGGAAGACCCAGCTCGTTGCCGGCCCGTGCCGGGGAGACAGAACGT GCAGTCAGCGCCGCTTCCAGCGCGCGCCAGCCGCCGCCAGCCTCCTCTT GGGGGCGAAGATGGCCCAGGTTGTTGACGTCTGAGCGTCTGGGAGGTGCTG CCTGGACGAGATTGACGAAGGTGAATGCCTTGGCGGTTGCCCACTGCGGTGA ACCTCGGCGCGCTTCTGCCGCCATTGCTGCCGCCAGAGCCCGAGAGCC GTGGTTGTGGGAGCACTAAGGCCCTAGCCAGCCTGGTGCTGGCCGAGGTC GAGGAGAGATTGACCGAAGAGGTGAATCGCCTTGGCGGTTGCCCACTGCCGTGGA ACCTCGGCGCGCTTCTGCCGCCATTGCTGCCGCCAGAGCCGGCCTCTCTAG | 4300 |
| | 3 | MGLAGLPTVGGTSAASGAIWLPRRRLPLRFEHR* | 4301 | ATGGGCTTGGCGGGTTTGCCACTGTCGGTGGTGGAAACCTCGGCGCGTTCTGCGCGCCATT TGGCCTCGCCCCGGAGCGTTCTGCCTCTTAGGTTGAGCATCGTGA | 4302 |
| | 4 | MQRTRSLPFYDL* | 4303 | ATGCAGAGAACACGTTCTCTGCCGATATGATCGTGA | 4304 |
| | 1 | MSFFQLLMKRKIEVSFKNQ* | 4305 | ATGAGCTTTTTTCCAACTCCTGATGAAAAGGAAAGGAAGTAAGTTTTAAAAACAATTGA | 4306 |
| | 2 | MKRWHRF* | 4307 | ATGAAAAGATGGCACAGATTTTGA | 4308 |
| hsa-mir-147b | 3 | MAQILNKV* | 4309 | ATGCAACAGATTTTGAACAAAGTATAA | 4310 |
| | 4 | MPHIEVSKCVPSTCYLLAHSLGGVHDCGGGWSLIPRCV PSLENRCDVSRSQFIKTPLAVPG* | 4311 | ATGTTTCATATTGAAGTGTCAAATGTCCCTCCACCTGTTATTGTTAGCTCATT CCCTTGGTGGTTCATGACTGTCATGGATGTGGATGTAAGTAGGTTCCAATTTATAAAACGTTTTGA | 4312 |
| | 1 | MVHTQSYFCF* | 4313 | ATGGTACACACTCAATGCTATTTTGTTTTGA | 4314 |

Figure 1 (Continued)

| | | | | | |
|---|---|---|---|---|---|
| hsa-mir-148a | 2 | MRLAPKLGPLLIFPLKSCETTSLVLLIRSIF* | 4315 | ATGAGGCTAGCCCCAAGTTGGGACCATTATTAATTTTCCCCTCAAGTCATGCGAAACATCTCTTGTCCTTTAATCAGAAGCATATTTAG | 4316 |
| | 3 | MRNISCPFNQKHLGAAE* | 4317 | ATGCGAAACATCTCTTGTCCTTTAATCAGAAGCATATTTAGGGCGTGCGGAATAA | 4318 |
| | 4 | MADNSPPPPVFY* | 4319 | ATGGCAGACAATAACTCCCCAGTCCCCCAGTATTTTATTAA | 4320 |
| hsa-mir-148b | 1 | MWFLPTPRPHLAPGQRGHTWLQASPSPPFQPRSPARSAFLPCI* | 4321 | ATGTGGTTTCTGCCCACACCCCGCCCACACCCTTGCTCCTGGCCAGCCCTTCAGCCAGGAGTCAGCAGTCAGGTCTGCGTTTCTCCCATGCATTTGA | 4322 |
| | 2 | MAPSLSQPSFSAQESSQVCVSPMHLTNSNLMVHSNVTFKLYTGCRRLVSPRLS* | 4323 | ATGGCTCCAAGCCTCTCCCAGCCTCTTTAGCCCAGGAGTCAGGAGTCCAGCCAGGTCTGCGTTTCTCCCATGCAATTGACGAATTCAACCTGATGGTCACTCGAATGTGACCTTTAAACTTTATACAGGTCGTCGTGCCCACGCTCTCTAG | 4324 |
| | 3 | MCPFTCSLLPSPLSLRSPRTKDSFLARFLSVCEGS* | 4325 | ATGTGTCCCTTTCACCTGTAGCCTTCTCTCCCCCCCTCAGCCTCAGAAGTCCAAGGACAAAGGATTCTTTCTTGGCCAGTTGTTCAGTGTGTGAAGGAGTTAG | 4326 |
| | 4 | MAPNSVRPVSTLIHLFFFPERGSLCLPGWSAVV* | 4327 | ATGGCACCCAACTCTGTTAGGCCAGTAAGTACCCTTATTCATCTTTTTTTTTTTTCCAGAGAGGGGCTCACTCTGTCTCCCAGGCTGGAGTGCAGTGGTGTGA | 4328 |
| hsa-mir-148b | 1 | MLGGGGRGVWDQGIARPLLAGGPGHRGSDGGLDPLKHITHCSLCSSLGKDRI* | 4329 | ATGCTTGGGGGAGGTGGTATACACAGAGGCTCAGTTGGGACTAGATTTCTGAAGCATATAACTCATTGTTCCTTGTTCCAGTTGGGTAAGGATAGGATTTAA | 4330 |
| | 2 | MPFSRA* | 4331 | ATGCCCTTTAGCAGAGCCTAG | 4332 |
| | 3 | MDEG* | 4333 | ATGGATGAAGGCTGA | 4334 |
| | 4 | MKADR* | 4335 | ATGAAGGCTGATAGATAA | 4336 |
| hsa-mir-148b | 1 | MILJLGGA* | 4337 | ATGATCTTATCCTAGGCGGGGCCTAA | 4338 |
| | 2 | MGTYGQSAAAFLLRLHVGTSCGARWRR* | 4339 | ATGGGAACGTATGGCCAATCAGCGCGCCAATGTGAGGGGCTGA | 4340 |
| | 3 | MANQRRIRFFCGSTSAPAAGQDGCADFCGRSWRGSRIDAVVSTGAGSQGSARVGDGEREFRVILGD* | 4341 | ATGGCCAATCAGAGGCGGCTGATTTGGTAGGAGGGCTCCACGTGCGGCACCAGCTGCGGGGCAAGATGCTGTGTGTCCACAGGGCGCCGGGAGTCAGGGTTCAGCCCGAGTGGAGAACGGGGAAAGAGAGTTCCGGGTAATTCTTGGGACTGA | 4342 |
| | 4 | MEALILVGAGGAAEMLWCPQGPGVRVQPEWETGKESSG* | 4343 | ATGGAGGCGCTGATTTTGGTAGGAGCTGGAGHGGCAGCAGAGATGCTGTGGTGTCCACAGGGGCCGGGAGTCAGCCGGGTTCAGCGGGTCGGGGAGACGGGGAAAGAGAGTTCGGGTAA | 4344 |
| hsa-mir-148b | 1 | MELRARGWWLLCAAAALVACARGDPASKSRSCGEVRQIYGAKGFSLSDVPQAEISGE* | 4345 | ATGGAGCTCCGGGCGGGGTGGTGGCTGCTATGTGCGGCCGCAGCGGCCTGCGCCGAGCTACGGAGCCAGCGAGCGGCAGCGAGCCCGCCAGATCTACGGAGCCAAGGGGTTCAGCCTGTCGGAGATCTCGGGTGAGTGA | 4346 |
| | 2 | MCGRSAGRLRPRGPGQQEPELRRGPPDLRSQGLQPERRAPGGDLG* | 4347 | ATGTGTGGCCGGAGCGCTGGCCGCCTGCGCCCGCGGGAGCCCGGCCAGCAAGAGCCGGAGCTCCGGAGATCTCGGGAGATCCAGAGATCCAGATCTCAGCCTGCAGCCCGAGCGGACGTCCCCCAGGCGGGAGATCTGGGTAA | 4348 |
| hsa-mir-149 | 3 | MAPCAAAPLQPHGPRLQAPRRTPSPGSPFPRSVVLRPSPPPARRLLPCGADLAGLRARGAPPGPRLELGYFCPPLGPARLQAGSPSPGAGCRGAVGLGVAGLSGRR* | 4349 | ATGGCTCCCTGCGCTGCGGCTCCTGCGCCCCCAACCCCAGGGCCTCCAAGCCGCGCCCGACTCCCTCCCCAGGGTCTGCCGCGCTTCTTCCCGCCGGAGCTGGCGTGCTGATCTCGGGGGCCGCGCCGGCGGCCTCCCCGCCCCCCGACGCCCCCCCCGCAGCCGCCCGGGAGCTCCCAGGGCGGCTCCCCGCGCCTCCGGAGGCTCGGGGCTGCTCGGGGGCGTGGGGGCCGGCCGGCCGGCGTGCGGGGCCGGCCGGGGCTCGGGCGTCGGGGGGGCGCGTGTGGGCTCGGGCGCGTCGGGGCTGCGGGGGCGCCGGCTGA | 4350 |

Figure 1 (Continued)

| | | | | |
|---|---|---|---|---|
| | 4 | MGTQRRNAHGPGDSEQEGSVHLGEGGLWPCLAAGGG VVGGGSRALLDPCPSRRNRTHRQPLALGGSPDAPSLRFL* | 4351 | ATGGGGACTCAGCGCAGAAATGCCCATGTCCTGCGATTCTGAGCAAGAAGGATC CGTGCATCTGGGTGAGGGGTCTGGGTGCCATGCCTCTGACCCTTGCCGCGGGGGGCGAGTGG TGGGAGGAGGCAGTCCGGCCCTTGGTCGCGGGCTCTGAGGCCCTCTGGATCTCCCGATGCCCCAGCCTGAGGTTCTTGTAA AGACAGCCCCTTGCCTGCCCTTGGTGATCTCCCGATGCCCCAGCCTGAGGTTCTTGTAA |
| | 1 | MVAGGLRADGRGVGRGGKHDGVSLGAVDAVDEELRC RGRSTSQVGPRLPLAQTSGAQADRDWPGAQAS* | 4353 | ATGGTGGGGGGGGGCTTCGGGCAGACGCGCAGGGGTGTGGGGAGGGCAGGGAAGC ACGATGGGGTGAGTCGGAGCTGTGGGGATGCGGTCCAAGGCTGACGAGGAGGATGCCGT GGCCGGTCCACCTCGCAGGTGGGCCAAGGTGCTGCCCTCTGGCTCAGACGTCAGGAGC CCAGGGCGGAGCGGAGGACTGGCCAAGGGCGCAGGCTTCTTAG |
| hsa-mir-149 | 2 | MPLTRS* | 4355 | ATGCCGTTGACGAGGAGCTGA |
| | 3 | MPWPVHLAGGAKAASGSDVRSPGGQGLARGAGFLEDG AKVRKRSSAAWAVGGPQETPWVVCPVPHPRRLLDVP EDATATGAGWGPRADGPGAGAGFEKRVRAWGKPSQPS ASQEGPVAGCRAE* | 4357 | ATGCCGTGGCCGGTCCACCTCGCAGGTGGGCCAAGGCTGCCCTCTGGCTCAGACGTC AGGAGCCCAGCCGGACGGAGGACTGTCGCCAGGGCGCAGGCTTCTTAGAGGATGGGG CAAAGTGAGGAAAAGATCCTCGCAGTCGCACCCTCAGTGGGCTGTCCCCAGGAAACC CCTGGGTCGTTTGTCAGTCGACCTCACCCAGCGAGCTGGCTGGACGCTGCCGGAG GATGCCACAGCACCGGAGTCTGGTTGGGGTCGGAGCCAGAGATGGGCCAGGGGCTGG GCCAGGCTTCGAGAAGAGGGTTCGGGCTTGGGGAAAGCCTTCGCAGCCATCGGCCA GCCAGGCCCCGTTGCCGGGTGCAGAGCTGAGTAG |
| | 4 | MGQK* | 4359 | ATGGGGCAAAAGTGA |
| | 1 | MTAGILGHIALHSERPQPLAFPQEGACFAALQGDSAEPAS AISCPGQPVAPACAGPELRRRKPAGGLLPLTAVRPACS GPQGAASIQPARGSQAFARLASSLPGAPRPAPELWLRVF HPVLVRGGREGRGLLCWGSWNNAGRRAGWASWPGGAE GSAGEAEARGPVRGREGV* | 4361 | ATGACAGCTGGTTCTTGGGCACATTGCCTCTCTCATTCAGAAAAGGCCCCCAGCCCTTGCCA TTCTTCCAAGGAGGGGGCTGCTTCCAGGGGCAGGCCACTCCAGAGAGCTCCAGCCGAG TCTGCCCATCTCATGTCCAGAAAGCCACCAACGGAGGCCTCGATCCAGCCTCTCCAGCC CTCGCAGAGGGGCTCAGGGGCGCCGCCCTTTGACTGCCGTGCCGTCCAGCG TGCAGCGGGGCTCAGGGGCGCCGCTGCCCGCTCGATCCAGCGTGCCGCCGAGCCTGCGCT GCCCGCCTTGCCTGCAGCCTGCCGTGCTTGTCACTCCCGTGCTTGTCGAGGAGGGCGGTAGGGCGGGAGGGGACGGGGGCTGTGCTG CGGTCTTCACTCCCGTGCTTGTCGAGGAGGGCGGTGGCCGGGGCCGGGAGTTGCCGGGCGG GCTGAGGGGTCGGCGGGGAGGTGAGGGCCGGGGCGGCGGGGCGGGTGAGG |
| hsa-mir-149 | 2 | MSRTTTCGPCLRRAGAPQKEASGRPPAFDCRASSLQRA SGGRLDPACPRLPGLRPPCVQPAGGSQAGARALAPCLH SRACPRREGGTGAVLGQLEQRRSPGRLGELAGRG* | 4363 | ATGTCAGGAGGACCACAACCTGTGCCGGCCTGCCTGCGCGGCCGGAGCTCCGCAGAA GAAGCCAGCCAGGGCCGGAAGGCCTCGATCCAGCGTGTCCTCGTGCCTCAAGCTGCAGCGGG CCTCAGGGACCCGAGCCCGCCCGCTTTGACTGCCGAGCCCGCCTTGCCGCCTCGCCCGCCTT GGGTCGAGCCTGCCGCGGGGCTCCCGCCCGCCTCGCCGCCGCCCGCGCCTTGCCGCCTCGCTCTTC ACTCCCGTGCTTGTCGAGGAGGGCGGTGGCCGGGGGCCGGGGCGGCGGGGAGTTGGCTGGGGCTG GAACAACCAGGTGCGCCAGGTGCCGGCTGGGCGGCCGAGTTGGCCGGGCGGGCTGA |
| | 3 | MPLVSLSRLRGGWVGPREGGAQEEPAGDATHP PP* | 4365 | ATGCCTCTCGTCAGCCTCTCGCGTCTCCGGGGATGGGTGGGACCGCGGAGGAGGGCGGCTGGGGCG GGACCTGCGAGGGCACGAGCGGCACAGGAGAGCCGGGGCACGGGGACGCCACCCTCCTCCTAG |
| | 4 | MCPADLCSPGLGSLDGCTGPHHSPHPRRDAS* | 4367 | ATGTGCCCTGCCGACTGCAGCCCGACCTGGGGCTGTCGGCAGCCTGGATGGGTGCACGGGGCCCCTGA |
| hsa-mir-149 | 1 | MALSPNPCTSAGLRPWYRPGGQQPGDPGTGRPQGVR* | 4369 | ATGGCCCTGTCTCCAAACCCTTGTACCAGTGCTGGCTCAGACCCTGGTACAGGCCT GGGGACAGGACCCTGGGACAGCCCCAAGGGTGAGGTGA |

Figure 1 (Continued)

| | | | | | |
|---|---|---|---|---|---|
| hsa-mir-150 | 2 | MRLSPSGPTYPLVRSCLIAPTPCLSSPPLCDAQSTPVSIV PASRGGLCSPQLCKTPPHVPQPWATVCPVLFLSRPPSL RPVCIGFSPDASCPLPSQQPGPRYH* | 4371 | ATGCGTCTCTCCCTTCGGGTCCCCACATATCTCTGGTGCGTCCTGCCTCACCGCC CCACCCCATGCCTCTGTCCCCACTCTGTCGTGATGCAAGTACACCTGTTTCTAT TGTACCTGCCACAACCCTGGGCACCGTGGTCTGTGTCCTCCCCAGCTGTCCTCCC CATGTGCCACAACCCTGGGCACCGTGGCTCGTGCCTGTCCGTTCCTCTCAAGGCCCCA TCTCTGCGCCTGTGTATTGGCCGTCTCCGGACGCTTCCTGCCCACTTCCTTCCC AGCAGCCTGGCCCCGGTACCACTGA | 4372 |
| | 3 | MPVVPTSV* | 4373 | ATGCCTGTCGTCCCCACCTCTGTGTGA | 4374 |
| | 4 | MRKVHLFLLYLPLAVVCCALPSSAKPLLPMCHNPGPPCV LSCSSQGPHLCGLCVLGRLRTLPAHFLPSSLGPGTTEQA PGEPHDATCPHRQFPYCDFEAAGAEEVSRI* | 4375 | ATGCGCAAAGTACACCTGTTTCTATTGTACCTGCCTCTCCGGGTGGTCTGTGCTCTCC CCAGCTGTCGAAAACCCTCCTCCAGGCCTGCACAACCCTGGCCACCGTGTCC TGTCCTGTTCTCAAGGCCCCATTCTGCCGGCTGTGTATTGGCCGTCTCCG GACGCTTCCTGCCACTCTCCAGCAGCTGGGCCGTACCACTGAACAGGC TCCAGGGAGCCTCATGATGCCACTCGCCACCACCACCAATTCCTTACTGCGATTT TGAGGCAGCTGGCGCAGAGGAAGTTTCTAGAATCTGA | 4376 |
| hsa-mir-151 | 1 | MRRRPAPPAPPARVLGGGEAGGREEVGGPRGGREA* | 4377 | ATGCGGCGGGAGACCGGCCCCTCGCCGCCCGGCCCTGGGTTCGGGAGGAGGGGA GGCCGGTGGCCGTGAGGAGGTTGGGGGCCCTGCGGAGGCCGAGAGGCTTAA | 4378 |
| | 2 | MPEKQKCRGRRRKREIAGTSAGFARTREGGSRRPDLRP PGAASRAAKGGLRAALCRCPSPKPAVSPNANPQVW* | 4379 | ATGCCTGAAAAACAAAAGGGAGAGGCAGGAGGAGGAGGAAATCGCAGGGA CGTCGGCAGGGTTCGCCGACTTCCGT CCCCGGGCGGCCGTGCGGCCTGCGAGGAGGCAGCCAGGCGCCCGACCTCCGT CCGAGCCCCAAGCCGCCGTGTCCCGAACGCAAACCCTCAAGTTTGGTAG | 4380 |
| | 3 | MRLR* | 4381 | ATGAGACTAAGATAA | 4382 |
| | 4 | MGTGYTFKLKAEGSARVWGFVFKT* | 4383 | ATGGGAACTGGTTATACATTCAAGCTGAAGGCAGTGCAAGAGTTTGGGG ATTTGTATTTAAGACTTAA | 4384 |
| | 1 | MQRPEAGHVRTRGRGPRRQAGGRRRLLEPGSPRGCGY GAGGRGDPGRRELGRDRAGLGGAANSELARPAAGNPV SPLTGPRTREEKFVPAPTGEEACPESVGAGLKFWVRLE WGWRVSCDSAGRVRSGLSVPDSAPITGG* | 4385 | ATGCAGCGGCCGGAGGCTGGGCACGTCCGCACCCGCGGCCGGGGACCCCGCGGCGGCA GGCGGCCGGGGGAGGCGGCGGCGCCCTGCTCGAGCCGGGAGCCCCTGGCTGCCGGGTACG GAGCGGGCGGGGAGGCGGGGATCCAGCAGCTCAGCAGACTCGCGCCCGGCGCGGGAGCTGCGACAGAGCAGG GTTAGGGGGAGCAGCAGCCCAACTCAGAAACTCGCGCCCGGCGCTGGGAACTTGT CACCCGGACTGGGCGTGTCTGAGTCGTCTGGGCGGGGGGAAAAGTTCGTCCAGCGCCGACCGGA GAGGGGCCGTGTCTGAGTCCAGGCGGCTGGGGGCCTGAAGTTCTGGGTCCGTTTGAA TGGGGGGTGCGGTGGTGAGTTGCCATTCGCGGGAGGGGTAAGGAGTGGCTTGCGCCGTGCCG TCCCAGACTCGGCTCCATCACGGTGGTGA | 4386 |
| hsa-mir-152 | 2 | MGMLLESTRARAWGRADSAGPARPGISWKKEARPAVP PGFGSVIHSDSGSGAVSA* | 4387 | ATGGGCATGCTTCTGGAGTCTACCCGGCAGGCCTGGGGCCGCGCTGATAGCGC AGGTCCAGCCCGGCCAGGGATCAGCTGGAAGAAGGCTCGGCCCGTGTCCCC CCGGCCCAGGTCTGTGATACACTCCGGGCTCTGGAGCAGTCAGTGCATGA | 4388 |
| | 3 | MTELGPGRTFCTQRAQRPLGACSGTSAWEWSGHLGWP MWHRAGQNQLWTLRTGVAGA* | 4389 | ATGACAGAACTTGGGCCCGGAAGGACCTTCTGCACCCAACGGGCACAGCGCCACT CGGGCCCTGCAGTGGAACATCTGCTGGAGTGGAGTGGCACTTGGGTTGGCCCA TGTGGCACAGGGCTGGGCAGAACCAGCTGTGGGACCTTGAGGACTGTGCTGGGG GCCTGA | 4390 |
| | 4 | MYPRASRSHRHRVSTSSQGPNGTLLSGVSCRNLPSTPSR LPSS* | 4391 | ATGTATCCTAGGGCCAGCAGATCCATAGACACAGGGTGTCCACCTCGAGTCAGGG GCCAAACGGGAACTCTCCTCCTGGGTGTCAGTTGCAGGAACCTTCCCTCTACACCATC AAGGCTGTTTTCATCCTAG | 4392 |

Figure 1 (Continued)

| | | | | |
|---|---|---|---|---|
| hsa-mir-153-1 | 1 | MGGGGAGVRPPLGLEFRVGPGASASDFWPPAPDPTLPPLKAGLRLRLCPSPSLHHPRGPAPRRPLLLCSLPLTLPGLAPSPPPASSRGPSAFCLPFSLSRTPASPLLPVPSCPAVSRPCTALPCCPLRLSLPPFARLPSFIPLRFSFIPLRLFASFFCVFHSFSFPLSSSSLSPSLSHSVSASPFFSLSISPSPRFSSFLSALSPVFLHLLPLSASFSLLLCPSLPLPPAACLSSLCPSLSLLPSFSLSLTAASVIFVICS* | 4393 | ATGGGCGGGGGCGGAGCCGGAGCCCTGGAGCCCGGGTCGGGCCTGGAGCCTCCGGCCTGACTTCCGGCCGCCGCTGGCCTGGAGCCCCGGCTGTGG... (sequence) | 4394 |
| | 2 | MDRQDMWPGDHPELGARGTGKRQRLSKGVVWEDLWILGGSVEQVGTRQGLPEGLTLPQH* | 4395 | ATGGATAGACAGGACATGTGGCCCGGGGACCACCCGAGCTGGGAGCAAGGGTAC... (sequence) | 4396 |
| | 3 | MSLGTGQRSRAGGGDMGHVSEPQDSSF* | 4397 | ATGTCTCTAGGTACTGGACAGAGGAGCAGAGCTGGGGTGGGGACATGGGTATAGTTTCTGAACCTCAGGACAGCAGTTTCTAA | 4398 |
| | 4 | MDLF* | 4399 | ATGGATCTGTTTTAA | 4400 |
| hsa-mir-153-1 | 1 | MRRPRRPGGLGGSGGLRLLLCLLLSSRPGGCSAVSAHGQEETWAGGWWGAGSSLGPJAKLGGGEGEMS* | 4401 | ATGCGGGGCCCGCGCGGCCTGGGGCTCCGGGGATCCGGGGGTCTCCGGCTGCT... (sequence) | 4402 |
| | 2 | MKLGENMGWGRHAR* | 4403 | ATGAAGCTCGGGGAGAATATTGGTTGGGAGGCATCGAGATGA | 4404 |
| | 3 | MRDEEGERASRRKGA* | 4405 | ATGCGAGATTAGGAAGGTGAGAGGCGTTCGGAGGAAAGGGCGTAG | 4406 |
| | 4 | MRKVRGRLGGKGRRPGGGAGNTGAGPKRIGLWGKLQVREKDTGCMWAEGLRDRLRDHRRSHLLRGAWEVVTGAEEWEGEVAGRMRER* | 4407 | ATGAGGAAGGTGAGAGGGTCTCGAGGAATACGGGGGGGACTCTAAGAGAATTGGGCTCTGGGGAAAATTGCAGTT... (sequence) | 4408 |
| hsa-mir-153-1 | 1 | MSTPVSVPSLRSSLPGEPGLRAHLV* | 4409 | ATGTCCACACTGTCTCTGTCCTCTGTCCTCCAGGTGAACCTGGTC | 4410 |
| | 2 | MTEESLPPQGPSWTSAGMTRGPPAGQCALSARHRGARLRCS* | 4411 | ATGACCGAGGAGTCCCTCCCTCCTCAAGGTCCCTCCTGGACTTCCGCAGGTATGACGCTCGGTGCTCTGA | 4412 |
| hsa-mir-153-2 | 3 | MCHRILMHKARMPSWILIWLHGMKEVASAGPDTTLRDLLAGKPGDT* | 4413 | ATGTGCCACAGGATATTGATGCATAAAGCTCGAATGCCAGTTCAGTTGGATTCATCTGG... (sequence) | 4414 |
| | 4 | MLDSVLQEEIDNEKKAAFKTTALYVNSRSALARWWCLVNKPPQGK* | 4415 | ATGCTAGACTCTGTCTTACGAGGAAGAAATTGACAATGAAAAAGCAGCATTAA... (sequence) | 4416 |

Figure 1 (Continued)

| | | | | |
|---|---|---|---|---|
| hsa-mir-153-2 | 1 | MGPPLPLLLLLLLPPRVLPAAPSSVPRGRQLPGRLGE WGAPGEGRLNELVGGVVRGAPP* | 4417 | ATGGGGCCGCCGCTCCCGCTGCTGCTGCTACTGCTGCTGCTGCTCCGCCACGCGTC CTGCCTGCCGCGCCCTTCGTCCGTCCCGCGGTGCCGGCAGTCCCGGGGTCTGGGT GAGTGGGGGAGGGGGGGAGGGGCGCCTCAATGAATTAGTTGGGGGGGTTGTGAG AGGGGCGCCTCCGTGA | 4418 |
| | 2 | MQGRRLNK* | 4419 | ATGCAGGGAAGGCGCCTCAATAAATGA | 4420 |
| | 3 | MSEGVGEGAPLRGSGGGTPQ* | 4421 | ATGAGTGGGGGCGTTGGGGAGGGGCGTTCTGGGGAGGGACGC CTCAATGA | 4422 |
| | 4 | MNERGAWGEGRLNECGAWGKGRLNE* | 4423 | ATGAATGAGAGGGGGCGTGGGGAGGGCCGCCTCTGAGAGGTTCGGGGAGGGGCGTGGG GAAAGGGCGCCTCAATGAATGA | 4424 |
| hsa-mir-154 | 1 | MDQGVEGCGCGPGVGRQSACSL* | 4425 | ATGGACCAGGGGGTAGAGGGGAGGTGGGTGTGGACCTGGGGCTCGGGGCCCAGTCAG CTTTGCAGCCTATGA | 4426 |
| | 2 | MKDGKEGYRDRGRVGLRIARAAWHTVLG* | 4427 | ATGAAGGACGGAAAGGAGGGCTACAGAGATAGGGGAAGAGTGGGCGCTGAGGATAG CCAGAGCGGCTTGGCACACAGTTTAGGGTAA | 4428 |
| | 3 | MTEPVTPGSSFKACLMGDSVVPVTKLGPESQGRAHQV AALP* | 4429 | ATGACTGAGCCGGTCACTCCAGGGTCTTCCTTCAAAGCGTGTCTAATGCGAGACAGCC GTTGTCCCAGTAACCAAATTGGGACCAGAGTCCCAGGGAAGGGCTCATCAGGTGGC CGCTCTGCCTTGA | 4430 |
| | 4 | MILFPLDPAPLVPFSL* | 4431 | ATGATTCTCTTCCCTCCTCGGATCCAGCCTCTTAGTTCCTTTTCACTTTGA | 4432 |
| hsa-mir-155 | 1 | MSHK* | 4433 | ATGAGTCACAAGTGA | 4434 |
| | 2 | MDSRGRQREGGVFET* | 4435 | ATGGATTCCCGGGGACAGAGGCAGGGGAAGGAGGGGTGTTCGAAACCTAA | 4436 |
| | 3 | MVGDVPV* | 4437 | ATGGTTGGGGACGTACCTGTATAA | 4438 |
| | 4 | MALDQLPCWSGQRSV* | 4439 | ATGGCCCTGGACCAGTTCCCTGTTGGAGTGGCAGAGAAGTGTGTAA | 4440 |
| hsa-mir-155 | 1 | MKYKSEKKKTVLCQNASFPLCILAFENSEERFLFI* | 4441 | ATGAAGTACAAATCAGAAAAGAAAACTGTACTGTGTCAGAATGCAAGCTTTCCT CTTTGCATTTGAATTCCGAAGAGCGTTTTTGTTTATTAA | 4442 |
| | 2 | MQAFLFAFWHLKTPKSGFCFLFKEDDTYVYPIQN* | 4443 | ATGCAAGCTTTCTTTTGCATTTGGCATTTGAAACTCCGAAGAGCGGTTTTTGTT TTTATTTAAAGAAGATGATACATATGTACCGATTCAAAACTAGAGAATAG | 4444 |
| | 3 | MHHMCTRFKTRE* | 4445 | ATGATACATATGTGTACCGATCAACAATGTCATCTTTAA | 4446 |
| | 4 | MPKGNNVIF* | 4447 | ATGCCTAAAGGTAACAATGTCATCTTTAA | 4448 |
| hsa-mir-15a | 1 | MRSLSAFGAIFE* | 4449 | ATGAGGAGCTCAGCGTTTCGGCGCCATTTCGAGTGA | 4450 |
| | 2 | MPDLINLAGETG* | 4451 | ATGCCTGATCTCATCAATCTAGCGGGAGAGACAGGATAA | 4452 |
| | 3 | MTPPEKLL* | 4453 | ATGACTCCGCCGGAAAAATTACTTTAA | 4454 |
| | 4 | MWREGRCETGLWGEGCSLSGTRTGCCGEAAAQRICQQ DPPPGTGACDGALRGLCRRPLLDRRTGRAPLPHFRTGPP FLAVFSTR* | 4455 | ATGTGGCGGGAGCGGTGCGAGACGGGACTGTGGGAGGGAGGGAGTGCAGTTGA GGGGGAGAGCGGCCCGCCGGGACGGGAGACGCCCGCCGGGGATCTGTCAGCAA GACCCCCCCCCCGGACAGGGACCGCCGGGCGCGGAGGCCCTGAGCGCCTCCAGGCG GCGGTCCTTGACAGGAGGACGGCCGCTGAACCCGGCGGGCCCCATTTCCGAACCGGGCC GCTTTTCTGCGCCGTTTTCTGACCCGGTGA | 4456 |
| hsa-mir-15a | 1 | MLTQSINSGTKGPTSSELC* | 4457 | ATGTTGACGCAATCTATAAATAGTGGAACAAAAGGACCAACTTCCTCGGAGCTTTGC TGA | 4458 |
| | 2 | MGRGALRRGRGRABRRGPRRAGGTPG* | 4459 | ATGGGCCGGGGCGCTGCGCCGGGAGGGCGGCGGCGGAGGGCGGGCGCCGCGCCC GCCGAGGGGGACACCTGGTGA | 4460 |
| | 3 | MAGACAAAKIDGILACATRAVGRAEARAALLGSRRGSR LLLSPVGRPPEATRQGPEAAACASLPPSSDPAPQLRPLT AVGGWSREALSLHAAVPPGSGAHAASKH* | 4461 | ATGGCCGGTGCCTGCCAGCCAAAGATCGACGGCCTCGCCTGCACCCGAGCCGTGGGCCGGGCC GGTAGGAGGAGGCGGAGGCGCGGAGGCCGCGGCCGCCCTGCTGGGTCGACGCTACGCCGGAGGGCTCCGG CTGCTTCTCTCGCCCGTGGGCCGCCCTCCTGAGACTCGGACCGGGAGCTCCGGAGCTTCGTCGTCCTCTA ACTGCTGTGGGAGGATGAGCAGAGAAGCGCTGTCGCTGCACCGCCAGTTCGTCGTCCTCTA TGGCTCTGGTGCCCACGCAGCCAAGCACTGA | 4462 |

Figure 1 (Continued)

| | | | | | |
|---|---|---|---|---|---|
| | 4 | MRLAPSELGPGASASSSNCCGRMEQRSAVAARRRAPW LWCPRSQQALSWGAGWNRGTLASRSLGPERERPPRRR GGSTGRGEGAELALLTAVPERGGRKLGRGGGEVGVG AGGESARAGFGGERGAGSCDVQTPPLQAGCRGDVTTL DCRGWHFRSLPSCSPAPGTAGWSPFAV* | 4463 | ATGGCGCTCGCTCCTCCCGAGCTCGGACCCGGGCGCTCAGCTTCGTCCTCTAACTGC TGTGGGAGGATGGAGCAGCAGAGAAGCCGTGTCGCTGAGCTGGCGGGGCCGGGGCA CTGGTGCCCACCGCCAGCCAGCAAGCACTGAGCTGCGGAGCCAGGTGGAACCGGGGCA CGCTGCTTCTCGGAGCCTCGGACCTGAGCGCGAGCTCGGGAGCTGGGAGCTGCCGTGC GGTTCCACAGGCGCAAAGTTGGGAGGGCGGCGGAGCCGGAGCGGAGCGGAGGAGCGGG TGGGGAGGGCGAGAGAGCGCGCGACTTCGGCCGGGGAGGGTGCAGGGTGCACCCTTGACT ATGTACAGACACACCCCGCTACAGCTGGCTGCAGGGTGCAGGGGTGACGTCACCCTTGACT GCAGGGGTGCACTTCGCTCCCCAGCCGTGCTCCCAGCTGCTCCCAGCCCTGGCACCGCCG GCTGGAGCCCTTTCGCAGTTTGA | 4464 |
| | 1 | MAVHAALFFKLVDPRNHCAHL* | 4465 | ATGGCGGTGATAATCGCCGCACTTTTTCAAATTAGTCGATCCCAGAAATCATTGC GCGCATTTGTAA | 4466 |
| hsa-mir-15b | 2 | MSRGGPEPRRSFL* | 4467 | ATGTCTCGGGGAGGCCTCGAGCCTCGCAGATCTTTCTTTAA | 4468 |
| | 3 | MYYCPTGLRLGSWRDKLLPLQN* | 4469 | ATGTTTACTGTCAACGGACTCGCGCTGGGGAGTCGAGAGACAAACTCTTGCCA CTCAAAATTAG | 4470 |
| | 4 | MPRAYNGARS* | 4471 | ATGCCCCGGGCGTCAACGGCGCCAGGAGCTAA | 4472 |
| | 1 | MRSLSAFGAIFE* | 4473 | ATGAGGAGCCTCAGTGCTTTCGGCGCCATTTGAGTGA | 4474 |
| | 2 | MPDLINLAGETG* | 4475 | ATGCCTGATCTCATCAATCTAGCGGGAGAGACAGGATAA | 4476 |
| | 3 | MTPPEKLL* | 4477 | ATGACTCCGCCGGAAAATTACTTTAA | 4478 |
| hsa-mir-16-1 | 4 | MWRERGETGLWGEGSCSLSGTRTGCGGAAAAQRICQQ DPPRGTGAGDGALRGLCRRPLLDRRTGRAPLPHERTGPP FLAVFSTR* | 4479 | ATGTGGCGGGAGCGCGGAGAGACGGGCTGTGGGGGGAGGGAGCTGCAGTTGA GCGGGACGCGGACCGGTGCGGTCGGAGCAGCCGCCGCCAGCGGATCGTCAGCAA GACCCCCGCCGGACCGGAGCCGGGACACGGCACTGCGGGGTCTCTGCAGGCG CTGCTCCGTTGACAGGAGGATGGAGCAGAGACAGGATAACCGGGCCTCCCCCATTCCGAACCGGGCC GCCTTTTCTGCGGTTTTCTGACCCGGTGA | 4480 |
| | 1 | MLTQSINSGGTKGPTSSELC* | 4481 | ATGTTGACGCAAATCTATAAATAGTGGAACAAAAGGACCAACTTCCTCGGAGCTTTGC TGA | 4482 |
| | 2 | MGRGALRRGRGRARRGPRRGGTPG* | 4483 | ATGGGGCGGGGAGCGCTGCGCGGAGCGCTGCGCGGGGGAGGGGCGGGCGCGCGCGGGGCCC GCCGAGGGGGGACACCTGGCTGA | 4484 |
| hsa-mir-16-1 | 3 | MAGACAAAKIDGGLACATRAVGRAEARAALLGSRRGSR LLLSPVGRPPEATRIQGPEAAACASLPPSSDPAPQLRPLT AVGGWSREALSLHAAVPPGSGAHAASKH* | 4485 | ATGGCGGGTGTTGCCTTCGCGCACAGCAGCAAAGACGGAGGACTGGCGTGCACCGGC GTAGGAGAGCGGAGCCGCGACCGCCTGCTGGGAGGCTACGCGCTCAGGCCCGAGGCC CTGCTTCTCTCGCCCGTGGGCCGCCTCGCTCCTCCGAGCTCGGCGCCTCAGCTTCGTCCTCTA ACTGCTGTGGGGAGGATGGAGCAGAGAAGCAGAGAAGCAGAGCCGTGCTGCTGACGCCAAGCACTGA TGGCCTCTGGTGCCCACGCAGCCAGCAAGCACTGA | 4486 |
| | 4 | MRLAPSELGPGASASSSNCCGRMEQRSAVAARRRAPW LWCPRSQQALSWGAGWNRGTLASRSLGPERERPPRRR GGSTGRGEGAELALLTAVPERGGRKLGRGGGEVGVG AGGESARAGFGGERGAGSCDVQTPPLQAGCRGDVTTL DCRGWHFRSLPSCSPAPGTAGWSPFAV* | 4487 | ATGCGCCTCGCTCCTCCCGAGCTCGGACCCGGGCGCTCAGCTTCGTCCTCTAACTGC TGTGGGAGGATGGAGCAGCAGAGAAGCCGTGTCGCTGCAGCGCTGGCGGGGCCGGGGCT CTGGTGCCCAGGCCAGCCAGCAAGCACTGAGCTGGGAGCCAGGTGGAACCGGGGGCAGCA CGCTGCTTCTCGGAGCCTCGGACCTGAGCGCGAGCTGGCGCTGACGCCAAGCACCGGGCT GGTTCCACAGGCGCGAAAGTTGGGAGGGCGGCGGAGCCGGAGCGTGGGAGCTGCCGGA GGGGGAGAGGAGCGCGCCGACTTCGGCGGGAGGCTGCAGCGCGAGGAGCGGCCCGGCGG AGGTACGACAGACACCCCGCTACAGCTGGCTGCAGGGGTGACGTCACCCTTGACTGCTG TGGCAGGGGTGCACTTCCGCTCCTCCCAGCCGTGCTCCCAGCTGCTCCCAGCCCTGTGCCGG GCTGGAGCCCTTTCGCAGTTTGA | 4488 |
| | 1 | MAVHAALFFKLVDPRNHCAHL* | 4489 | ATGGCGGTGATAATCGCCGCACTTTTTTCAAATTAGTGGATCCCAGAAATCATTGTAA | 4490 |

Figure 1 (Continued)

| | | | | |
|---|---|---|---|---|
| hsa-mir-16-2 | 2 | MSRGGPEPRRSFL* | 4491 | ATGTCTCGGGAGGCCCTGAGCCTGGAGATCTTTCTTTAA | 4492 |
| | 3 | MVYCPTGLRLGSWRDKLLPLQN* | 4493 | ATGGTTTACTGCCAACGGGACTCCGCTGGGGAGCTGGAGAGACAAACTCTTGCA CTCCAAAATTAG | 4494 |
| | 4 | MPRAVNGARS* | 4495 | ATGCCCCGGGCCGTCAACGGTGCCAGGAGCTAA | 4496 |
| hsa-mir-17 | 1 | MVAATPPGESARPSGDGGKPVVCGPGLAGGAERPGAD WPGAAWRRRGRGGSRPLAAPACGSRIWLPPRSPAGRR RGIAGPGREGGRGRRARGGRARDPFRRPCLGRPEGGWAD GEHNGPSCRGRGRARPVPSPGPARAGRGIVSG* | 4497 | ATGGTGGCGGCTACTCCTCCTGGTGAGTCGCCGCCCCTCCGGCGACGGAGGGAA ACCTGTTGTGTGCGGCCCCGGGTCTGGCGGCGGAGCGGCCTGGGGCCGGACT GCCCCGGCGTGTGCCAGCGCCATCTGGCTGCCCCTCGCTGCCCTGCCATTGGCC GAGGGGGCGCAGAGCCGGGGCGGCGGACCCCTGCCTGGGGGAGAGGACGTGCGGCC GCGCCCCGGGACCTGCCGCCAGAACCCTTCCGGCGAGAGAGGACGTGCGAGCGCGGGA GGHNGCGCTGCCGGGCTGTGGGGTCTGGGTAG | 4498 |
| | 2 | MAPRGEDVRGPCLLRGPGRARGVGSLGRKVSPEGES* | 4499 | ATGGCCCCTCGCGGAGAGGACGTGCGAGGGCCCGTGCCTTCTCGGGGCCCGGGGCG CCGCGGGCGTGGGTCTGGGTAGGAAAGTTCTCCGAGGGCGAGAGTTAA | 4500 |
| | 3 | MGPAAGREGARPRGTCAPAGGVAWAGARGSPNFVRA RVGGGAPRSARPGRHPRSAWALLARVGSLGAGPATSPP WPSEEAAVGLSRGVEPPAPGRLLGVWRGRASPARRERR PRRHVPAGRAARG* | 4501 | ATGGGCCCAGCGGCCGGCCGTGCGAGGGGAGCCGCAGCGGTCCGATCGGCCGAGG GTGGGGGCAGGGGCCGGAGACGGAGGGCTGGGCCGATCGGGCTCAGCCGCCTCCCGCGTG GGCTTTGTTAGCGCCGGAGCTGGGGCAGTCGGCGTCAGCGAGGCCAGCGCGTCGGCCGTG GCCGCTTGCTGGAGGAGGCGTCAGCGTCAGCCAGCCAGCCTCGGCGGAGGCGCGT CCCGGCGCCATGTGCCTGGGCCGCCGCCGGCCGCTGACGGGGTGA | 4502 |
| | 4 | MPLRGGLHGGEGGGHGGDCAPPPIVPGLGLGPRATGTA AAEPPLWAGLGGAGGHKGGAARPRPRTRASAPPVA ARLPPGNGLGGLPRPAGPDSDPPPPGGYAENRRAALPL VRHVLPARAP* | 4503 | ATGTTCCTGCGGGGCGGGCTGCACGGCGGGGAGGGCGGGGACATGGCGGCGACTG CGCTCCGCGCCGAGCCCCCGATGTTCCGGCTTAGGCCTTGGGCCGGAGGGAGGACACCG GGAGGGCGCGGTCGCTCCGCGGCCCTCTGGGCCGCCACTCGGGGCTCGGCGGCCTCGC GGAGGGGCGGTTGCGGCGAAACGTGTTGGGCGGCGTGGGGGCCTCGAGGCCGCGT ACTCTGACGCACATGTGCCTGGGCCGCCATCGGAACATCGCAGGGCCGCTGACGCCTG TGTGCGACATGTGCCTGGGCCGCCGGGCTCCATGA | 4504 |
| | 1 | MSLSVKTKKKLDTGTQARRGIEPRQISLQPCLLSSH* | 4505 | ATGAGTTGCAGTTAAACAAAAAAATTAGATACTGAACCGAGGTAGACG AGGTATTGAACCCGCAGATCCTTGCAGCCCTCTCGTCTCAGCTCGCATTGA | 4506 |
| hsa-mir-181a-1 | 2 | MTQMMDRSTFSHVHTGRKRICWSLAVQGFVF* | 4507 | ATGACCCAGATGATGGACAGAAGCACATTTAGTCATGTGCACACTGGAAGAAGCG GATTTGCTGGTCCCTGGAAGAAAGCGGATTTGCTGGTCCCTGGCAGTGCAGGGGTTTGTCT TCTGA | 4508 |
| | 3 | MCTLEESGFAGPWQCRGLSSDWAVF* | 4509 | ATGTGCACACTGGAAGAAAGCGGATTTGCTGGTCCCTGGCAGTGCAGGGGTTTGTCT TCTGATTGGGCTGTGCCCTGA | 4510 |
| | 4 | MKIG* | 4511 | ATGAAAATTGGATAG | 4512 |
| hsa-mir-181a-2 | 1 | MPIRK VESAS* | 4513 | ATGCCGAGGAAGGAAGGTAGAAAGTGCTTCATAA | 4514 |
| | 2 | MCGRMFTVGFYSDRIS* | 4515 | ATGTGTGGAAGAATGACTGTAGGATTTTACAGTGACAGAATTAGTTAA | 4516 |
| | 3 | MPVFFSPFS* | 4517 | ATGTTTTTTGTTATTTTTCCCCTTCAGTTAA | 4518 |
| | 4 | MTHFQILFLHLQRLYCSSKLN* | 4519 | ATGACGCATTTTCAATTTTATTTTACATTACAGAGACTTTATTGTAGTTCTAAAC TAATAAACTAA | 4520 |
| hsa-mir-181b-1 | 1 | MSLWPHG* | 4521 | ATGTCTCTTTGTGGCCAATAGGATAG | 4522 |
| | 2 | MTHCFPCLSHGL* | 4523 | ATGACTCACTGCCCTGTCTTTCACATGGCTGTAA | 4524 |
| | 3 | MGCNLVQFRTADSTASTGARDV* | 4525 | ATGGGCTGTAATTTAGTTCAATTCAGAACTGCAGATAGTACAGCTTCCACAGGAGCA AGGGATGTCTGA | 4526 |
| | 4 | MSEHKWLSSE* | 4527 | ATGTCTGAGCACAAGTGGCTGAGTTCCGAGTGA | 4528 |

Figure 1 (Continued)

| | | | | | |
|---|---|---|---|---|---|
| hsa-mir-181b-2 | 1 | MTKCASVHHLGH* | 4529 | ATGACTAAATGTGCTTCTGTCCATCATCTGGGTCATATATAG | 4530 |
| | 2 | MCFCPSSGSYIVQCELSRQGCKEIWRGSIPRLAWVPVSN FFFVLTDKLISLLGQDAVLAGSSISTARHLSGNTEVVL* | 4531 | ATGTGCTTCTGTCCATCATCTGGGTCATATATAGTTCAATGCGAGCTGAGCAGACAG GGCTGCAAGGAAATCTGGCCGCGGTTCAATAACCTCGTCTAGCCTGGTTCCAGTATCT AATTTTTTTGTTTGATACCAAACTCCATTTCTACTGGACAAGGATGCTGTGC TGGCTGGAAGTTCCATTTCTACAGCAAGAATCTACTCTGGAAACACAGAAGTGTCC TCTAG | 4532 |
| | 3 | MRAEQTGLQGNLARFNTSSSLGSSI* | 4533 | ATGCGAGCTGAGCAGACAGGGCTGAAGTTCCATTCTACAGCAAGAATCTGGCGCGGTTCAATACCTCGTC TAGCCTGGGTTCCAGTATCTAA | 4534 |
| | 4 | MLCWLEVPPLQQESYLETQKLSSSHSSSNFFDCRCCFLP SPPSPFDKDPTVKSLT* | 4535 | ATGTGTCTGGCTGGAAGTTCCATTTCTACAGCAAGAATCCTATCGCAAGAACACAG AAGTTGTCCTCTAGCCACAGCAGCTCGAACTTTTTGATTGTCGTTGCTTTCTCC CATCACCCCCATCCCCTTTGACAAAGATCCAACTGTAAAAAGTCTTACGTAA | 4536 |
| hsa-mir-181c | 1 | MPVIPALWEAQELETNLANIVKPCLYSKYKN* | 4537 | ATGCCTGTAATCCCAGCACTTGGGAGGCCGAGGAGTTGGAGACCAACCTGGCCAA CATAGTGAAACCCTGTCTCTACTCAAAATACAAAATTAG | 4538 |
| | 2 | MGVSLCFPG* | 4539 | ATGGGGTCTCACTGTGTTTTCCAGGCTAG | 4540 |
| | 3 | MGISCSQRDECSVIISNVHNTCAPNSLSFPSPRRSPP* | 4541 | ATGGGTATATCCTGCTCACAGCGTGATGAATGTAGCGTTATCATCAGTAATGTAATT ATTAACACCTGTGCTCCCAACTCACTCTCCTTCCCAAGTCCTAGGCGTTCTCCTCCTT AG | 4542 |
| | 4 | MNVALSSVM* | 4543 | ATGAATGTAGCGTTATCATCAGTAATGTAA | 4544 |
| hsa-mir-181d | 1 | MPVIPALWEAQELETNLANIVKPCLYSKYKN* | 4545 | ATGCCTGTAATCCCAGCACTTGGGAGGCCCAGGAGTTGGAGACCAACCTGCCAA CATAGTGAAACCCTGTCTCTACTCAAAATACAAAATTAG | 4546 |
| | 2 | MGVSLCFPG* | 4547 | ATGGGGTCTCACTGTGTTTTCCAGGCTAG | 4548 |
| | 3 | MGISCSQRDECSVIISNVIRNTCAPNSLSFPSPRRSPP* | 4549 | ATGGGTATATCCTGCTCACAGCGTGATGAATGTAGCGTTATCATCAGTAATGTAATT ATTAACACCTGTGCTCCCAACTCACTCTCCTTCCCAAGTCCTAGGCGTTCCTCCCTT AG | 4550 |
| | 4 | MNVALSSVM* | 4551 | ATGAATGTAGCGTTATCATCAGTAATGTAA | 4552 |
| hsa-mir-182 | 1 | MCIFFHPRGASHSAHFANGKLRLREVK* | 4553 | ATGTGCATTTTCTTCCATCCCCAGAGGTGCGAGTCATTTCTGCCCATTTTGCAAATGGG AAACTGAGGCTTAGAGAGGTGAAGTGA | 4554 |
| | 2 | MPWGQG* | 4555 | ATGCCATGGGGCCAGGGTTAG | 4556 |
| | 3 | MGPGLAGEPHHSERGQWQNHGRISGSA* | 4557 | ATGGGGCCAGGGTTAGCAGGAGAAGAACCTCACCATTCGGAGAGGCGCAATGGCAGAA CCAACGGCCGCATCAGTGGGGTCTGCGTGA | 4558 |
| | 4 | MAEPRPHQWCVRGLYPGHLSP* | 4559 | ATGGCAGAACCACGGCCGCATCAGTGGGTCTGCGTGAGGGGCTTGTATCCGGGCA CCTTTCCCCCTAG | 4560 |
| hsa-mir-183 | 1 | MCIFFHPRGASHSAHFANGKLRLREVK* | 4561 | ATGTGCATTTTCTTCATCCCAGAGGTGCGAGTCATTCTGCCCATTTTGCAAATGGG AAACTGAGGCTTAGAGAGGTGAAGTGA | 4562 |
| | 2 | MPWGQG* | 4563 | ATGCCATGGCGCCAGGGTTAG | 4564 |
| | 3 | MGPGLAGEPHHSERGQWQNHGRISGSA* | 4565 | ATGGGGCCAGGGTTAGCAGGAGAACCTCACCATTCGGAGAGGCGCAATGCAGAA CCAACGGCCGCATCAGTGGGGTCTGCGTGA | 4566 |
| | 4 | MAEPRPHQWCVRGLYPGHLSP* | 4567 | ATGGCAGAACCACGGCCGCATCAGTGGGTCTGCGTGAGGGGCTTGTATCCGGGCA CCTTTCCCCCTAG | 4568 |
| hsa-mir-184 | 1 | MGKTWRSRSGCPRTAGDSRRRPWA* | 4569 | ATGGGGAAAACCTGGCGTCCCGCTCGGGGTGCCCGAGGACAGCAGGGATCCAG GAGGAGACCTTGGGCATAG | 4570 |
| | 2 | MRPLPEDAGVAFVFCQ* | 4571 | ATGCGCCCCTGCCTGAGGATGCTGGGGTAGCCTTTGTTTGTCAGTGA | 4572 |
| | 3 | MCSLRLGLGSPLEKSGWVVGEGRGLIPQTSL* | 4573 | ATGTGCTCTCTGCGACTGGGTTAGGTGTCTCCCCTTGAGAAAAGCGGTTGGGTGGTT GGTGAGGGAAGGGGGCTTATTCCACAGACTTCTTTATAA | 4574 |
| | 4 | MLLSFSYVRNHVLRQKVS* | 4575 | ATGCTTTTGTCTTTTCGGTTTATAGGAACCATGTGCTGAAGACAGAAGGTTTCATGA | 4576 |

Figure 1 (Continued)

| | | | | | |
|---|---|---|---|---|---|
| hsa-mir-185 | 1 | MPKSQAGGANLGWESSRADCHPPQLPQAQLGVIRHTVT MDFFKTGPSTSEGGTLGATPGP* | 4577 | ATGCCAAAAAGCCAAGCTGGGAGCAAACTTGGGTGGAGACAGGCTGACTG TCATCCACCTCAGCTTCCCAAGCTTGGGGTCATCAGACACACTGTGACCAT GGATTTCCAAAAACTGGTCCCTCCACCTGAGGGCCAGACCTGGGGGCCACACC AGGGCCGTAG | 4578 |
| | 2 | MPPPTISMLRGGSRFP* | 4579 | ATGCCCTCCCCACCTCAATGTGAGAGGGGAGGATCCCGTTTCCTTAG | 4580 |
| | 3 | MGSRDPAARPAYPGAPRSRHPPGPGPSLTQPSQGRKTI AASGQRLRGTKAGPPGQADAPPSASDPGPGSPQANFPP TCLSSAGIGPGLGGRWPAAGEAVAGPGSAPAPRPLGLR LGGLAPRGGGSGGHGEQPTGRGRAQVGRGGRGGRG GRGAGNYPSRPPETGGGALQPRVAPCPPTSRHLPPPTA GLDPCSLPLPAAGVSLSRRKTLAKSFPGLGLASVYDHTS VRLQRGKQFRQGRCPCCDAQSTRPPSLAQTWLRLSFTC HEMGADFTVVTAL* | 4581 | ATGGGGCTCCAGAGACCCTGCGCGCCCTGCATACCCGGGGGCACCGCTCACA CCGCACCCGCCGGCCCTGGCCTGCAGCGGCCCCAGCCAGGAGGGCAAGA CAATAGCTGCCTCGGCCAGCAGCGTACTCCTGACCCGGCCAGGGTCCTCCGGGCAG CCTCCAACCTGTCTGAGTTGGCACGCCAAGGGTCCACCAAGCAACTTC AGCAGCAGGGGAGGCGGTGCCTGGACCAGCTCGGCTCCTCCGGCCCTCG GCCTCAGGCTCGGTGGACTCGGGGCGCGCGGCGGCGATGTGGGCGGTTCACGGG GAGCAGCAATCGGGCGGCGGCGGCCAGGTGGCGTGCGGCGGACAGGGTG GCGTGGCGGGCGGGCGGGCAATGTGAGGTCCGCCCCCAGAGACAGGGGG CGGGGGCCTGCAGACTTTGCAAGTCTTCCTCCCCCCAGACTCGTTTGGCCTGGTTTA TGACCACACTTCAGTCGCCTGCAAAGGGGAAACAGTTCCGGCAGGCAGGTGCC CGTGCTGCGATGCACAGAGCACAAGGCTCCTCACTGGCACAAACTGGCTGCGA CTCAGTTTCACCTGCCATGAAATGGGGCCGATGAGACAGTAG | 4582 |
| | 4 | MTTLQSACKGGNSSGRAGARAAMHRAQGLPHWHKPG CDSVSPAMKWGPMRQ* | 4583 | ATGACCACACTTCAGTCGCCTGCAAAGGGGAAACAGTTCCGGCAGGCAGGTGCC CGTGCTGCGATGCACAGAGCACAAGGCTCCTCACTGGCACAAACCTGGCTGCG ACTCAGTTTCACCTGCCATTGGCCTTCAGTCCCGGGATGA | 4584 |
| hsa-mir-185 | 1 | MRGEDGLPLGLRDVSPGG* | 4585 | ATGCGCGGAGATGACGGCTTGCCATTGGGCCTCCGGGGATGTCAGTCCCGGGATGA | 4586 |
| | 2 | MTACHWASGMSVPADDRPPRGGAAAPHLPEPLRRWQ GTRDRSLPADLREHPPTIQPRAGTGRAGAPSPDSGRVAS ATTPSSQVSPFSACYSLRAARRSLLSTSNCILHASREREF CCYPHFTVGKQPQRGSHLLEHSRLILGPGGSLILTPLGP RSGETMEVGAAVFPRAGRDPLGKPGIAHLPHQAWM* | 4587 | ATGACGGCTTGCCATTGGGCCTCCGGGATGTCAGTCCCGGCGGATGACCGGCCCCCT CGCGGAGGGGCAGCCGCTCCTCCCCAGCCGACTTACGAGAACATCCCGACCATCCAGCC TACGGAGCAGGGACTGGCAGAGACCCGGAGCCAGGTTCACAGAGGCCGCAGGTATCCCCCAGACTCTTCAGCGCCTACTCGCTCGGCG CTGCGCGCCTCGCGCTCTGTCTCCATGGAATTGGAAACAGCCTCAGAGGTTCTC AGCTTGCTTGAAACACAGTGCTTGCCTGGGCCTGGGGAAGCAGGAGAGTGAGTATTTCGAGG CCCTGGGTCCCCGCAGCGGGGACGATGGGAAGCCTCGGTAAACCAGGGGCTCAGTATTTCCGAGG GCAGGAAGGAGACCCCTCGGTAAACCAGGGCTCACCTCCCCCACCAGGCCTGGAT GTAG | 4588 |
| | 3 | MTGPLAEGPRPRTCPNLCGGGGVRGTAPSQPTYENIP RPSSPEQGLAEPAPLPRTLAA* | 4589 | ATGACCGGCCTGGCCGAGGGCCGGCCCCGCACCTGCCCGAACCTCTGCGG CGGCGGTGGCAGGTACGGCGGGACCGCTCCCCAGCCGACTTACGAGAACATCC CGCGGTCCATCCAGCCCCGAGCAGGGACTGGCAGAGCCGGCGCCTTCCCCGGACT CTGGCCGCGGTAG | 4590 |
| | 4 | MGPFLTSSWHSHSPTALRLGRQSCAFMPAPRTTVPFSS PYLESGRNGASLPVEJHVGYISLPD* | 4591 | ATGGGGCCAGCAGAGTTGTGCGTTTAGCTGCCGCACCCGTACTACTTGTCCATTTCTT CACCCTACCTGGAGTCAGGAAGAAACCGGTTCGCTTCACTGCCTGTTGAGATTCACGTAG GTTACATTCCTTGCCAGATTAA | 4592 |
| | 1 | MVNAPASGWAVLGWLRWRAGAAPGSRRRWRR* | 4593 | ATGGTGAACGCGCCGGCTTCGGCTGGGCGGTACTGGCTTGCCTGCGGTGGCGGCGC GGGCGCGGCACCGGAAGTCGGCGGCCGGTGGCGGAGGCGGTGA | 4594 |

Figure 1 (Continued)

| | | | | | |
|---|---|---|---|---|---|
| hsa-mir-185 | 1 | MPRALLEGVFDNPRWHGMRGTLAGGTRLAAGRLRSAGLGAAWSLQGVWAARPWPASGTALAPGHSAPYPRPAAGQQGDS* | 4595 | ATGCCCCGCGCGTTACTGGAAGGTGTTTTGATAATCCCGCTGGCACTGGATGCGAGGGACTCTGGCAGGTGGGACCAGAACTCGCTGCGGGAGGCTGAGATCGGCAGGGTTGGGAGCTGCCGTGGTCCCTGCAGGCGTGTGGCTGCTGGCCAGCATCAGGGACAGCTCTGGCGCCCGGTCACTCTGCCCCTACCCGCGGCCTGCTGCGGCCAGCAGGGTGACAGCTAA | 4596 |
| | 3 | MRPSWGGLGS* | 4597 | ATGCGGCCTTCCTGGGGAGGTTTGGGTAGTTAG | 4598 |
| | 4 | MSHALPWPGLFALSCGSRPADHCFAATLGTVPSSMRQM* | 4599 | ATGTCACATGCCCTGGCCAGGCCTGTTTGCACTGTGTGGCTCTAGACCTGCTGACCACTGTTTTGCTGCCACAGTGCCCTCTCCATGAGGCAGATGTGA | 4600 |
| | 1 | MSTKMFRVSDGDWICPDKK* | 4601 | ATGTCGACCAAGAATTTCCGAGTCAGTGACGGGGACTGGATTTGCCTGACAAAAGTGA | 4602 |
| hsa-mir-186 | 2 | MIFCALRRVEAANRQPPGGKKAPNLLTREVFPGAFVLDMSSAFPRHYLRKVASLFRVRDGLPFCHPPPPRPGFSDRKPLQSGQLGVGSPPRDFSLQNFFLVHGKYCFLAIVLLPLIVHLVLYFYSNFSSILFSPPPEALPSSVWEILTFSLWHSPQELGFSPP* | 4603 | ATGATTTTCTGTGCCTTAAGACGGGTTGAGGCGGCGAACCGCCAGTTCCTGGCGGGAAGAAGGCTCCCAATCTCCTCGACATTACCTCCGAGAGAGTCTTTCCGGGAGCCTCTCTTTTAGAGTGCATGTCTTCAGCGTTCCTCCGACATTACCTCCGACATTACCTCCGAGAGAGTCTTTCCGGAGCCTCTCTTTTAGAGTGCGAGATGGCCTACCTTTTGCCCCCACCCCCGCCCCGGCCAGGTTTAGCGATAGGAAACCTCTCCAGTCAGCAGGCCAGCTGGTTGATCTCCCCACGCTGCTGCTTACTCTGTTCACGGAAAATATTGCTTCCGACTGTCGTCCTTTTGCCTGCAGAAACTTACTCTGTTCACGGAAATATATTGCTTTCTCAACTTGACATTTTCTTGTGGATCATTTCTCCACAAGAATTGGGCTTTTCGCCCTCTAG | 4604 |
| | 3 | MAYLFAPTPLPRPGQVLAIGMLSSQASLVLDLPHVTFLCRTLLLFTENLAFSHSSFCLL* | 4605 | ATGGCCTACCTTTTGCCCCCACCCCCGCCCCGGCCAGGTTTTAGCGATAGGAAACCTCTCCAGTCAGCAGGCCAGCTGGTTGATCTCCCCACGCTGCTGCTTACTCTGTTCACGGAAAATATTGCTTCTCAACTTGACATTTTCTTGTGGATCATTTCTCCACAAGAATTGGGCTTTTCGCCCTCTAG | 4606 |
| | 4 | MPAAEKHVC* | 4607 | ATGCCTGCAGCAGAGAAGCACGTTGTTGTGA | 4608 |
| | 1 | MSCYLLM* | 4609 | ATGAGTTGCTATCTCTTAATGTGA | 4610 |
| hsa-mir-187 | 2 | MGEERPQASLLRGKESLLTG* | 4611 | ATGGGGGAGGAAAAGACCCCAAGCTTCTCTCCTTAGAGGGAAGGAATCCTTACTTACAGGTTAG | 4612 |
| | 3 | MDPCAPLPIPQAKGSEGRARSPRLAFGGTGLEGPLGAQRPREIEYLYAQQPSLSRRTE* | 4613 | ATGGATCCTGCGCCTGCACTTCCAATTCCCAAGCAAAGGGAAGGGAGCGGGAGAGCGCGGAGCCCCGGATTAGCGTTCGGAGAACTGGCCTAGCAGGGCCACTCGAGGCGCAAAGGCCCCCGCGAAATAGAATATCTATAGCCAGCAACCTCCCTTTCGAGGCGCACGGAATAA | 4614 |
| | 4 | MSVRPSPRGTR* | 4615 | ATGAGCGTACGCCGCCGCGCTTGCTCCCCGGTACCAGGTGA | 4616 |
| | 1 | MSRAPASLPLLPGWAV* | 4617 | ATGAGCCGCGCGCGTTGCTCCCCGGTCGGCTGTGTGA | 4618 |
| hsa-mir-188 | 2 | MKLCRLRGALTQLGVLDARADRARCPPAADTGSAAPDLGDR* | 4619 | ATGAAGCTCTGCCGCTACGTGGGGCGCTCACTCAACTTGGTGTCTGGACGCCAGAGCGACCGAGCGCGTGCCGCCACGGCGCCGGACACGGGCTCCGCCGCTCCGGACCTCGGCGACAGGTAA | 4620 |
| | 3 | MGLPRARRWQPGA* | 4621 | ATGGGGCTTCCCCGCGCCCGGCGTTGGCAGCCGGCGCTTAG | 4622 |
| | 4 | MVPGLPERSFLAERRQARPAFESECLAACVPPPGLG* | 4623 | ATGGTCCCTGGGTTGCCCGAGCAAGTTTCCTTGGAGCGGCGCCAAGCCGCCCCGCTTTTTGAATCGGAGTGTTTAGCCGCTGCCTGCGTCCCTTTCCGGACTGGGGTAG | 4624 |

Figure 1 (Continued)

| | | | | | |
|---|---|---|---|---|---|
| hsa-mir-18a | 1 | MVAATPPGESARPSGDGGKPVVCGPGLAGGAERPGAD WPGAAWRRRGRGESRPLAAPACGSRIWLPFRSPAGRR RGAGPGREGGRGRRARGGRARDPRRPCLGRPEGGWAD GEHWGPSGRGRARPYPSPGPGARAGRGVSG* | 4625 | ATGGTGGCGGCTACTCCTCCTGGTGAGTCTGCCCGCCCTCCGGCGACGAGGGAA ACCTGTGTGTCGCAGCCCGGGTCTGCGGGGCGGAGCGCTCCGGGGCGGACT GGCCCGGGGCAGCGTGGCGGCGGCGTGGCCGGGGCCTGGGGGCGGTTGGCC CCCCGCTGTTGGCAGCCGCATTGGCTGCCCCTCGCTGCCCGGGCGGTCGGCG GAGGGGGCAGGGCGGGCGGCGAGGTGGAGGCGGCGAAGCGGCGGGCGGC CCGGCCCGGACCGGCTGCCTGCCGCAGACCCGGGGCGGCCGGCGTCGGCGA CGGCGAACACAATGGCCCCTCGGGAGGACGTGCGAGGCCGTGCTTCTCCGG GCCCCGGGCGCGCGGGGCGTGGGGTCTCTGGGTAG | 4626 |
| | 2 | MAPRGEDVRGPCLLRGPGRARGVGSLGRKVSPEGES* | 4627 | ATGGCCCCTCGGGAGGACGTGCGAGGCCGTGCCTTCTCGGGGCCCGGGGCG CGCGGGGCGTGGGGTCTCTGGCTAGGAGAAGTTCTCCGAGGGCGAAGTTAA | 4628 |
| hsa-mir-18a | 3 | MGQAAGREGARPRGTCAPAGGVAWAGARCGSPMFVRA RVGGGAPRSARPGRHPRSAWALLARVGSLGAGPATSPP WPSEEAAVGLSRGVEEPAPGRLLGVWRGRASPARRERR PRRHVPAGRAARG* | 4629 | ATGGGGCAGGCCGCGGCGTGGAGCGGGCGGCGCCACGAGGTACCTGCGCAG GTGGGCGAGGGCGCCGAGATCGGAGCCCCGGTTCGTACGCCGGAGG CGCTTGTTAGCCCGCTGGCAGCCTCGCGCCGCAACTTCCCCCGCCGTG CCCTCGAGGAGGCCGCAGTCGGCCTCAGCGGCGGAGTCGCTGCCC GCGCTTGCTGGGAGTGTGCGCGGGAGGGCCAGGCGGCTCCGCGGAGCGGCGT CCCGGCCCATGTTCCTGCGGGGCGGGCTGCACGGGGTGA | 4630 |
| hsa-mir-18a | 4 | MFLRGGLHGGEFGGGRGGDCAPPIYPGLGLGPRATGTA AAEPPLWAGLGGAGGHKGGAARPRPRTRASAPPVA ARLPPGNGLLGGLPRPAGPDSDPPPGGYAENRRAALPL VRHVLPARAP* | 4631 | ATGTTCCTGCGGGGCGGCTCACGGCGGTGAGGCGGGACATGGCGGCGACTG CGGCCGCCGCCGATTGTTCCCGCTTAGGCTCGGCCGGTGCGACGGGCACCG CGGGCCGGAGCTCCCCGCCCCTCGTGGGGGGCGTGGGGAACAAA GGAGGGGCGGCTGCCGCCGGAAACGGGTTGGGCTACGTGGAGAATGGGAGAATCGCAGG GCCCGCGGCCGTCCGTCCCGCCGGCCTG ACTCTTACCGCCGCCGCCGCCGTGCTGGCGCTACGTGGAGAATGCAGGGCCGCGCTCTCCC TTGTGTCGACATGTCTGCCGCGCCCGGGGTCCATGA | 4632 |
| | 1 | MGGGH* | 4633 | ATGGGCGGTGGTGGCGAATAG | 4634 |
| | 2 | MSCLMNC* | 4635 | ATGTCTTGTTTAATGAACTGCTAA | 4636 |
| | 3 | MSLLGSYFYLFPLIG* | 4637 | ATGTCACTCTTGGGAGTTACTTCACTTGTTCCTTAATAGGATGA | 4638 |
| | 4 | MISSFPITFCLSMQDT* | 4639 | ATGATTTCATCTTTCCAACCTTCTTCGTCTCTCAACCAAGACACATAG | 4640 |
| hsa-mir-19c | 1 | MVALSLKHCVRHCNVVKTMQFEPSTAVYDACRVIRERV PEAQTGQGRSWVIYWLLKTCLHVFHFFAKETEAPSGTQ AY* | 4641 | ATGGTGGCCCTGTCCTTAAAGCATTGTGTGCGCCACTGCAACGTGGTGAAGACCATG CAGTTTGAACCATCTACAGCTGTGTACGATGCGTGTCGAGTCATTCGGGAACGGGTG CCTGAGGCACAAACTGGCCAAGGTAGGTCATGGTTATTTACTGCTTCTTAAAACG TGTTTGCATGTTTTCACTTTTTGCTAAAGAGACAGAGCTCCAAGTGGTACACAA GCTATTAG | 4642 |
| hsa-mir-19c | 2 | MRVESFGNGCLRHKLLGKVGHGLFTGFLKRVCMFFTFLL KRQRLQVVHKPISAYVSNEIPS* | 4643 | ATGCGTGTCGAGTCATTCGGGAACGGGTGCCTGAGGCACAAACTGGGCAAGGTAGG TCATGGGTTATTTACTGGCTTCTTAAAACGTGTTTGCATGTTTTCACTTTTTGCTA AAGAGACAGAGCTCCAAGTGGTACACAAGCCTATTAGTGCATATGTTTCAAATGA AATACCTTCTTAG | 4644 |
| | 3 | MGYLLAS* | 4645 | ATGGGTTATTTACTGGCTTCTTAA | 4646 |
| | 4 | MFQMKYLLRSDTTCFLCETCDYSDHAHC* | 4647 | ATGTTTCAAATGAAATACCTTCTTAGATCAGACACTACCTGCTTCCTCTGTGAGACTT GTGATTACAGTGACCATGCCCACTGCTGA | 4648 |
| hsa-mir-19b | 1 | MTMGHHEAIINTFALTRR* | 4649 | ATGACAATGGGAATTCATGAAGCTATAACCAACACTTTTGCACTAACAAGACGATAG | 4650 |
| hsa-mir-19b | 2 | MPEFLFTKNKLFNFCHLTCQR* | 4651 | ATGCCTGAATTTCTATTCACAAACTAAAAAACAAACTTTTCAACTTCTGCCATCTTACCT GCCAAAGATAA | 4652 |
| | 3 | MNEEQF* | 4653 | ATGAATGAAGAACAGTTCTAA | 4654 |

Figure 1 (Continued)

| | | | | |
|---|---|---|---|---|
| hsa-mir-191 | 4 | MKNSSNASEV* | 4655 | ATGAAGAACAGTTCTAATGCCTCCGAAGTATAG | 4656 |
| | 1 | MGEVYKLLC* | 4657 | ATGGGAGAAGTGTATAAATTATTATGTTGA | 4658 |
| | 2 | MLISKISAKG* | 4659 | ATGTTGATAAGCAAGATAAGTGCCAAAGGGTAG | 4660 |
| | 3 | MRAAPVTRPS* | 4661 | ATGAGAGCAGCTCCAGTTACTCGGCTTCATGA | 4662 |
| | 4 | MTQEVEGGTGTGIGLQRKGQHQPV* | 4663 | ATGACACAGGAAGTTGAAGGTGGCACAGGCATTGGGCTGCAAAGAAAAGGCCAGCATCAGCCTGTCTAG | 4664 |
| hsa-mir-191 | 1 | MGSQGSRVGRAGWVPEAEAQCTSGAQRAAMLEQRRRRRGASWVPAAAPVGWSRGPSRAAEGRPARRQGGRASGQLFPDPRPPPAWPRPPTPPPPRAQRPHPGAVRSR* | 4665 | ATGGGGTCTCAGGGGTCAAGGGTCGGTAGGGCGGGCTGGGCTGGGAAGCGGAAGCGCAGTTGCACTTCAGGCGCAGCGGGGGTCGGGGCGGCCATGTTGGAGCAGCAGCGGAGGCGCGCGAGGGCCGGTCGCCGTCTTGGGCTCCGCAGCGGCGACGCCGAGTTGGAGCCGGGGCCTAGCCGGCGCCGGGGCGGCCGGCGGCCGCGGAGGCGCTCGCAGGGCGGCCAACGGCCAACTCTCCCGGACCCGCCGCTCCCCCGGCCTGCCGAGACCCCGCCACCCCACCCCCACCCGCCGACCCAGCGACCTGGGGCTGTGCGGTCCGGTAG | 4666 |
| hsa-mir-191 | 2 | MCKDCAWRTVSGEGKCPRHLRIQECFQTKSPRAFPPGYSEDPFCCIRAVGRNYTDGPHGPRDLPDPG* | 4667 | ATGTGCAAGGATTGTGCTTGGAGAACAGTTCTGGGAGGGAAGTGCCCAAGACACCTGAGGATCCAAGAATGTTTCCAAACAAGAGCCTAGGGCATTTCTCCAGGGTATTTCTGAAGACTTCATCTGCTGCATTAGAGCCGGTGGGAAGAAACTACACAGACGGGCTCATGCTCGAGGGACCTGCCTGATCGTCCTGA | 4668 |
| | 3 | MFPNKEP* | 4669 | ATGTTTCCAAACAAGAGCCCTAG | 4670 |
| | 4 | MARGTCLILADLLMLWCSWGAASCFWEPSVLGWVLDVSYD* | 4671 | ATGGCCCGAGGAACCTGCCTGATCTTGGCTGATCTTTTAATGCTCTGGTGCAGCTGGGGAGCTGCCTCTTCTTCTGGGAACCTGAAGTGTTGGGTTGGGTTAGATGTTAGTTATGATTGA | 4672 |
| hsa-mir-192 | 1 | MGKPRLGLGHREPSPC* | 4673 | ATGGGGAAACCAAGGCTCGGTTGGGAATCAGGGAACCCTCACCTGCTAG | 4674 |
| | 2 | MFPGEADGAQPDASWTRPTLPGHSPGLFALRTALVISIDGGGHHNHHQGLGQRLKRPWAQGVPTSSLCPEGQPGTQVRGFLSGRTPAALPVLGGS* | 4675 | ATGCCACCCGGAGAGGCAGATGGGGCCCAGCCTGATGCTTCCTGGACCCGCCCACCCTGCCCGGCACAGTCCAGGGCTTCCTGCCCTCGAACCCGCACTGTGATCAGTATTGAGCAGGTGGTGGGATAATCATTAACCACCACCAGGGGCTCAAAAGGCCCTGGGCCAGGGGTGCTCCTGCCCCACTTCTCCTTGTCCCGAAGGCCAGCCGGCCAGGCTTCAGTGAAGAGAGCTTCCTGAGACTGGTAGGACCCTGCGCCTCCTGTCCTAGGAGGCTCCTGA | 4676 |
| | 3 | MGPSLMLPGPAPPCPGTVQGFLPEPHL* | 4677 | ATGGGGCCCAGCCTGATGCTTCCTGGACCGCTCCTGCCCCACCCTGCCCGGCACAGTCCAGGGCTTCCTGCCCTTCGCCTTCGAACCGCACTGTGA | 4678 |
| | 4 | MGWPGRAPSSLCLGFHCGIRGP* | 4679 | ATGGGCTGTCCGGGTCGCGCCTTCGGGACGAGCCCCTTCCTCTCTGCCTTGGTTTCCACTGTGGGATAAGGGCCCTAG | 4680 |
| hsa-mir-1932 | 1 | MGKLRPAAGALHRAGARPCSGAAGRGLPAPVSAGGSAGSCSDGSKEEKGKLLGSGAGRTA* | 4681 | ATGGGGAAGTTGAGGCCGGCGGCCGGGGCCCTGCACCGGGCCGGCGCGCGGCCCTGCAGCGGCGCCGCCGGGGCGGGCCTCCCGGCGCCCGTCTCGGCTGGAGGAAGGCGCTGGGGAAGCCTCCGGGGCGGCAGGGAAAATTACTGGGCTCCGGGCGGGAAGGACTGCGTGA | 4682 |
| | 2 | MCRQHVEPGRAAASKPTPPTFEGSRRPAPLLPASSGSLS* | 4683 | ATGTGTCGCCAGCACGTGGAGCCTGGCCGCGGCGGAGCAAGCCGCGACCCCCAACTTTCGAGGGTCTCGGCGGCCCCGGCTCCTCCGGGCTCGCTCGTC | 4684 |
| | 3 | MAPVPRQRCGLGLAGGCGLLREVGHRGSCPAPRAPRPRS* | 4685 | ATGGCCCCCGTGCCCAGGCAGCGGTGCGGCCTCGGCCTCCGGGGCTGCGGAGGGTGCGGCCTGCTCGAGAGGTTGGCCACGAGGTCGTGCCCGGCGCCGCGGCCACGGCCGTCCGCCGCTCCTCCTCTCCAGGTTCGA | 4686 |
| | 4 | MGAEGWVFAGEMRVSDQLAYKVPVLGPRDQRLLPGPRPRPASSRAGVRSGQAASQVHAGEGVVRCARPGCVR* | 4687 | ATGGGAGCTGAGGGCTGGGTCTTTGCGGGCGAGATGAGGGTGTCTGACCAGCTCGCCTACAAAGTCCCAGTTCTGGGCCCCAGGGACCAGCGTCTTCTCCCCGGGCCAGGCCCCGGCCCGGCCAGCTCCTCGGGCTGCGTCCGGCAGGCGGCGAGCCAGGTGCACGCGGGCGAGGGTGTGGTCCGCTGCGCTCCCGGCTGCGTGCGGTGA | 4688 |

Figure 1 (Continued)

| | | | | |
|---|---|---|---|---|
| hsa-mir-193a | 1 | MCHQHVEPGRAAASKPTPPTFEGSRRPAPLPASSGSLS* | 4689 | ATGTGTCACCAGCAGCACGTGGAGCCAGGTCGGAGCCAAGCCGACCCCCCC AACTTTCGAGGGTTCGAGTCGAGCCTCCTCCGCTCGTCCCCGGAGCAAGGCGGCCT CTAG | 4690 |
| | 2 | MAPVPRQRCGLGLAGGCGLLREVGHGSCPAFRAPRPPS* | 4691 | GCTGCGAGAGGTCGGCCAGCAGCGGCTCCCTGCCCGCGCCTCGCCTTGCGCGAGAGGTGCGGCCT GCTGA | 4692 |
| | 3 | MGAEGWVFAGEMRVSDQLAYKVPVLGPRDQRLLPGPR PRPASSRAGVRSGQAASQVHAGEGVVRCARPGCVR* | 4693 | ATGGGAGCTGAGGGCTGGGTCTTTGCGGCGAGATGAGGGTCGGATCAACTGGC CTACAAAGTCCAGTTCCTCCGGCCCGGGACCAGCGTCTCCCGGTCCTCGCC CAGGCCGGCTTCCCGGCTGGCGTCCGGAGGTGCTCTCAGGTTCA CGCTGGAGAAGGAGTGGTGAGGTGCGCTGCCGTGCGGTGA | 4694 |
| | 4 | MGQALPLTEACPAVLSRAATLSLGVGRTGPDF* | 4695 | ATGGGCCAAGCCTGCCACTTACCGAGGCCTGCCTGCTGTGCTTCCAGGGGCGGCA ACCTTGAGCTTGGGGGTGGGAGAACGGGCCTGACTTCTAG | 4696 |
| hsa-mir-193b | 1 | MGTTGEGRWRRGSARFSRDSARDACLGCDCRRCRHPGS PSDPSPAPQRGV* | 4697 | CGGCGGCGAGAGCGTTGTCTGGCGCTGCGATTGCGCGCGCCTGCCACCCGGTCCC CCTCGACCCCTCGCCTGCCAGAGGCGGTGA | 4698 |
| | 2 | MPRAEQAGRARRSTCARAPLAWAAAPAGAGPRGSRTS REPPSESYRRPLKLSAPSPREAGSPGALALASAGRGQK N* | 4699 | ATGCCGCGCGCGGAGCAGGCGGCAGGCGCGCGCCGGCCTGCCCGCCGAGCCC GCTGGCATGGCGCGGCGGCGCCTCCCAGAGAGTTACCGCCGCCCCTAAAGTTGTCAGCTGCCTCC GGGAACCACCCGTCCCCGGATCCCGGGACCTAGCC CCCGAGAAGCAGGCAGCCTGGCGCGTTGGCTTAGCTCTGCAAGGACGGGGGCAA AAAACTAG | 4700 |
| | 3 | MCGGACCGRAPGIPD* | 4701 | ATGGGCGGCGGCGCTGCGGGGCCCGGGACTAG | 4702 |
| | 4 | MRRLCPLRTHPYL* | 4703 | ATGCGCCGCTTATGTCCTCTGACACATCCATATTTATA | 4704 |
| hsa-mir-194-1 | 1 | MSTGLTEMNALDPHLPFICSCALFSYKVDGLFREPLGN V* | 4705 | ATGTCCACGGGCCTGACAGAAATGAATGCTCTGACCCCATCCACTTGCCTTTCATT TGTTCCTGTGCCCTTTCATACAAAGTGGATGGCTCTTTAGGTTCCTTTAGGAA ATGTGTAA | 4706 |
| | 2 | MLWTPSTCLSFVPVPFFHTKWMASLGFL* | 4707 | ATGCTCTGGACCCCATCCACTTGCCTTTCATTGTTCCTGTGCCTTTTTCATACAA AGTGGATGGCCTCTTTAGGTTCCTTAG | 4708 |
| | 3 | MCKCLQAFVLTLK* | 4709 | ATGTGTAAGTGCCTTCAGGCCTTTGTGCTCACATTAAATAA | 4710 |
| | 4 | MAFVTRQMNNVKYFQK* | 4711 | ATGGCATTTGTGACTATCCAAATGAACAATGTAAAGTACTTTCAAAATAG | 4712 |
| hsa-mir-194-2 | 1 | MGKPRLGLGHREPSPC* | 4713 | ATGGGGAAACCAAGGCTCGGGTTGGGACATCGGGAACCCTCACTTGCTAG | 4714 |
| | 2 | MPPGEADGAQPPDASWTRPTLPGHSPGLPALRTALVISID GGGHHNHHQGLGQRLKRPWAQGVPTSSLCPEGQPGTQ VRGFLSGRTPAALPVLGGS* | 4715 | ATGCCACCCGGAGAGGCAGATGGGGCAGTCCAGGCTCCTGCCCTTGAACCGACCTGCCGCCCAC CCTGCCGGGCACAGTCCAGGGATAATCATTAACCACCAGGGCGTGGGTCAACGGCTCAAAA GGCCCTGGCGTGGTGGGAGCCCAGGTGTCCCACTTCCTCGTGCCGAAGGCAGCCCGGCA CTCAGTAAGGAGGCTTCCTGAGGTGGTAGAACCCCTGCCGCCCTCCCTGTCCTAGGAG GCTCCTGA | 4716 |
| | 3 | MGPSLMLPGRAPPCPGTVQGFLPFEPHL* | 4717 | ATGGGGCCCAGCTGCTTCCTGATGCTTCCTGGACCCGCCCACCCTGCCCGGGCACAGTCCAG GGCTTCCTGCCCTTCGAACCGCACTGTGA | 4718 |
| | 4 | MGWPGRAPSSLCLGFHCGHRGP* | 4719 | ATGGGGTGGCCCGGGACGAGCGAGCCCCTTCCTCTCTGTGCTTGGTTCCACTGTGGGGATA AGGGGCCTTAG | 4720 |
| | 1 | MGWDGFWGGVPNSDWEWRNPS* | 4721 | ATGGGCTGGGACGGCTTTTGGGGCGGTGTCCCCAATTCTGACTGGGAGTGGAGGAA CCCCTCCTGA | 4722 |
| | 2 | MRLGRLLSPAPQM* | 4723 | ATGCGACTGGGCGGCTCCTTTCTCCTGCACCCAAATGTGA | 4724 |

Figure 1 (Continued)

| | | | | | |
|---|---|---|---|---|---|
| hsa-mir-195 | 3 | MHPKFCSFQNRGPGSQGRVAEVSGEGSVLCFQERRGG WGGGLEVRAGVGLALSVLELGG* | 4725 | ATGCACCCTAAATTTGCTCTTTCAAAATAGGGACCAGGATCTCAGGGGAGAGTAGCTGAGGTAAGTGGGGAGGGAAGGGAAGTGTCCTCTGTTTCAGGAGACGTGGCGGTTGGGGGGGAGGTTGGAGAGTGCGTGCTGGGTGGGGTTGGCTTTGTCAGTCTTTGAATTGGGGGATGA | 4726 |
| | 4 | MIGEAFSYTPKLQPPRRKPKAETREPPNIPSR* | 4727 | ATGATTGGAGAGGCTTTCTTCTATACCCTAAACTGCAGCCCCCAGACCGGAAACCAAAGGCTGAGACCAGAGAGCCCCCAACATCCCCAGCCGTTAG | 4728 |
| | 1 | MGAGVSVSTCEQAGVWRGREEERAR* | 4729 | ATGGGTGCGGGTGTGAGCGTGAGCACCTGTGAGCAGGTGGGTGTCTGGAGAGGCAGAGGTGAGGAGGCGGCACGTTAG | 4730 |
| hsa-mir-196a-1 | 2 | MNCLTWGSSASAEPGPWDLGRYPSQQLFRSTGPPLQIPFFLCLFPRIPETF* | 4731 | ATGAATTGTCTTACCTGGGGCAGCTGGCTCTGCAGAGCCAGGCCCTGGGACATTTGGGCAGGTGCCTTCAGACAACTGTCAGATCAACCGGCTTCCCCTCCAAATCCCATTCTTCCTCTGTTTGTTCCTAGAATTCCGAAACTTCTGA | 4732 |
| | 3 | MHLRICLKLRILFICGDLQLG* | 4733 | ATGCACCTTCGTATCTGTTTGAAGTTGAGAATTCTTTTATCTGTGGAGACCTCCAGCTGGGCTGA | 4734 |
| | 4 | MSLESELSGPAPKWFYLESWVQFFRCVV* | 4735 | ATGTCTCTGGAATCTGAGCTATCAGGACCGGCTCCAAATGGTTTTACCTAGAGTCCTGGGTTCAGTTCTTCCGATGTGTTTAG | 4736 |
| hsa-mir-196a-2 | 1 | MIKRGRDGNGRPKGAESLLCGSSGWGKSWGPRTGTTAVASGHRSWNKVPPLS* | 4737 | ATGATTAAGAGAGGAAGAGATGGCAATGGAAGACCTAAGGGAGAGCAGAGTCACTCTGTGGCAGCTCAGGTTGGGGTAAGAGCTGGGGGATGGGGGAAAGCTGGGGGTCAAGGTCATGGACCACTGCAGTGGCCTCTGGCCACAGATCCTGGAACATCTGGAACAAAGTCCCTCACTGAGTTGA | 4738 |
| | 2 | MAMGDLREQSHSVAAQVGVRAGGPGQPLQWPLATDPGTKSLH* | 4739 | ATGGCAATGGGAGACCTAAGCGAGCAGAGTCACTCGTGGCAGCTCAGTTGGGTAAGGGAGACCCCAGGACAGGGTCAGTGGCCTCTGGCCACAGATCCTGGAACAAAGTCCCTCACTGA | 4740 |
| | 3 | MLPHLVGFFQSWNGTERRGDLARPEESARVSQLGESQGTQDLLD* | 4741 | ATGCTTTTCCATCTGGTTGGATTTTTCCAGAGCTGGAATGGAACAGAGAGAAGGGGGGATCTGGCAAGGTTTAGGAATCTGCCAGGTCAGGTCAGCAGCGGCGGAGCGGCGGCGGAGGCGGCGGCGTACTCAGGATCTTTTAGATTAA | 4742 |
| | 4 | MEQREGGIWQGLGNLPCGASWGKARVLRIF* | 4743 | ATGGAACAGAGAGAAGGGGGATCTGGCAAGGTTTAGGGAATCTGCCAGGGTCAGCCAGTGTGGTTGA | 4744 |
| hsa-mir-196b | 1 | MAGFSPWRRRQRRRRRRRARQPFAGSTRTGR* | 4745 | ATGGCAGGTTCTCTCCTTGCGCGGCGCGGCAGCGGCGGAGCGGCGGAGCGCGGCGCGGGCGGCGAGGGAGGCAGCCTTCGCCCTGTCGCTAACGGCTGGTCGGTGA | 4746 |
| | 2 | MTTGWRQPCVSSPVANG* | 4747 | ATGATCACGACCGGATGCGCGATGTCTTGCGTTCTTCGCTGTCGCTAA | 4748 |
| | 3 | MAAALRFFACR* | 4749 | ATGGCGCAGCAGCTTCGGTTCTTCGCTGTCGCTAA | 4750 |
| | 4 | MFHTAPLCSWVLEKGTLPRASMF* | 4751 | ATGTTCCATACAGCACCTTGTGCAGCTGGGTCTGGAGAAGGGGGACCCTTCCAAGAGCCAGTATGTTTTAA | 4752 |
| | 1 | MRRYKPGWGFAAIS* | 4753 | ATGCGCGCTATAAACCGGCTGGGGTTTTGCAGCGGATTCTTAG | 4754 |
| | 2 | MRSQ* | 4755 | ATGAGATCTCAATAG | 4756 |
| hsa-mir-196b | 3 | MAHFRSMSKPPGSREPQHDSWPLFASDTKSSTVHYFTCPAPLHFRKRGLTLKK* | 4757 | ATGGCCCACTTCCGATCAATGTCAAAGCCGCCGGGAGCCGGAGAACCCCAGCATGATTCTTGGCCTTTTGCCTCAGACACTAAGAGCAGCACGTACATTATTTCACTTGTCCGCTCCCTTGTCATAACGGCATTCGTAGGCCTCGGAGCCTCGGAGCGTCCGCCGCGGACTCACCCTCAAGAAGTGA | 4758 |
| | 4 | MILGLCSLLILRAARYIISLVPLPFITEKGDSPSRSDWYGNLKQRAFARPRERRRAEKPAVPWQ* | 4759 | ATGATTCTTGGCCTTTGCTCCCTTCTCATAACGCTCCGGGCCGCTCAGCAGCCGCACCGTACATTATTTCACTTGTCCGCTCCCTTGTCATAACGCACCGGCATTCGTCTAGGCTCCGCAGAAAAGGGGACTCACCCTCAAGAAGTGGTATGGTAATTTAAAGCAACGGCATTCGCTAGGCCTCGGAGCGTCCGCCGCGGAGCATTCAGCTCCAAGAAGTGAAGCCAGCTGTCCCTTGGCAGTGA | 4760 |
| | 1 | MLIYILQGYPSRGGHPGD* | 4761 | ATGCTGATTTACATCCTCCAGGGATACCCTCCAGGGAGGCCATCAGGAGACTGA | 4762 |

Figure 1 (Continued)

| | | | | | |
|---|---|---|---|---|---|
| hsa-mir-197 | 2 | MWVRADHLPGAQKPQGPLTSYLWIPKESPRVLGLEVCPSLQPMGIRVGGCYF* | 4763 | ATGTGGGTGAGGGCTGACCACTCCCGGGGCGCTCAGAAACCCAGGGGCCACTCACAAGCTATCTGAACCAATGGGATCCCCAAGAGTCCCCAGAGTTCTAGGTCTGGAAGTCTGTCCCTCCCTTCAACCAATGGGCATAAGAGTCGGGGGGTGCTATTTTAG | 4764 |
| | 3 | MSGKEVTGPVSLCSVVSSLDREESGSLGLSRGWLG* | 4765 | ATGTCTGGGAAAGAGGTCACAGGAGTCAGGTTCCTTGGCTGACTGCAGGCCAGGTGCTCAGTGCTCAGTGGTGTCCAGCTGGACAAGGAAGAGTCAGGTTCCTTGGCTGACTGCAGGGGTTGGCTTGGCTGA | 4766 |
| | 4 | MRWLGATDPET* | 4767 | ATGAGATGGTTAGGGCGACTGACCCAGAGACATAG | 4768 |
| hsa-mir-198 | 1 | MGRSWGGROAGKERS* | 4769 | ATGGGAGGAGAGCTGGGGGGCAGGCAGGCGGGAAGAGAAGAGTCTTAA | 4770 |
| | 2 | MWKRWLALALALVAVAWVRAEVGEGPRSPNSVPGASWVCALGGWARVLGMLSRGGAGSFGPWGVLGWSWGSNAAYET* | 4771 | ATGTGGAAACGCTGGCTCGCGCTCGCGCTGGCTGGTGGCGGCTGCTGGGTCCGCGCCGAGTTAGGCGAGGGCGCCGAGGGCGGAACTCGGACTCGGACTCGGACTCGGACTCGGACTCGGACTCGGACTCGGTCCGCGTGCTCCCGGGGCGCTCTTGGGTCTCGCCGCTGGGGCGGCGAGTCGGAGTCCCGGGCGCCGAGGGCGCCGAGGGCGGAAGGAAGGAAGGACCAGTGGGGAGTTCGGGGGAGAGCAATGCTGGCAGTAATGCTGCTTACGAAACTTAA | 4772 |
| | 3 | MLLTKLKSLKQEK* | 4773 | ATGCTGCTTACGAAACTTAAATCTTAAAGCAGGAAAGTAG | 4774 |
| | 4 | MEGERGGGEGTGWADGDEAATGAAAASSKRRLSSVLHFRGD* | 4775 | ATGGAGGGAGAGGCGGGAGGAGAGGCAGCAGCGAGTTCAAAAAGGCGCCTCAGTTCCGTCCGTCCTTCACTTCAGAGGAGACTGA | 4776 |
| | 1 | MPHLELFTVRFRREISGRLPGAAGTHACARAHTHTHTCVCAPPPHPRPPKSQTFLLSPEATIPNPASCSASPTL* | 4777 | ATGCCACATCTGAAACTGTTTACAGTGCGATTCCGCCGAGAAATCAGTGGCGCGCTTCCTGGTCTGCGCCCCCTCCTCCCCACGCGTCGCGCGCACCCCGACCCCAAAGAGTCAGACATTCCTCCTGAGTGTGTCGCGCCCCCTCCTCCCCACGCGTCGCGCGCACCCCGACCCCAAAGAGTCAGACATTCCTCCTGAGCCAGAAGCCACGACCACGAGCCTCTGCTCCCCCACTCTTTAG | 4778 |
| hsa-mir-199a-1 | 2 | MRAGPSLATSEGTERIVSGRVVVSLAAQRC* | 4779 | ATGCGAGCGGCGCCTTGCCTGTTCCTTGGCGCTGCTCAGAGGTGCTGAAAGAGTGTGGTTCCTTGGCGCTGCTCAGAGGTGCTGA | 4780 |
| | 3 | MDSRPRQPSVQTTCSGGSQCVQ* | 4781 | ATGGATAGCGGCCGCCAGCCCAGCGTGTTCAGACTACCGTTCAGGAGGCTCTCAATGTGTACAGTAG | 4782 |
| | 4 | MCTYVCTLVRLGLGERLVETGPPNSPAGECHFPPPRFPLWQSLA* | 4783 | ATGTGTACAGTAGTCTGCACATTGGTAGGCTGGGCTTGGTGAGCGGCTCGTCGAGACAGGCCCCCAAACTCGCCGGCAGGTGAGTGCATTTCCACCACCCGTTCCCACTGTGGCAGAGCCTCGCATAG | 4784 |
| | 1 | MHRKEGSYHFQGIALIARYI* | 4785 | ATGCATAAAGAAGGTAGTGTAATCTTTCAGGGAATTGCCCTAATAGCAAGATATATATAG | 4786 |
| hsa-mir-199a-2 | 2 | MCVCVCVCVCV* | 4787 | ATGTGTGTGTGTGTGTGTGTGTGTGTGTGTAA | 4788 |
| | 3 | MKSSGLDIFVLVFI* | 4789 | ATGAAGAGTTCAGGCTGGACATATTGGTTTCTTGTTTCATCTGA | 4790 |
| | 4 | MVEKHLYFKRCFAKPLMLSKLLYEK* | 4791 | ATGGTGGAGAAGCATCTTATTTTAAAAGATGTTTGCAAAGCCTCTTATGCTTTCAAAATTACTATATGAAAAGTGA | 4792 |
| hsa-mir-199b | 1 | MGLKRPPDGQTLLPGWTRGHLHSVYPVFRLSVQDSQIVQ* | 4793 | ATGGGCTGAAGCGCCACCGGATGGACAGAGACATCTGCTGCTGGATGGACCAGAGGACACCTCCACTCCGTCCGTTCAGGACTCCCAAATTGTACAGTAGTCTGCACATTGGTTAG | 4794 |
| | 2 | MDRHCCLDGPEDTSTPSTQCLDYLRTPKLYSSLHIG* | 4795 | ATGGACAGACACTGCTGCCTGGATGGACCAGAGGACACCTCCACTCCGTCCGTTCAGGACTCCCAAATTGTACAGTAGTCTGCACATTGGTTAG | 4796 |
| | 3 | MDQRTPPLRLPSV* | 4797 | ATGGACCAGAGGACACCTCCACTCCGTCACCAGTGTTTAG | 4798 |
| | 4 | MDGGATLCGTGWG* | 4799 | ATGGATGGGGGTGCTACCCTGTGTGGGACTGGTTGGGGTAG | 4800 |

| | | | | |
|---|---|---|---|---|
| | 4 | MFLRGGLHGGEGGGHGKDCAPPPIVPGLGLGPRATGTAAAEPPPLWAGLGGAGGHKGGAARPRPRTRASAPPVAARLPPGNGLGGLPRPAGPDSDPPPPGGYAENRRAALPLVRHVLPARAP* | 4815 | ATGTTCCTGCGGGCGGGCTGCGGGGGTGAGGGCGGGACATGGCGGCGACTGCGGCGCGCCGCCGATTGTCCGCCCCTCTGGGCGGGCCTCCGGCCTGAGGCTGCGACGGGCACCGCGGAGGGCGGCGGCCGCCCGAGCCCGCTCCCCGCACTCGGGCTCCGGGGGCTGCCTCGGCGCCGCCGCGTCCGCGCGAGGCGGCTGCCGCCGGGGAAACGGGTTGGGGGGGTTGCCGCGGTCCGGCGGGGCTGACTCTGACCGACATGTGCTGCCGCCCCGGACTCGTAGTGCGGACATGTGCGAATAG | 4816 |
| | 1 | MGGGE* | 4817 | ATGGGGGGTGGCGAATAG | 4818 |
| hsa-mir-19b-2 | 2 | MSCLMNC* | 4819 | ATGTCTTGTTTAATGAACTGCTAA | 4820 |
| | 3 | MSLLGSYFYLFPLIG* | 4821 | ATGTCACTCTTGCAACCTTCTTTCCTGTCTCTCTGCCTTCCAACCAAGACACATAG | 4822 |
| | 4 | MISSFPTFPCLSNQDT* | 4823 | ATGATTTCATCTTTTCCAACCTTCTTCGTCTCTCTGCCAACCAAGACACATAG | 4824 |
| | 1 | MGCRQPGQRPGELRSLQTQAGAGPSPPQCKVGPCADAAGFRVWSHLGPTGCVFRARAQCVGSRHGVPSGQGLGRGQAPRGVTFLPPT* | 4825 | ATGGGCTGTCGCCAGCCTGGCCAGCGTCCAGGGAGCTCCGGTCACTGCAGACACAGGCTGAGCGGGTCCTTCCCCCCCAGGGAAAGGTGGGCCCTGCGCAGATGCGGCTGGGTTTCGAGCGGTGTGGAGCTCAGGATGGGACCACGGGACCGCTGTCCGGGCAGGAATGTGTGCGAGAGGGTCACGTTCTTGCCGCCTACCTGA | 4826 |
| | 2 | MRLGFGCGAILDPRAASSGHGHSVWAPGMGCPQGRAWAEGRLREGSRSCRLPDSRPSRKFSPEAATAVLRHFVRRREAVASEVGA* | 4827 | ATGCGCGGCTGGGTTTCGGGTGTGGAGCCATCTTGACCCACCAGGGCTGCGTCTCCGGGACGGGCACAGTGTGTGGGGTCAGCATGGGGTGCCCTCAGGGCAGGGCCTGGGCTAGAAAGTTCTCTCCAGAAGCAGCAGCAGCACCGCCGTCTGAGGCACTTGTCGGAGACCTAGAAAGTTCTCTCCAGAAGCAGCAGCAGCCCGCGTCGACGTGGCGTAG | 4828 |
| hsa-mir-200a | 3 | MTASPLGSGVCGGKGLVSAPSGQRPAEPMGGEVGAWGRGWSGTGGAQPGEAGAGSQAPRYDWGGGNVSREVFYLNVKRLSTVAAAGNKVRPTEAQP* | 4829 | ATGACCGCGCTCCTTGGCTCTGGAGTCTGCGGTGGAAGGGCTTGGTTTCAGCACCCTCTCCTTGGCGCCTCATGGGACCACGGGGCAGGTTCTGCAGGCCCTCTGCTGACTGGGGTGGGCAACGTCTCTCGTGAGGTTTTTACTTAAATGAAAACGGTCCGGGAAACAAGGTCCGACCACCCCAAGGCCCAGCCTTGA | 4830 |
| | 4 | MTGVGATSLVRFFT* | 4831 | ATGACTGGGGTGGGCGCAACGTCTCTGAGGTTTTACTTAA | 4832 |
| | 1 | MGCRQPGQRPGELRSLQTQAGAGPSPPQCKVGPCADAAGFRVWSHLGPTGCVFRARAQCVGSRHGVPSGQGLGRGQAPRGVTFLPPT* | 4833 | ATGGGCTGTCGCCAGCCTGGCCAGCGTCCAGGGAGCTCCGGTCACTGCAGACACAGGCTGAGCGGGTCCTTCCCCCCCAGGGAAAGGTGGGCCCTGCGCAGATGCGGCTGGGTTTCGAGCGGTGTGGAGCTCAGGATGGGACCACGGGACCGCTGTCCGGGCAGGAATGTGTGCGAGAGGGTCACGTTCTTGCCGCCTACCTGA | 4834 |
| | 2 | MRLGFGCGAILDPRAASSGHGHSVWAPGMGCPQGRAWAEGRLREGSRSCRLPDSRPSRKFSPEAATAVLRHFVRRREAVASEVGA* | 4835 | ATGCGCGGCTGGGTTTCGGGTGTGGAGCCATCTTGACCCACCAGGGCTGCGTCTCCGGGACGGGCACAGTGTGTGGGGTCAGCATGGGGTGCCCTCAGGGCAGGGCCTGGGCTAGAAAGTTCTCTCCAGAAGCAGCAGCAGCACCGCCGTCTGAGGCACTTGTCGGAGAC | 4836 |
| hsa-mir-200b | 3 | MTASPLGSGVCGGKGLVSAPSGQRPAEPMGGEVGAWGRGWSGTGGAQPGEAGAGSQAPRYDWGGGNVSREVFYLNVKRLSTVAAAGNKVRPTEAQP* | 4837 | ATGACCGCGCTCCTTGGCTCTGGAGTCTGCGGTGGAAGGGCTTGGTTTCAGCACCCTCTGTTGCAGGCCGGCCAGCCATGGGCGGTGCCCATGGGGCGTGGGGCTCAGCGCGGGGCAACGTGGAGAAGCTGAGCCGGTTCCCAGGTGAAACGGTCTCTGTGAGGTTTTTTACTTAAATGTGAAACGGCTCAGTACGGTGAGCGCAGCGGGAACAAAGGTCCGACCACCAGCAGAGGCCCAGCCTTGA | 4838 |
| | 4 | MTGVGATSLVRFFT* | 4839 | ATGACTGGGGTGGGCGCAACGTCTCTGAGGTTTTACTTAA | 4840 |

Figure 1 (Continued)

| | | | | |
|---|---|---|---|---|
| hsa-mir-200c | 1 | MAGGHTCAQGGRRGPGKEPALAARQAEKEGGRAEAR AGSRPWNLGP* | 4841 | ATGGCAGGAGGACACACCTGTGCGCAGGGTGCAGGCGGGGCCAGGTAAGGAGC CTGCGCTGGCTGCCGGCCAGGCGGGAGAAGGAAGGAGGAAGCGGAAGCGGAAGGCCAGGGC GGGCTCTAGGCCGTGGAATCTGGGCCTTAA | 4842 |
| | 2 | MRVGKSVCVAGRERLPGVGEGGSEAAGRRSRGFGGPA WTATWAS* | 4843 | ATGAGGGTGGGTAAATCGGTGTGTGCCGGGTGCGGGTTGGGAGAAGCTGCCRGGGGTAGG GGAAGGTGGCTCAGAGGCGGCGGGCCGACGGTCGGAGGGGCTTCGGAGRGCCTGCTT GGACTGCAACCTGGGCCTCGTGA | 4844 |
| | 3 | MGARDLQLFRRDPGREAA* | 4845 | ATGGGAGCCAGGGATCTGCAGCTTTCCCAGGGATCCTGGTCCTGAAGCTGCCTGA | 4846 |
| | 4 | MMEAPVPVSATSIASGPQPLAGCSPLPTSHAPRRPLVLS* | 4847 | ATGATGGAGGCCCCTGTCCTGTCAGCAACCATCATGCGCTCAGTGCCCAGCCC TTAGCTGGCTGCAGCGCCCCCCACTCCCACGCACCCTCGTCTG AGCTGA | 4848 |
| hsa-mir-202 | 1 | MRAPLGGGLHFSAGRWWVPLTSPGVYFCMCEP* | 4849 | ATGAGGGCTCCCCTTGGGGCGGCTGCATTTCTCAGCGGGAAGGTGGGTGGGT GCCCCTCACATCCACCTGCGTTTATTTTGCATGTGTGAAATATAA | 4850 |
| | 2 | MGTYGPKLTAE* | 4851 | ATGGGAACATATGGTCCGAAACTCACTGCTGAATAA | 4852 |
| | 3 | MVRNSLLNNVLS* | 4853 | ATGGTCCGAAACTCACTGCTGAATAATGTGCTGTCATGA | 4854 |
| | 4 | MCCHEIYFKMPLIEYNLG* | 4855 | ATGTGCTGTCATGAAATTTACTTCAAAACCCCTCACGGAGTACAAATCTGGGTAG | 4856 |
| hsa-mir-203 | 1 | MQRWQGLSSLLYHQELCMPQKSLSLPERQFPQLQNENN KTFLIPFPGWLRWLSHTRPMWKCLGGPSDLVAVFWSG AHLGS* | 4857 | ATGCAGCGATGGCAAGGCCTGTCATCCCTTCTCTACCACCAAGAGCTGTGCAATCCC CAGAAGTCACTGTCCGTGCCTGAGCCTGAGTTCCCAACTGCAAATGAAAATAAC AAAACCTTTCTGATTCCTTTCCCTTCCAGGGTGGCTGCGTGGTTGAGCCACGGGCCC ATGTGGAAATGTCTGGGGGTCCCAGATCGTGGTGTTCTGGTCTGGGGCT CACCTTGGCTCCTGA | 4858 |
| | 2 | MARPVIPSLPPRAVQSPEVTVPP* | 4859 | ATGGCAAGGCCTGTCATCCCTTCTACCACCAAGAGCTGTGCAATCCCCAGAAGTC ACTGTCCCTCCCTGA | 4860 |
| | 3 | MKJTKPF* | 4861 | ATGAAAATAACAAAACCTTTCTGA | 4862 |
| | 4 | MSGGSLRSGGCVLVWGSPWLLSTWLLAGWAGGGMAC HRPALE* | 4863 | ATGTCTGGGGGTCCTCCAGATCTGGTGGCTGTTCTGGTCTGGGGCTCACCTTGG CTCCTGAGCACTTGGCTGGCTGGGCGGTGCGTGGGATGGCGTGTCACGGC CCTGCACTGAATGA | 4864 |
| hsa-mir-204 | 1 | MGKKWRDAAEMERGCSDREDMAESRRRSRSASRGRFA ESWKRLSSKQGSTKRSGLPSQQTPVSGRGRAPVFAPFSP FARDLSPFHGAELASLRVRARELVAPLLMK* | 4865 | ATGGGAAGAAGTGGAGGATGGCGGCGAAATGGAGCGCGGCTGCTCGACCGCG AGGACAACGCGGAGATGGAGCGCGGCTGCAGCGACCGGGAGGACATGGCAGAGTCTCGGCC GAGTCGTGGAAAAGGTTAAGTTCCAAGCAGGGTTCCACCAAACGCTCGGGACTCC GTCGCAGCAGACCAGCCGGTGAGTGAGCGCGACTTGAGCCTTTCATGTGTGCTGAACTTGCTCCTAAGGGT TCCCTTCGCACGGAACTGTGGCGCGCTTCTAATGAAATAG | 4866 |
| | 2 | MRRKWSGAAPTARTTRRAADAAGAPAGAGLPSRGKG* | 4867 | ATGCGGGCGGAAATGGAGCGGGCGGGGCTGCTCGACCGCGAGGACAACGCGGAGAGCCG CAGAGCGCAGCCGGGAGCCGACGCCGGGCAGGTTTGCCGAGTCGTGGAAAAGGTTAA | 4868 |
| | 3 | MVLNLPP* | 4869 | ATGGTCTGAACTTGCCTCCTAA | 4870 |
| | 4 | MFERRGGSLLDHKSFAVNRACETLSSVL* | 4871 | ATGTTCGAGAGGCGAGGGGGCTCGCTGTTAGATCATAAGAGTTTTGCAGTTAACAG AGCGTGTGAGACGTTGTCGAGTGTATTGTGA | 4872 |
| hsa-mir-205 | 1 | MLPRLVLNS* | 4873 | ATGTTGCCCAGACTGGTCTTGAACTCCTGA | 4874 |
| | 2 | MFFFIKERNQLPRTGPHLSSGVISVPHRPAELGALYRVS VSHFLFPVLKP* | 4875 | ATGTTCTTTTTCATTAAAGAGAAATCAACTATTCAGGACCGGCCCCCACCTTCT CAGGAGTCATTTCTGTTCCGCACAGGCCTGCTGAACTGGTGCTTTATATAGGGTAA GTGTTTCTCATTTTTGTTCCCTGTCTTCAAGCCTTAG | 4876 |
| | 3 | MAVAISLFCHL* | 4877 | ATGGCTGTAGCCATCTCTCTGTTCTGCATTATCTTAAGA | 4878 |

Figure 1 (Continued)

| | | | | | |
|---|---|---|---|---|---|
| | 4 | MTKKKNSYFRANSKLGPDVSRHRYYSYLKVSLKSVDLG NFGKTKMSQ* | 4879 | ATGACAAAAAAGAAAATTCTATTTGAAGCAAACTCAAACTAGTCCTGATGTC TCAAGGCACAGGTACTCGTACTTAAAGGTGAGTCTGAAATCTGGATTGGGGAAC TTTGGAAAAACAAAGATGAGTGGCTAG | 4880 |
| hsa-mir-206 | 1 | MLHFSLRS* | 4881 | ATGCTAATAATATTTCCCTGAGAAGCTGA | 4882 |
| | 2 | MKGPCTWGRVGISYCSTGFCCKH* | 4883 | ATGAAAGGCTTTGTATTGGGGGAGGTGGAATTTCTACTGTTCAACAGGTTTT TGTTGTAAACATTAA | 4884 |
| | 3 | MWEGVPLLSQEGGQAPGSLRSPFS* | 4885 | ATGTGGGAGGGAGTGCCACTTCTGTCCAGGAGGAGGCCAGGCACCAGGCAGCCT GCATTCACCATTCTCCTGA | 4886 |
| | 4 | MWGPPSQFSFK* | 4887 | ATGTGGGGACCTCCCTCCAATTCTCCTTCAAATGA | 4888 |
| | 1 | MPCSPSTEPPP* | 4889 | ATGCCCTGCAGCCGTCCAGAGCCCCACCGTGA | 4890 |
| | 2 | MLSPSFHLPSSPGWLPSLDPGFILPLGLHRHLSQSCPFVS LPCPSFLARVLTSLPLCF* | 4891 | ATGTTGTCTCCATCTTTCCATCTTCCTCTCTTTGGATGGCTTCCTTCCCTTGATCC TGGTTTAPCTTGCCTCTTGGTCTTCATGACACTTGTCACAATCATGCTTCTTGTC TTCTCCCTTGTCCTTGTCCTTCTTGGCACGTGTTCACCTCCGTCCTCTGCTTCTA A | 4892 |
| hsa-mir-208 | 3 | MASFP* | 4893 | ATGGCTTCCTTCCCTGA | 4894 |
| | 4 | MLLCLSPLSFLLGTCSHLPASLLLTLFPHPVPRTHIDSVPF LFCLCVFPPLTPWSVLPVCALGLPPSPGGLPLLFFTLLICS SLCPALPLLFLAPPTVQILQDSP* | 4895 | ATGCTCTGTGCTCTCCCCTGTCCTTCCTTCTGGCACGTGTTCACCTCCGTCC CCTTTCTTTTCTGGGCTCCTCTAACCTGTTCCACACCCGTCCCTCCACTAATGACTCGGTC CCCTTTCTTTTCTGCCTCTGCGTCTTTCCGTCTTCTGACTCCCTGGTCTGTCTGCCTGT CTGGCGCTCGGGCCTGCCTCCATCCCCCGGGTGGCCTCGGTCCTGTGTTCTTCACTCTC CTCATCTGTTCTTCTCTGCCCGGCTCTACCTCTTGTTCCTGCTCCACCCACGG TCCAGATTCTTCAGGATTCTCCGTGA | 4896 |
| | 1 | MNPMPGRRGKGWGGVGVG* | 4897 | ATGAATCCATGCAGGGAGGCACTGTGCAGCGACTGCAGCGATGCTTCTGCAACC CCCAGTCCCAATCATTAA | 4898 |
| | 2 | MAVGTVPATAQPSAMPSATSAISPCHLQPPTCTPAPQP PVPNH* | 4899 | ATGGCGGTGGCACTGTGCCAGCACTGCCAGCCAGCGATGCCTCTGCAACC CCCAGTCCTATTTCCCCTGCAGAGAGTTCCTAAGGAGCCAGTCGATGGCTTCTGCAACC CCCAGTCCCAATCATTAA | 4900 |
| hsa-mir-208 | 3 | MLINPTGQAARLGVQRGCEEK* | 4901 | ATGCTAATTAACATTCCTACAGGGCAGGCTGCCAGGCTGCAGAGGCGATG TGAAGAGAAGTAG | 4902 |
| | 4 | MGEEGEPVFLEEQRGGKENPKEG* | 4903 | ATGGGGGAGGAGGAAGAGAGCCAGTCTTCTAGAAGAACAGCGGGAGGGGAAAG AGAACCCAAAAGAAGGATGA | 4904 |
| | 1 | MQDPMQSTRSSHWAHMCRSKHCRMQHRSS* | 4905 | ATGCAGGACTTCATGCAGGTACAGAGTACCAGGAGCACACATGCAGGTCT AAACATGGCGTATGTGCCACAGGAGTTCCTAG | 4906 |
| | 2 | MGVCATGVPRGRYLHLSIWDQYALQGVCVCVCVCVC VDKPA* | 4907 | ATGGGCGTATGTGCCACAGGAGTTCCTAGGGAGAGATATCTGCATCTGAGCATATG GACCAATATGCATTACAGGGTGTGTGTGTGTGTGTGTGTGTGTGTGGA CAAGCCTGCATAG | 4908 |
| hsa-mir-208b | 3 | MGPICITGCVCVCVCVCVCGQACIV* | 4909 | ATGGGACCAATATGCATTACAGGGTGTGTGTGTGTGTGTGTGTGGACAAGCCTGCATAGTCTGA | 4910 |
| | 4 | MHYRVCVCVCVCVCVCVWTSLHSLNVRKGMYLTD* | 4911 | ATGCATTACAGGGTGTGTGTGTGTGTGTGTGTGGGACAAGCCTG CATAGTCTGAAATGCAGAAAAGGTATGTACTCACTGACTGA | 4912 |
| | 1 | MNPMPGRRGKGWGGVGVG* | 4913 | ATGAATCCATGCAGGGAGGCACTGTGCAGCGACTGCAGCGATGCTTCTGCAACC CCCAGTCCCAATCATTAA | 4914 |
| | 2 | MAVGTVPATAQPSAMPSATSAISPCHLQPPTCTPAPQP PVPNH* | 4915 | ATGGCGGTGGCACTGTGCCAGCACTGCCAGCGATGCCTCTGCAACC CCCAGTCCCAATCATTAA | 4916 |
| hsa-mir-208b | 3 | MLINPTGQAARLGVQRGCEEK* | 4917 | ATGCTAATTAACATTCCTACAGGGCAGGCTGCCAGGCTGCAGAGGCGATG TGAAGAGAAGTAG | 4918 |
| | 4 | MGEEGEPVFLEEQRGGKENPKEG* | 4919 | ATGGGGGAGGAGGAAGAGAGCCAGTCTTCTAGAAGAACAGCGGGAGGGGAAAG AGAACCCAAAAGAAGGATGA | 4920 |

Figure 1 (Continued)

| | | | | | |
|---|---|---|---|---|---|
| hsa-mir-20a | 1 | MVAATPQESARPSGDGGKPVVCGPGLAGGAERPGAD WPGAAWRRRGRGGSRPLAAPACGSRIWLPPRSPAGRR RGACPGREGGKGRRARGRARDPRRPCLGRPEGGWAD GEHNGPSGRGRARPVPSPGPGARAGRGVSG* | 4921 | ATGGTGGCGGCTACTCCTCCTGGTGAGTCTGCCGCCCTCCGGCGACGGAGGGAA ACCTGTTGTGCGGCCCGGGTTGCGGCGGCCGGGTTGGCGGGGCTGCCGGGCGACT GGCCCGGGGCAGCGTGCTGGCGGCGGCGGCTGCCGGGGCGGTTCTGGCGTTGCC CCCCGGCGTGTGGCAGCCGCATCTGCTGCCCCTGCTCGCCCGCGGGCCGGCG GAGGGGCAGRCCGGGGCAGAGCGTGCAGTGCGGAAGGGGCGCAGGTGCCGGCGC CGCCCCGGACCCGGCAGCCTGCCTGGCGCAGATCCTGGCGAGAGGACCTGCCCCG CGGCGAACACAATGGCCCTCGGCGGGGCGTGCGAGGGCCCGTGCCTTCTCCGG GGCCCCGGGCGCGCGCGGGGCGTGGGGTCTCTGGGTAG | 4922 |
| | 2 | MAPRGHEDYRGPCLLRGPGRARGVGSLGRKVSPEGES* | 4923 | ATGGCCCCTCGGGGAGAGGACTTGCGAGGCCGTGCCTTCTCCGGGGCCCGGGCG CGCGGGGCGTGGGGTCTCTGGGTAGGAAAGTTCTCCGAGGGCGAGAGTTAA | 4924 |
| | 3 | MGQAAGREGARPKGTCAPAGGVAWAGARGSPNFVRA RVGGGAPRSARPGRHPRSAWALLARVGSLGAGPATSPP WPSEEAAVGLSRGVEPPAPGRLLGVWRGRASPARRERR PRRHVPAGRAARG* | 4925 | ATGGGGCAGGCCGCGGGCCGGGAGGGGCCGCGCCCACGAGGTACCTGCGCGCAG CGGGGCGTGGCGTGGGCGGGAGCCCGGTTCCCAAACTTGTACGCGGAGG GTGGCGCCCAGGGGCCCCCGTGGCGAGATCGGGGCCGCCACCCCGGCTCCCGCGTG GGCTTTGTTAGCCCGGCGAGTCGCAGCCTCAGCCGCGGCGTGAGCCTCGCGCCCG GCCCTGGAGGAGGCCGCGAGTGCAGCGCTCAGCCGCGGCGTGAGCCTCGCGCCCG GCCGCTTGCTGGGAGTGTGGCGCGGAAGGCCAGCCGCTGCGCGGGAGGCGCGT CCCCGCGCCATGTTCTGCCGGGGCTGCACCGGGGTGA | 4926 |
| | 4 | MFLRGGLHGGEGGGHGGDCAPPPIVPGLGLGPRATGTA AAEPPLWAGLGGAGGHKGGAARPRPRRTRASAPPVA ARLPFGNGLGGLPRPAGPDSDPFPPGGYAENRRAALPL VRHVLPARAP* | 4927 | ATGTTCTGCGGCGGGCTGCACGGGGGTGAGGGCGGGGACATGGCGGCGACTG CGGCCGGGGAGCCCCTGGGCTGGGCGGGACTAAGGCGCGGCCTCGGGAGGGCGGC CGGCGGGCGCGCGCGGAGCCCCGCCCCGGCTCTCCGGGCTCGCACTCGGCCGCCGTCCC GGAGGGCGCGGCGGCTCCGCGAATCGGGTTGGGGGGTTGCCGCTCCGGCGGGCTG ACTCTGACCGCACATGTGCTGCCGGCCCGGGCTGCCATGA TGTGCGACATGTCGTGGGGCTCCATGA | 4928 |
| | 1 | MGGGE* | 4929 | ATGGGGGGTGGCGAATAG | 4930 |
| hsa-mir-20b | 2 | MSCLMNC* | 4931 | ATGTCTTGTTTAATGAACTGCTAA | 4932 |
| | 3 | MSLLGSYFYLFPLIG* | 4933 | ATGTCACTCTTGGGAGTTACTTCTACTTGTTCCTTTAATAGGATGA | 4934 |
| | 4 | MISSPTFFCLSWQDT* | 4935 | ATGATTTCATCTTTCAACCTTCTCTGTCTCTCAACCAAGACACATAG | 4936 |
| | 1 | MTAEQNKYIL* | 4937 | ATGACAGCAGCAGAACAAATAAGTAAGTACATCCTATAA | 4938 |
| | 2 | MLHPLIFF* | 4939 | ATGCTCCACCCGTTAATCTTTTTTAA | 4940 |
| hsa-mir-21 | 3 | MWPFMWPRLFSNSWAQAHLSQPPKVLDYKLSHRAGS AVYNRKKQTNLSQHFSDP* | 4941 | ATGGCCCCCTATGTGGCCAGGCTGTTCTCAAACTCCTGGGCTCAAGCAATCCTC CTGTCTCAGCCTCCAAAGTGTTGGATTACAGGTGGATTACAGGCTGAGCC GTTTACAACGGAAAAAAACAAAACTTTCCCAAATCTTCTCTGACCCTTAA | 4942 |
| | 4 | MVPGVCQ* | 4943 | ATGGTGCCTGGGGTATGTCAGTAA | 4944 |

Figure 1 (Continued)

| | | Protein | SEQ ID | Nucleotide | SEQ ID |
|---|---|---|---|---|---|
| hsa-mir-210 | 1 | MDGVCLSGQQGRRVGVSEIRGLCCPLGGAEAGPDTLLEGTFPSLCCVQGTSVRSSCCQAEGGPGGAQVWSYLQPTGPSSGGPPLGTSYGKRVTDLVLLCVSAASVGPLRETAGGSSSSLSAFPAFSSLLLKSGPGRVRAYRPCLRSPGLQELRAAPARWRGRGRFSGRLAWTRTGLWKLPALTGLPVTTAK* | 4945 | ATGGACGGGGTGTGCCTCTCTGGCCAGCAGGAGCGGGGGTGGGGTAAGCGAAATCATTCGGGGGGCTTTGCTGCCCCTCGGTTGTGTCCAGGGACGGGGGGCTGAGGCTGGGCCAGATACCCTCTTGGAGGGAACTTCTTTCTTGTCGTCCAGGGCACAGGTGTGGTCATATCTCAGCCAACTTGCCAAGCTGAAGGTGGCCCTGGCAGGCACAGGTGTGGTCATATCTCAGCCAACAGGACCATCTCCGGAGGGCCACCTCTGAGGACTTCTACGGGAAGAGAGTGACAGATTTGGTGCTTCTGTGTTCTGCCGCCTTCAGTGGCCGTCCGGGAGACAGCCGGGTGATCCTCCAGCAGCCTGTCTGCTGCTGAGCCTGTCTGAGCCTCTCAAGTCTACTGTTAAATCAGGACCGGGTCGTGTCCGAGCCTACAGGCCCTGTCTCCGCTCCCCAGCCTGCAGGAGTTGAGGGTGCACCTGCTGCGTGGAGAGGGAGGCAGATTTAGTGGACGCCTGTGCATGGACTCGGACTGGCCTTTGGAAGCTCCCTGACGGGGTTGCCTGTCACCACACTGCGAAGTGA | 4946 |
| | 2 | MDSDWPLEAPCPDGVACHHCEVRLGRTCT* | 4947 | ATGGACTCGGACTGGCCTTTGGAAGCTCCCTGACGGGGTTGCCTGTCACCACACTGCGAAGTGA | 4948 |
| | 3 | MSRNSGRGGSQRRPSIQPGSALCPYLHQVGSLPCIAWGLAGLGPALLWNWMFSGSPAFPHVATVHNIVFKVQFKTQK* | 4949 | ATGAGTAGGAACTCTGGCCGAGGAGGGTCCAGCGCCGCGCCCCTCGATACAGCCTGGCTCTCTGCCCCTCTGGCGTACTTACACCAGGTGGGATCCCTGCCTGCATTGCCTGGGGAGTTGGCTGGGCTTGGGCCCGCCTGGGAACTGGATGTTTCAGGAGCCCAGCCTTTCCTCATGTCAACACAGTTCACAATATAGTTTCAAAGTACAGTTTAAAACTCAAAAGTAA | 4950 |
| | 4 | MSTQFTT* | 4951 | ATGTCAACACAGTTCACAATATAG | 4952 |
| hsa-mir-211 | 1 | MRAQAQVLTCSSWGLLLLLKGGPSSPSSLPWPRRRLKEPELCPLHSTAVAGKLRCG* | 4953 | ATGAGGGCCCAGGCGCCAAGTGCTCACATGTCTCCTCATGGGGACTGCTCCTCTTAAAGGGTGGCCCCTGCTCACCAGCTCCTGCCCTGCCAAGGAGGAGGCTGAAGAGCCTGAGCTGCCCCTTCCAATTCCACTGCTGGCAGGTAAGCTCAGATGCGGGTAA | 4954 |
| | 2 | MLLMGTAPLKGWALLTQLPALAKEEAERA* | 4955 | ATGCTCCTCATGGGGACTGCTCTCTTAAAGGGTGGGCCCTCCTCACCCAGCTCCCTGCCCTGGCCAAGGAGTAAGCACAGGTGAAGGAGGTCAGGTGCAGGTATCCTCAGGTGTGGGTAA | 4956 |
| | 3 | MRVSTGEGRSGAGHLRCG* | 4957 | ATGCGGGTAAGCACAGGTGAAGGAGGTCAGGTGCAGGTATCCTCAGGTGTGGGTAA | 4958 |
| | 4 | MQLSSGVGNLRCR* | 4959 | ATGCAGTTAAGCTCAGTGTTGGTAACCTCAGGTGCAGGTAG | 4960 |
| hsa-mir-211 | 1 | MHPCMLVCAQNCTHAPINNGCLEYGVRRKCEYPCPPVIDLFVNYCNFLHQALTLVDRWVGNR* | 4961 | ATGCATCCGTGCATGTTGGTATGTGCCAGAACTGTACACGCACCATTAACAATGGCTGCCTGAAGTGCCGGAAGGTAAGAAGGGTAAGAAGTGTGAGTATCCATGTCCCTTTGTGATAGATTTATTTGTGAATTACTGTAACTTCCTACATCAGGCACTGACACTTGTGGACAGGTGGGTAGGTAATAGGTAG | 4962 |
| | 2 | MCPELYTRTH* | 4963 | ATGTGTCCAGAACTGTACACGACGACCATTAA | 4964 |
| | 3 | MAAWK* | 4965 | ATGGCTGCCTGGAAGTAG | 4966 |
| | 4 | MSLCDRFICELL* | 4967 | ATGTCCCTTTGTGATAGATTTATTTGTGAATTACTGTAA | 4968 |
| | 1 | MNEPPHEYYARL* | 4969 | ATGAATGAGCCGCCACGAGTACTACCGAGTACTACGCGCGCTATAA | 4970 |
| | 2 | MSRRTSTTRAYKSRRAGGAAGGDRAVATRPAR* | 4971 | ATGAGCCGCCGCACGAGTACGGGCAGTGGGACGGGGAGGCGGCCGCCATAAAAGCGCCGCGGCCAGGC | 4972 |

Figure 1 (Continued)

| | | | | |
|---|---|---|---|---|
| hsa-mir-212 | 3 | MCGHGREDEEGTGRRRVGRPLRGGDGGRGAPGSPRG CGAGARDDTSPRSTCRRPMDTQLLRRSIEWRTDLGDPP PAFLGLLRHSPRKVRRRCWRPRRRAPSSPSLRRGHDSASL PGPAERGCRRETDAHPRFPGSPPGTPAPHGVGRPFPAGPV QRYPRRPRLPASASGAVLSGPGGRGLPGPAPPPRPRRKC PLWDFDVTAL* | 4973 | ATGTGCGGACACGGACGGAGGAGGACGAGGAGGGACGGGCAGGCGGCGGGTGGGGC GCCCCCTCCGGGGTGGCGGGATGGGGGCGGACGGCAGGGCCACCGGCGTCCCTCGCGGC TGCGGAGCCGGACCCAGAGACGGACGACAGCCGCGCAGCAGCCGCGCACCTGCCGGCGCCGAT GGACACGCAGCTACTTCGGAGGAGCATCGAGTGGAGGACCGACCTGGGAGACCCC CCCCGGCTTTCTTGGGGCTCCTGCGCCATTCTCCGGCCCCTCCTGCCTCCAGGAAAGTGAGGCGAAGTGCT GGCGCCCAAGGAGACCGGCCGCCCCTCCTCCCTGCCGCGGTGACGGCGGGTGACTCAGCCT CGTGCCCGGCGCGCGGCTGAGCGGGGTGCAGGCAGGGAGAGACGGACGCCACCCCGC GTCCCGGACCCTCCTGGGACCCCGCATGGCGTCGGGCGTCGGGCGCCCCTTCCGGCA GTCCTCCAGCGCGGGGCGGTCCTCCAGCGACCTCCCGCTTCCGGCTGGAGGGAGCT GTCGTCCAGGGACGCGGGCGGGCGGGGCCTCCAGGACATCTTTGACGTCACGGCCCTGA CCGCCGAAGTGCCCCTCTGGGACACTCTTTGACGTCACGGCCCTCTGA | 4974 |
| | 4 | MGADGGHRGPLAAAEPGHETTRARAAPAGARWTRSYF GGASSGGPTSETPPRLSWGSCAHPGR* | 4975 | ATGGGGGCGGACGGGCGGCACCGGGGGCCTCCCTGCGGCTGCCGAGCCGGGACCCAG AGACGACAGCCACGAGCCAGCACCTCGAGGAGGACAGCACCGGCGGGCCAGCTACTTC GGAGGAGCATCGAGTGGAGGACCGACCTCGGAGACCCCTCGGCTTTCTTGGGGG CTCCTGCTGCGCCATTCTCCCAGGAAAGTGA | 4976 |
| | 1 | MHKEGSYIFQGIALLARYI* | 4977 | ATGCATAAAGAAGGTAGTGTAATCTTTCAGGGAATTGCCTAATAGCAAGATATATATAG | 4978 |
| hsa-mir-214 | 2 | MCVCVCVCVCVCV* | 4979 | ATGTGTGTGTGTGTGTGTGTGTGTGTGTAA | 4980 |
| | 3 | MKSSGLDIFVFLVFI* | 4981 | ATGAAGAGTTCAGGCTGGACATCTTTATTTGTTTCTTGTTTCATCTGA | 4982 |
| | 4 | MVEKHLYFKRCFAKPLMLSKLLYEK* | 4983 | ATGGTGGAGAAGCATCTTATTTTAAAGATGTTTTGCAAAGCCTCTTATGCTTTCA AAATTACTATATGAAAAGTGA | 4984 |
| | 1 | MSTGLTEMNALDPIHLPFICSCALFSYKVDGLFRPPLGN Y* | 4985 | ATGTCTCACGGCTCACAGAAATGAATGCTCTGACCCATCACTTGCTTCATT TGTTCCTGTGCCCTTTTTCATACAAAGTGGATGGCCTCTTAGGTTTCCTTTAGGAA ATGTGTAA | 4986 |
| hsa-mir-215 | 2 | MLWTPSTCLSFVPFFHTKWMASLGFL* | 4987 | ATGCTCTGGACCCCATCCACTTGCTTCTGTTTCCTGTCCCTTTTTTTCATACAA AGTGGATGGCTAAGTGCCTCTTTAGGTTTCTTTAG | 4988 |
| | 3 | MCKCLQAFVLTLK* | 4989 | ATGTGTAAGTGCCTACAGGCCTTTGTCCTCACATTAAAATAA | 4990 |
| | 4 | MAFVTIQMNNVKYFQK* | 4991 | ATGGCATTTGTGACTATCCAAATGAACAATGTAAAGTACTTTCAAAATAG | 4992 |
| | 1 | MLTLKLITSGNNGKKEKLLGCICLENAM* | 4993 | ATGCTGACTTTAAAATTGATAACATCTGGAAATAATGGCAAAAAGGAAAAACTGTTG GGCTGCATCTGTCTTGAAAATGCTATGTAA | 4994 |
| hsa-mir-216a | 2 | MAKRKNCWAASVLKMLCNKIYLIYLKKEKCFVPQFVA TSESSRGYDPSLRKHLPPPANTPGKAVGNNKTRAS* | 4995 | ATGGCAAAAAGGAAAAACTGTTGGGCTGCATCTGTCTTGAAAATGCTATGTAATAAG ATTTACTTACTAATATATTGAAAAGGAAAAATGTTGTCCCAATTTGTTGCAACAT CTGAAAGTTCACGAGGTTATGACCCCCTCTTAAGAAAGCATCTCCACCACCTGCAA ATACCCCAGGAAAAGCAGTTGGAAACATAAAACACGTGCTAGTTAA | 4996 |
| | 3 | MFCSPICCNI* | 4997 | ATGTTTTGTTCCCAATTGTTGTCAACATCTGA | 4998 |
| | 4 | MTPL* | 4999 | ATGACCCCTCTTAA | 5000 |
| | 1 | MLTLKLITSGNNGKKEKLLGCICLENAM* | 5001 | ATGCTGACTTTAAAATTGATAACATCTGGAAATAATGGCAAAAAGGAAAAACTGTTG GGCTGCATCTGTCTTGAAAATGCTATGTAA | 5002 |
| hsa-mir-216b | 2 | MAKRKNCWAASVLKMLCNKIYLIYLKKEKCFVPQFVA TSESSRGYDPSLRKHLPPANTPGKAVGNNKTRAS* | 5003 | ATGGCAAAAAGGAAAAACTGTTGGGCTGCATCTGTCTTGAAAATGCTATGTAATAAG ATTTACTTACTAATATATTGAAAAGGAAAAATGTTTGTTCCCAATTTGTTGCAACAT CTGAAAGTTCACGAGGTTATGACCCCTCTTAAGAAAGCATCTCCACCACCTGCAA ATACCCCAGGAAAAGCAGTTGGAAACAATAAAACACGTGCTAGTTAA | 5004 |
| | 3 | MFCSPICCNI* | 5005 | ATGTTTTGTTCCCAATTGTTGTCAACATCTGA | 5006 |
| | 4 | MTPL* | 5007 | ATGACCCCTCTTAA | 5008 |

Figure 1 (Continued)

| | | | | | |
|---|---|---|---|---|---|
| hsa-mir-217 | 1 | MLTLKLIJTSGMNGRKEKLLGCICLENAM* | 5009 | ATGCTGACTTTAAAATTGATAACATCTGGAAATAATGGCAAAAGGAAAAACTGTTG GGCTGCATCTGTCTTGAAAATGCTATGTAA | 5010 |
| | 2 | MAKRKNCWAASVLKMLCNKIYLIYLKKEKCFVPQFVA TSESSRGYDPSLRKHLPPPANTPGKAVGNNKTRAS* | 5011 | ATGGCAAAAGGAAAAACTGTTGGGCTGCATCTGTCTTGAAAATGCTATGTAATAAG ATTTACTTAATATATTTGAAAAGGAAAAATGTTTTGTTCCCAAATTTGTTGCAACAT CTGAAAGTTCACGAGGTTATGACCCCTCTTTAAGAAAGCATCTCCACCACCTGCAA ATACCCCAGGAAAGCAGTTGGAAACAATAAAACACGTGCTAGTTAA | 5012 |
| | 3 | MFCSPICCNI* | 5013 | ATGTTTTGTTCCCAATTTGTTGCAACATCTGA | 5014 |
| | 4 | MITPL* | 5015 | ATGACCCCTCTTTAA | 5016 |
| hsa-mir-218-1 | 1 | MPSCPARSATGPLGFRAF* | 5017 | ATGCCCAGTTGCCCGCGCTCTGCTACGGGCCCCTGGGCTTCCGGCCTCTAG | 5018 |
| | 2 | MRGVGWQMLSLSLGLVLAHLNKVAPQACPAQCSCSGS TVDCHGLALRSVPRNIFRNTERL* | 5019 | ATGCGCGGCGTTGGCTGGCAGAATGCTGTCCTGTCGTCGGGGTTAGTGCTGGCGATC CTGAACAAGGTGGCACCGCAGGCGTGCCCGGCGCAGTGCTCTTGCTGGGCAGCAC AGTGGACTGTCACGGCTGGGCTGCGCAGGCGTGCCCAGGAATATCCCCGCAACA CCGAGAGACTGTGA | 5020 |
| | 3 | MRSSSSPLPIRAAHPCLHWRNLSAQGPVPGAALASSPPC TSWG* | 5021 | ATGCGCTCTTCGTCTCCCCTCTCCCCATCCGGCCGCTGCACCCTGCCTCCACTGGA GGAACCTGTCAGCTCAGGGTTCCGTTGCCTGGGGCAGCCCTCGCTAGCTCTCCCCAT GCACATCCTGGGGTTGA | 5022 |
| | 4 | MHHLGLSSPGGHWPGKGLCPRRGGSAGSCASSPSPALVP PLAAPCWLVLWGWGAGR* | 5023 | TCCACATCCTGGGGTTGAGCTCTCCGGCGCGCTCTGCTCCGCTCCGATGGAGCTGTG CCCGGCCACTGCAGCTCCTGCTTGCTGCTAGTTCTCGGGGCTGGGGAGCGGGTAGATA G | 5024 |
| | 1 | MRSGAAPAPPMELLLLPPPPPGAPRSARAPCA* | 5025 | ATGCGCAGCGGGGCAGCGCCGCCCCGCGCCGCGATGGAGCTGCTGTTGCTGCCGCC GCCGCCGGAGCCGGAGCCCCCGTGCCCGTGCGCTGA | 5026 |
| | 2 | MAPGWAGVGAAVRARLALALASVLSGPPAVACPTK CTCSAASVDCHGLGLRAVPRGHPRNAERL* | 5027 | ATGGCCCCCGGGTGGGCAGGGGTCGGAGCGGTCCGAGCGCTGGCGCTGGCGCTGAC CTTGCGCTGGCGAGCGCCGCCACCAAGTG TACCTGCTCGCTGCAGCTCCAGCGTGCACAGCGGCGCGAGCCGCCGGTTCCTCG GGGCATCCCGGCAACGCGAGCGCCGTGTGA | 5028 |
| hsa-mir-218-2 | 3 | MQSLFSSLPGYDPSLSELGVCRLGQJWKERSRNPQRWA KSSASPGVRVPDAGPADSFQGVAEERRGEARALQPQGL RVRVRGLRSLKRGAGEGESYRMMGRQGAEAGERARD C* | 5029 | ATGCAGTCTCTATTCTCATCCCTTCCTGGATACGATCCGTCACTTCTCCGAGCTGGGG TCTGTTAGGCTTGGTCAGATCGGAAAGAGAGTCTCCAGACGGATGGCA AAGAGCAGTGCCTCTCCAGGGGTGAGGGTTCCAGACGCAGTGCAGCT CCAAGGAGTAGCTGCAGGCGGAGGGAGGCAAGGAGCACTGCAGCTCAAGGT CTTAGGGTGAGGTCAGGGTCGCGCGTCGCTCAAGGCGGCGGAAGGAGA AAGCTATAGGAGATGGAGATGGGCCGTCAAGGCGCGGAGGCGGGAGAGAGGGCCGAGAC TGTTGA | 5030 |
| | 4 | MGKEQCLSRGFGSRRRAR* | 5031 | ATGGGCAAAGAGCAGTGCCTCTCCAGGGGGTGAGGTTCCAGACGCAGGGCCCGCTGA | 5032 |
| | 1 | MNQPMKGAGESRREGAGKRRRKGRGVCANRLWRPHK DWPRTEGEDREVGGNWGGGRGHPLLPCPRDRPPPGSR SPSPGASARAGTRCPSGSLTAPHPLALYPSHSLHSMGHA LPLPLLFPPHPLRLL* | 5033 | ATGAACCAGCCGATGAAAGGGCTGAGAGAGCAGGAGGAGGGCTGGAAGA GGAGGAGGAAGGGAGGGGGGTCTGCGTAATCGACTCGGCGCCACATAAGGAC TGGCCACGGACTGAAGGAGGAAGTAGGCGGAGCTGGGGTGGGGGC GAGGGCACCCACTGCGTCCTGTTCGCAGGAGGCGGGACAGGAGCAGGGCAGC CCAAGTCGGGAGCCTCAGCTGCGGCGGGGACAAGATGCCCATCAGGGTCTCTAAC TGCCCCCCACCCGTCGCCCGCCCGTATCCCTCATTCCTACACTCCTACTCAAGGTCTCTAAC CTGCCCCTTCCTCTTCTCCCCATCCCCTTCGTTACTCTAG | 5034 |

Figure 1 (Continued)

| | | | | |
|---|---|---|---|---|
| hsa-mir-219-1 | 2 | MPIRVSNCPPPRPVSLSFPTLNGDRSAPSSSLSSPSPSFT LESSKRLLPTSHSRHSAPVYPTHTRTPPSQWELHLVYVP VSAWCLRSPFPPVRLPPFPAPG3RGS* | 5035 | ATGCCCATCAGGGTCTCTAACTGCCCCCCCACCCCTGCCCCTGTATCCCTCATTCCC CTACACTCAAATGGAGATCGCTCTGCCCCTTCCTCTCTTTCCTCCATCCCTTC GTTTACTCTAGAGTCCTGAAGAGGCTTCTGCCACTTCCACTCCAGACATTCTGCC CCTGTATCCCCACCACACGCCGTGTCTCCAACCCCTCCAATGGAGCTCCATCTGT TATGTCCCTGTTTCCGCGTGGTTCCGTGGTCCTCCCGTGCGGCTCTCGA | 5036 |
| | 3 | MGAPSCVCPCFRVVSPFPLSSRAPPSLPRPGPRLLIVQTQ FSSLWLRPRVESGRPEPPPNLERESGSEGLGRAKAEGG GSPQGGKGNPGHGT* | 5037 | ATGGGAGCTCCATCTTGTGTATGTCCCGTTCCGTGGTGTCTCCATTCCCTT CCTTCCGTGCCGTCCCGTTCCCGCCGCCGGAGTCCTCGATTGTCAAA CGCAATTCTGAGTCTATGCCTCCGCCGGAGTTGAGTTGAGTCGCGAGCCGC CGCCCCAAACCTCGAGCGGGAGAGCGGCGTCTAGGGAGCAGCCAAAGCA GAGGGTGAGGGAGTCCCAGGGTGGTAAGGGGAATCCCGGGCACATCGGGACCTA G | 5038 |
| | 4 | MSLFPRGVSIPPLPCASLPSPPRAAAPDCPNAILESMAP AES* | 5039 | ATGTCCCTGTTTCCGCGTGGTCTCTCCATTCCCCTTTCCTCCCGTGCGCCTCCTCC CTTCCCCCCCGGCCCGGCCGCCTCCTGATTGTCCAAACGCAATTCTGAGTCTATGG CTCCGGCCGAGAGTTGA | 5040 |
| | 1 | MLVPGPGEGRGRWAKGSGRGSRRGIGS* | 5041 | ATGCTGGTTCCTGGCCAGGAGAAGGGAGCGGGTCATTCGGGAGTTGA | 5042 |
| | 2 | MGKGVRPREQAGHRELRVPSGGGRTRGPAGAEGEAAP GEGHAMSLRAA* | 5043 | ATGGGCAAAGGGGTCAGGCCAGGGAGGAGCAGGGCATCGGGAGTTGAGGGTGC CGAGTGGGGGGTCGGGGATCAGAGGGTCGGTGCAGAGGGGGAGGCGGCCCCC CGGGGGAGGGGCACGCTATGTCTTAAGAGCTGCCTGA | 5044 |
| hsa-mir-219-2 | 3 | MTIDGPVALFKSSTNCSRAPESAPGPYCWSGPLKARPGP EPPEAPARVQPCASAARRLPVRLHGRCR* | 5045 | ATGACACATTGATGGCCCGTGGCCAGGCCCGTATTGTTGGAGCGGCCCACTAAATCAGTACCAATTGCAGCCGAGC CCCGAGCCGCCAGAGGCGCTCCACGGCGCTCAGCCTGCGCCTCGGCACCCCGG GCTCCCAGTCGGCTCGCTCCACGGCGCTGCAGGTGA | 5046 |
| | 4 | MAPWRYSNPVPLAAEPLSPRQARIVGAAH* | 5047 | ATGGCCCCGTGGCGTTATTCAAATCCAGTACCAATTGCAGCCGAGCCCTTCTCCG CGCCAGGCCGTATTGTTGGAGCGGCCCACTAA | 5048 |
| | 1 | MEGESGVRAATPSPSGRRRGGGRGASGRGAWTGRVS VSGATRKESGTGVVAEGLAEWRGAGGEPRGRRAGGGS PGGPRSEDTGAGHLAWGGSGPPERAARRCFASAGVHW VRASSAPWQGRGRWAGRPLLSFSPGDVM* | 5049 | ATGGAGGGGTGAAAGTGGGGTCCGGCGGCACACCAGCCTTCCGGAGGAGAAG CTGAGGCCTGAACTGGCGGGTTAGT GTGTCAGGAGCTACGAGAAAGAGTCTGGAGTCTGGGAGTCTGCGAAGGCTGG CGAGTGGCGGGGGTCGGGGGAGCAGGTCTGGGAGGGGGCGGAGCCGGCGCTC ACCCGGCGGCCGGCCCGGTCTGAGGATACAGGGGCGGCATCTAGCTGGGAGGGT CTGACCCCCCGAGCGGGCAGTTCAGCGCCTGGCAGGGAAGGGTGCTTTGCCTCG GTCAGGGCGCAGTTCAGCGCCTGGCAGGGAAGGGTGCGTGGCGGGCGGGCCCT CCTCTCGTCTCTCCAGGGATGTTATGTAA | 5050 |
| | 2 | MLCKGGGERSRGRRCRGLMQPKG* | 5051 | ATGTTATGTAAGGGGGGGAGGGGAGCGCGGGTGTCCGGTGCCGGGGCCTTA TGCAACCAAAGGTTAG | 5052 |
| | 3 | MASGEAVTPTSLRPWFQPPTPLACHPGCQIGLGAVRVP EG* | 5053 | ATGGCCTCCGGCGAGGCTGTCACCCCACCTCACTCCTGCGCCTGGTTCCAGCTCCA ACTCCTTTGCCTGTCATCCTGGCTGTCAGATTGGGCTGTCAGAGTGCCA GAGGGTTGA | 5054 |
| hsa-mir-22 | 4 | MEQLVRGSVPWAHPALQPRAPAWHRLSAAAESSGLNR AISDRGRSDGVGLVTQGKEDTQSSCLPRGFRNLNRTPY PPIFLTL* | 5055 | ATGGAGCAGCTGGTCAGAGGGTCAGTGCCCTGGGCCCACCCGCGCTGCAGCCAAG GGCACTCCGCTTGGCACAGAGGAAGACTCTCAGCAGCGTGGACAGAGC TATCTCAGACAGAGGAAGGTCGACGAGTTGAACTGGTCACCCAGGGAAGGAAGC ATACACAAAGTTCATGCTCCCAAGAGGGTTTCGGAATTTGAACCGCACCCGTATC CCCAATCTTTCTTACCCTCTGA | 5056 |
| | 1 | MSGVLETRIC* | 5057 | ATGTCTGGTGTCCTAGAAACAAGAATATGCTAA | 5058 |

Figure 1 (Continued)

| | | | | |
|---|---|---|---|---|
| hsa-mir-220 | 2 | MLTFEERTFCVIEDISQRDLSCNFSLIHLESVY* | 5059 | ATGCTAACCTTTGAAGAAAGAACATTTGTTAATAGAAGACATCAGCCAGAGAGACCTTTCATGTAATCCTTCTAATCATTTAGAATCAGTATTAA | 5060 |
| | 3 | MVHRNISRATSHCSLQDMSRGHTLPTG* | 5061 | ATGGTCATTAGGAATATTTCAAGGCTACATCCATTGCTCCCTGCAGGATATGTCCAGGGGAATTCTGACTTTGCTACTCTGCTCTGA | 5062 |
| | 4 | MSNMHSLPL* | 5063 | ATGTCCAACATGCACTCTGCCTCTGA | 5064 |
| hsa-mir-220b | 1 | MQTLQKTPPTPTFPRCLCCSVSGCRIGSTNEKCS* | 5065 | ATGCAGACGCTGCAAAAACCCCTCAACCCTACATTTCCAGATGCCTTTGCTGCTCCGTTTCTGATGCAGAATTGGTTCTACCAATGA | 5066 |
| | 2 | MPLLLRFWMQNWFYQ* | 5067 | ATGCCTTTGCTGCTCCGTTTCTGGATGCAGAATTAGAAAATGTCATGA | 5068 |
| | 3 | MRNAHERFRKWK* | 5069 | ATGAGAAATGCTCATGAGAGATTTAGAAAGTGGAAGTGA | 5070 |
| | 4 | MLMRDLESGSEAVWACVYILLRSRVVELYHLFS* | 5071 | ATGCTCATGAGAAGCAGGGTTGTGGAGCTATAGATTTATTTCATGA | 5072 |
| hsa-mir-220c | 1 | MGRRRARVFLPRLLPSLLPPPVAPP* | 5073 | ATGGGCCGCCGCAGAGCCCGTGTCTTCCTCCCGCCTGTCCTCCCCTCCCCTGA | 5074 |
| | 2 | MLFL* | 5075 | ATGCTCTTCCTCTAG | 5076 |
| | 3 | MYYIHLFYVHC* | 5077 | ATGTATTATATTATGTTAACATATAAATATATAAATATTAA | 5078 |
| | 4 | MLLYVKHNIKYN* | 5079 | ATGTTATTATATGTTAACATATAAATATTAAATATAATTAA | 5080 |
| hsa-mir-221 | 1 | MRGFCYSFLSENDSHSILPFTLHQVSPSHTHTHTHTH TPFSCPP* | 5081 | ATGAGAGGGTTTTGCTATTCCTTTTGAGTGAAAACGACTCCATAGCATATGCCATTCACACTCCACCACCATTCTCCCTTCACACACCACACACACATTTTTTCACACACCACCATTCTGTCCTCCCTGA | 5082 |
| | 2 | MNNLRFVMDSGCSPFLTFFLNLQELLLSLLPFPTFWFSLP GKLLILPS* | 5083 | ATGAATAATCTTCGCTTGTCATGATGGCCGGATGCTCACCTTTTCTAACATTTTTTAAACCTCCAAGAGTTACTCTCAGCCTCTCCCCACCTTCTGGTTTTCCCTACCTGGTAAACTTCTATTCTACCTAGTAA | 5084 |
| | 3 | MLTFSNIFFKPPRVTPQPPSLPHLLVFPTW* | 5085 | ATGCTCACCTTTTCTAACATTTTTTAAACCTCCAAGAGTTACTCCTCAGCCTCTTCCCCACCTTCTGGTTTTCCCTACCTGGTAA | 5086 |
| | 4 | MKLLPH* | 5087 | ATGAAGCTCTTGCCTCATTGA | 5088 |
| hsa-mir-222 | 1 | MRGFCYSFLSENDSHSILPFTLHQVSPSHTHTHTHTH TPFSCPP* | 5089 | ATGAGAGGGTTTTGCTATTCCTTTTGAGTGAAAACGACTCCATAGCATATGCCATTCACACTCCACCACCATTCTCCCTTCACACACCACACACACATTTTTTCACACACCACCATTCTGTCCTCCCTGA | 5090 |
| | 2 | MNNLRFVMDSGCSPFLTFFLNLQELLLSLLPFPTFWFSLP GKLLILPS* | 5091 | ATGAATAATCTTCGCTTGTCATGATGGCCGGATGCTCACCTTTTCTAACATTTTTTAAACCTCCAAGAGTTACTCTCAGCCTCTTCCCCACCTTCTGGTTTTCCCTACCTGGTAAACTTCTATTCTACCTAGTAA | 5092 |
| | 3 | MLTFSNIFFKPPRVTPQPPSLPHLLVFPTW* | 5093 | ATGCTCACCTTTTCTAACATTTTTTAAACCTCCAAGAGTTACTCCTCAGCCTCTTCCCCACCTTCTGGTTTTCCCTACCTGGTAA | 5094 |
| | 4 | MKLLPH* | 5095 | ATGAAGCTCTTGCCTCATTGA | 5096 |
| hsa-mir-223 | 1 | MGRLRPSPPPLAPSLAPYSASLSSSPLPQQWRGDTEQAE ATSPRAHPPAPRPCSARARSCATPQPPRCLRLR* | 5097 | ATGGGGCGCCTCCGCCCCTCCGCCTCTGCCTTCGCTTGGCGCCTACTCTGCCTCGGCTCAGCAGCAGCCCCTCCGCCAACAATGCGCGGGACACTGAGCAAGCAGAGGCCACCTGCCAGGCTCACCGCCCGCCTCCCTTCCCGATGCTCACCTTTTCTAACATTTTTTCCCTCTGGTCCTGCCGCCACCCAGCCGCCACGCGCATCCTGCCTCCCGCCTGCCTCGCCTGCTCGCCCAGGGCTCGGTCCGCCGCCACAGGGACACTGA | 5098 |
| | 2 | MARGH* | 5099 | ATGGCGCGGGGACACTGA | 5100 |
| | 3 | MHVYIHPSTHHNTKDMEST* | 5101 | ATGCATGTGTATATTCACCCCAGCACTATTCACAATACCAAAGACATGGAATCAACCTAA | 5102 |
| | 4 | MCIFTPALFTIPKTWNQPKCCPSMTDCIKKMYI* | 5103 | ATGTGTATATTCACCCCAGCACTATTCACAATACCAAAGACATGGAATCAACCTAAAGCCCATCAATGACAGACTGCATAAAGAAATGTACATATAA | 5104 |

Figure 1 (Continued)

| | | | | |
|---|---|---|---|---|
| hsa-mir-224 | 1 | 5105 | MLSKVLPVLLGLLLILQSR* | 5106 ATGTTGTCCAAAGTTCTCCAGTCCTTCTAGGCATCTTATTGATCCTCCAGTCGAGGTGA |
| | 2 | 5107 | MRAGLGPPHCRMGSRGP* | 5108 ATGCGCGCGCTCGGCCTCCGCCCTCACGTAGGATGGGCTCCCGGGTCCTTGA |
| | 3 | 5109 | MCECCLVCSLLTFPLRVPTEFQALRQATLTLLASHAAA PVGASLRHELWESLRYPAPAMPPLHR* | 5110 ATGTGTGAGTGTCTCAGGCACTGCGCTCTGTGTTCTCTGCTGCCAGGCAACTGACATTACTTGCTTCCATGCCGCTG CTCTGTTGGTGCCAGTTCGCAGGCACGAGCTTTGTTTAGTCTAAGGAGTGCTCCGCTCA CAGCTATGCCCCCTCTCCACCGCTGA |
| | 4 | 5111 | MPLLLLVPVSGTSFGLV* | 5112 ATGCCGCTGCTCGTTGGTGCCAGTCCTCAGGCACGAGCTTTGGTTTAGTCTAA |
| hsa-mir-23a | 1 | 5113 | MAPFGLFRAQ* | 5114 ATGGCCCCATTTGGCCTGCCAGGGCTCAATGA |
| | 2 | 5115 | MRGELGHASCCSLLVPHGPSRYLCLSSPGAGTEGTARL QLPVWWLLHMRKELPCDQRKHLGTWRGGVPKSHYLL CSLSLSPLQVPASGPARCPPHPCATAGWGSWGWDLLPV TNHIARDFQPTLSSAIEDAARGRGGREAPKPVPGLRSRA* | 5116 ATGAGGGGGAGCTTGGCATGCAAGTTGCTGTAGCCTCCATGCCTCTGTCCGCATGGGCC TCTAGGTATCTCCAGTCCTTGCTCTCCAGTGGGCTGAACGAGGCACAGCTAGGCTC AGCTCCCGTGTGGTCGGAACCTGGAGCCTCATATGAGAAGAGAGCTTCCTGTGATCAAAGG AAGCATCTGGGGACCTGGAGAGTGTCTCAAATCTCATTACCTCCTTTGCTCT CTCTCTCTTCCCCCTCCAGGTGCCAGGTCCAGCAGGCCCTGGGGTTCTGGGAATGGATGGATTTGCTCTGTCACAAATC CCTGCACGGCCGGCTGGGGCCGGCTGGGTAACCGACCCTGAGCTCTGCCACCGAGGATGTGCCGGG ACGGGGCGTGGCAGAGAGGCCTGTGCTGGCCTGGCCTGAAGAGCAGGAGTTAG * |
| | 3 | 5117 | MQVAVASLSRMGPLGISASPVLGLERRAQLGSSSPCGG SCI* | 5118 ATGCAAGTTGCTGTAGCCTCCCTCCTCCGAACGGCATGGGCCTCAGCTCCCGTGGTGG CAGTCCTGGGGCTGGAACGGAGGGCACAGCTAGGCTCCAGCTCCCCGTGTGGTGGC TCCTGCATATGA |
| | 4 | 5119 | MGFASCHKSHCQGPPTDPELCHRGCCPCTGWQRGPEA CAWPEEGLAACEQGPHQVVFTVAKFRPPGPHLLWPC RLSPAAACLPAILLPGLPGLCLPCLLS* | 5120 ATGGGATTTGCTTCCTGTCACAAATCACATTGCCAGGATTCCAACCGACCCTGAG CTCTGCCACCGAGGATGCTGCCCGGACCTTAGCTGCGGGTTGCAGAGAGCCCGAAGCTG TGCCTGGCCTGAGGAGCAGGGCCTTAGTGCTGCCCCAGGCCTCCCTGCCTTGCCCCTT GTTCACAGTTGCTAAGTTCCGCCCCCCAGGCCCCCATCCTCTGCCCCCATCCTCGTCCTGGGCTCTGC CTCCCGTGCCTACTGAGCTGA |
| | 1 | 5121 | MVPWVPGDPAKGLSHGMRFSPPAQPRLCGTPTCPPPA RTARHWEGREAASGGLLSRLRLGLALLQACRIRRLRRR QGEGAGYFYLPPGSRGDRK* | 5122 ATGGTTCCCTGGGTTCCTGGTGACCAGTAAGGGCTTTTCTAGTGGATGCGTTC CCCAGTGCCCAGCCAGCCTAGGGCTGTCGCACCCTACTTGCCTCCCCTCCTGCC AGACAGGAGCGAGCACTGAGGAGGGACGGGAGGGCCTCTCTCCCTCCCG GCTGAGGTCGGCTGCGCCCCTCCAGGATCGGCCGTCTGCGCCGCGG GCAGGGGGAGGGGCGGCGGGTTATTTTACCTCCCTCCAGGCAGGCGGGGGCGACAGGA AGTGA |
| hsa-mir-23a | 2 | 5123 | MGCASPVPQRSLGSVAPLLAPLLPGGQRGTGRDGRRPQG ASSPQ* | 5124 ATGGGATGCGCTTCCGTTCCCCAGTCCAGGACAGCTAGGCTCTGTGGCACCCTACTT GGCCTCCCCTCCTGCCAGGGAGGAGGACGGGAGGCGGCCTCAGGG GCCCTCCTCCCGGCTGA |
| | 3 | 5125 | MWGARELGTATAGLAAGRERG* | 5126 ATGTGGGAGCCAGGGAGCTGGAACAGCCACAGCTGACTGGCGGCGGCCGGGGGG AGCGGGGTTAG |
| | 4 | 5127 | MWVVASLSLIWAPIPSLARGLSDPGQGGGPCPSPQGPPG PSRVGGKRGRRPLAGPACHRHCLPVGCLLGNLTRJPR* | 5128 ATGTGGGTCGTGGCCTCGCTCTCGCTCATCTGGGCGCCAATCCCTCGCTGGCTCGA GGGCTCTCAGATCCTGGGCAGGGAGGGGGGTAAGAGGGGCACCCCGCCTT AGTTCCAGCAGAGTCGGGAGTCGGGCTGCCTCGGACGGGGAAAAGGGGCCGCCGCCT GCCACGGCCATTGTTTACCCGTCGCTGCCTCCTAGGAAACTTAACCCGCCGCCGCGGT AA |
| | 1 | 5129 | MRPKARVDDVTRRVPG* | 5130 ATGCCGGCCCCGGCGCGCGTGTGGATGACGTCACCCGGCCGTGCCGGGTAG |
| | 2 | 5131 | MTSPGACRGSP* | 5132 ATGACGTCACCCGGCGCGTGCCGGGGTAGCCCGTAG |

Figure 1 (Continued)

| | | | | |
|---|---|---|---|---|
| hsa-mir-23b | 3 | MAAGTASPRSEGDGEPSLLTLTFARPARTRIPSSVLPDSWG* | 5133 | ATGGCGGCGGGACAGCATCATTCCGTTCTGAAGGCGACGGGAGAACCCTCCTTAC CCTCACTTTTGCTCGACCAGGCGAGGACCCCTCCTGTTCTCCAGACTCC TGGGGCTGA | 5134 |
| | 4 | MNACMGGEGVAQ* | 5135 | ATGAACGCATGCATGGCGGGGAAGGGGTGGCACAGTAA | 5136 |
| hsa-mir-23b | 1 | MPARAGGRPAGGGAAAIPLRQAPPLGARPPARAAAQAPRPPPAPRLR* | 5137 | ATGCCGGCGGGGAGGCGACCTGCGGGGAGGCGACCTGCGGCGGCCGCTATACCTTT AAGGCAGGCGCCCCCGCGCCCCTCGGGCCGCGCCCCGCCCAGG CCCCGCGCGCCCGCCCGCCCCTGAGGTGA | 5138 |
| hsa-mir-23b | 2 | MRITPGGRRARAPAPPLRPPRPRARYGAGTPS* | 5139 | ATGCGGACCCCTGGAGGGCGCAAGGCGCGGGCTCCGGCGCGCGTGCGTCCTCC CCGGCCGCGGGAGGTACGGGGCGCACGCCGAGTTAG | 5140 |
| | 3 | MAVRTLSPSLKCCGF* | 5141 | ATGGCCGTCAGGACCCTGTCGCCTCTTGAAATGCTGTGGTTTTGA | 5142 |
| | 4 | MLWFLNLRSRNGLE* | 5143 | ATGCTGTGGTTTTTGAACCTCAGTGCAGTCACGAAATGGATTGGAGTGA | 5144 |
| | 1 | MRPRARVDDVTRRVPG* | 5145 | ATGCGGCCCGGGCGGTGGATGACGTCACCCGCGCGTCCGGGTAG | 5146 |
| | 2 | MTSPGACRGSP* | 5147 | ATGACGTCACCCGCGCGTGCCGGGTAGCCCGTAG | 5148 |
| hsa-mir-24-1 | 3 | MAAGTASPRSEGDGEPSLLTLTFARPARTRIPSSVLPDSWG* | 5149 | ATGGCGGCGGGACAGCATCATTCCGTTCTGAAGGCGACGGGGAACCCTCCTTAC CCTCACTTTTGCTCGACCAGGCGAGGACCCCTCCCTGTTCTCCAGACTCC TGGGGCTGA | 5150 |
| | 4 | MNACMGGEGVAQ* | 5151 | ATGAACGCATGCATGGCGGGGAAGGGGTGGCACAGTAA | 5152 |
| hsa-mir-24-1 | 1 | MPARAGGRPAGGGAAAIPLRQAPPLGARPPARAAAQAPRPPPAPRLR* | 5153 | ATGCCGGCGGGGAGGCGACCTGCGGGAGACGCGGCGGCCGCTATACCTTT AAGGCAGGCGCCCCCGCGCCCCTCGGGCCGCGCCCCGCCCAGG CCCCGCGCGCCCGCCCGCCCCTGAGGTGA | 5154 |
| hsa-mir-24-1 | 2 | MRITPGGRRARAPAPPLRPPRPRARYGAGTPS* | 5155 | ATGCGGACCCCTGGAGGGCGCAAGGCGCGGGCTCCGGCGCGCGTGCGTCCTCC CCGGCCGCGGGAGGTACGGGGCGCACGCCGAGTTAG | 5156 |
| | 3 | MAVRTLSPSLKCCGF* | 5157 | ATGGCCGTCAGGACCCTGTCGCCTCTTGAAATGCTGTGGTTTTGA | 5158 |
| | 4 | MLWFLNLRSRNGLE* | 5159 | ATGCTGTGGTTTTTGAACCTCAGTGCAGTCACGAAATGGATTGGAGTGA | 5160 |
| | 1 | MAPFGLPRAQ* | 5161 | ATGGCCCCATTTGGCCTGCCAGGGGCTCAATGA | 5162 |
| hsa-mir-24-2 | 2 | MRGELGHASCCSLLVPHGPSRYLCLSSPGAGTEGTARLQLPVWWLLFMRKELPCDQRKHLGTWRGGVPKSHYLLCSLSLSPLQVPASGPARCFPHPCATAGWGSWGWDLLPVTNHIARDFQPTLSSATEDAARGRGREAPKPVPGLRSRA* | 5163 | ATGAGGGGGGAGCTTGGCCATGCAGTGCTGTAGCCTCTTGTCCGCATGGCCC TCTAGGTATCTCTGCCTCTCCATTGGGTCTGGAGCGCACAGCTAGGCTC CAGCTCCCGTGTGGAACCTGCTCTGCATATGAGGAAAAGAGCTTCCCTGTGATCAAAGG AAGCATTCTGGGACCTGAGGAGGTGTCCCAAATCTCATTACTCTCTTTGCTCT CTCTCTTTTCTGCCAGGTCCAGGTGGCCAGTCTCTGTGCCGCCGGTTGCTTCTGTCACAAATC ACATTGCCAGGGATTTCAACGACCCAGCCAGCAGAGATGCTGCCGG GACGGGGGTGGCAGAGAGCCGTGCCTGGCCTGGCGAGGAGCAGGGCTAG | 5164 |
| | 3 | MQVAVASLSRMGPLGSASPVLGLERRAQLGSSSPCGGSCI* | 5165 | ATGCAAGTTGCTGTAGCCTCCTGTCCGCATGGGCCCTCTAGGTATCTCTGCCTCTC CAGTCTCTGGGGCTGGAACGGCAGGCACAGCTAGGCTCCCAGCTCCCGTGTGGTGGC TCCTGCATATGA | 5166 |
| | 4 | MGFASCHKSHCQGFPTDPELCHRGCCPGTGWQRGPEACAWPEEQGLAACEOQGPHQVVFTVAKFRPPGPHLLWPCRLSPAAACLPAILLPGLLPGLCLPCLLS* | 5167 | ATGGGATTTGCTTCCTGTCACAAATCACATTGCCAGGATTTCAACGACCCTGAG CTCTGCCACCGAGGATGCTGCCCGGGACCGGCTTAGCTGTTGAGCAGGGTCACACAAGTCG TGCCTGGCCTGAGGAGCAGGGTTAGCGCCCCCAGGTTCCGCCCATCCTGGCTTGCGCT TGTTCACAGTGGCTAAGTTGCCCAGGCCTGCCATCCTGCCTGCCTGCCTGGGCCT CTCCCGTGCCTACTGAGCTGA | 5168 |

Figure 1 (Continued)

| | | | | |
|---|---|---|---|---|
| hsa-mir-24-2 | 1 | MVPWVPGDPAKGLSHGMRFPSPPAQPRLCGTPTCPPPARTARHWEGREAASCGLLSRLRLGLALLQAGRIRRLRRRQGEUAGYFYLPPFGSRGDRK* | 5169 | ATGGTTCCCTGGGTTCCTGGTGACCCAGCTAAGGGCCTTCTCATGGGATGCGCTTCCCCAGTCCCCAGCGCAGGCCACTGGGAGGGACGGAGGCGGGGCCTCAGGGGCCCTCTCTCCCGGCTGAGGCTCGGCCTCGCCTTCTCCAGCTGGGAGGGATCCGCCGTCTGCCGCCGGCAGGGGAGGGGCTCGGGGCTCGGTTATTTTTACCTCCTCCAGGCAGCCGAGGGACCAGAAGTGA | 5170 |
| | 2 | MGCASPVPQRSLGSVAPLLAPLLPGQRGTGRDGRRPQGASSPG* | 5171 | ATGGGATGCGCTTCCCCAGTCCCCAGTCCAGTCTAGGCTCTGTGGCACCCTACTTGCCCCCTCTGCCAGGACAGCGAGGCACTGGAGGCACTGGAGGCGGCCTCAGGGGGCCTCCTCTCCCGGCTGA | 5172 |
| | 3 | MWGARELGTATAGLAAGRERG* | 5173 | ATGTGGGGAGCCAGGGAGCTGGGAACAGCCACAGCTGGACTGGCGGCTGGCGCTGGGAGCGGGGTTAG | 5174 |
| | 4 | MWVVASLSLIWAPIPSLARGLSDPGQGGGPCPSPQGPPGPSRVGGKRGRRPLAGRACHRHCLPVGCLLGMLTRPR* | 5175 | ATGTGGGTCGTGGCCTCCCTGTCCTCATCTGGGCGCCAATCCCTCGCTGGCTCGAGGGCTCTCAGATCTGGGCAGGGAGGGGACCCTTCGCCTCGCGCCAGGGACCCCCAGTCCCAGCAGAGTCGGGGTAAGAGGGTGGAGGGGCCTCCGGCCCCGCCTGCCACCGCCATTGTTTACCCGGCGTGCCTCCTAGGAAACTTAACCCGCCGCGGT | 5176 |
| hsa-mir-25 | 1 | MSGSPLEDRMKNWEIMAVLESRQEDGEESRACPALRFRNKRTRVRWPFKSDSPPPAPARTAGNPAPALFRFEIFFRRPHRLPVTHSRPAR* | 5177 | ATGAGCGGGTCCCCCTTGGAGGACAGAATGAAGAATTGGAAATCATGGCCGTTCTGGAGAGTAGACAAGAAGACGGAAAGTCGGCCTGCCCGGCCCTGCCCCGCCCTGCGCCCTGCGGCAGACAAAAGAACGCGTGTCGCCTGGCCTTTAAGAGCGATTCTCCCCCCGCCCAGCTCGGACCGGGAAACCCGGGCTGCACTACCCCGCGAGATTCCCTTCCGACGCCCGCACCGGCTCTCCGTCCACTCATTCTAGGCCCGCACGGTGA | 5178 |
| | 2 | MALEKDYALEKGTGLRAREGVLRGEPPGEHLLV* | 5179 | CGTCCTGCCGGAAGGACTACGGCGCTAGAGAAGGGACTACGAGCGCCGGGAGGGTCTAGGAGCCCGGGAGGGCGTTGGTGTGA | 5180 |
| | 3 | MLKKS* | 5181 | ATGTTGAAGAAAAGKTAG | 5182 |
| | 4 | MANGWTGSRPGRRNPEL* | 5183 | ATGGCCAATGCTGGACTGGTCTCCGCCCTGGTCGGAGGAATCCGAGCTGTGA | 5184 |
| hsa-mir-26a-1 | 1 | MVTRRPLEPSGGGGGSWGAGPGRLSQSAGPGGGRAQAAAASAPPRRAPPAPPRRPRAALGLRGAGPAGGRRAAHPWTARPSSPR* | 5185 | ATGGTGACGAGGCGGCCGCTGGAGCCGTCGGGGGAGGCGGCGGCTGGGGAGCTGGGCAGCGCTGGCAGCGCCGGGCCCGCCGCGCGCCGCGGGCCCGCCCGCCGCGGCCCGGCGCTGGCCTTGCGGGGAGCAGGGCCGGGAGGACGCGGGCCGCCGCGCGCGCCGCCACCCATGACGGCCCGGCCCATCATCACCAGGTGA | 5186 |
| | 2 | MDGPAHTQVTNPKEDEGRLPGAGEKGEEGRRRPAGGERJTPRAAGVHCRAPAWAWGRGAQGPEGAWVWGAPGGERGCQSACAD* | 5187 | ATGGACGGACCGGCCCATACCCAGGTGACCAACCCAAAGGAGGACGAGGGCCGCGTTGCCGGCGCGGCGGAGAAAGGTGAGGAGCGGCGACGCCCAGCGCCGGGCCGCATGGGCCTGGGGAGCGAGGCGCACCCGCGGCTCACTGCCGAGCGCGCCGGGAGTCGTGGGTGGGGGTGCGCGGGAGGAGAGCGAGGTGCTGCCGACTGA | 5188 |
| | 3 | MGLGEGCTGPGGCVGVGCARRRARLPECVCRLSQCECAGAGGETGSECVCI* | 5189 | ATGGGCCTGGGAGGAGGGTGCACAGGGCCTGGTGGCGGGTGCGTGGGTGTCGTCGCAGAGTGCGTGTGCCGACTGAGCCAGTGTGAGTGTGCCGGAGAGCAGGGGGCTGGCGGAGACTGGGAGCGAGGTGCTGCATCTGA | 5190 |
| | 4 | MCVCTRGQSDCKDMCAPHREVVRL* | 5191 | ATGTGTGTGTGCACACGGACAGCGGACAGCAGCGAGTGATTGTAAGGATATGTGTGCACCTCACAG | 5192 |
| hsa-mir-26a-1 | 1 | MERNVWSLF* | 5193 | ATGGAAAGAAATGTGGTCATTGATTAG | 5194 |
| | 2 | MCGH* | 5195 | ATGTGTGGTCATTGA | 5196 |
| | 3 | MKHWCTVRLR* | 5197 | ATGAAACATTGGTGCACAGTTCGTTTAAGGTAA | 5198 |
| | 4 | MIFVI* | 5199 | ATGATCTTTGTGATTGA | 5200 |
| | 1 | MLDPN* | 5201 | ATGTTGGACCCAAACTGA | 5202 |

Figure 1 (Continued)

| | | | | |
|---|---|---|---|---|
| hsa-mir-26a-2 | 2 | MEHGSHTQARREDALVLTKQGRGSNFPKLCYAPGRGG G* | 5203 | ATGGAACACGGCTCCATCATCACCAGGCGCGAGGAGAAGACGCCTGTGCTCAC CAAGCAAGGTAGGCGGCAGCAGCTTCCCAAAACTTTGCGTCGCCCCCGGCGCGGAG GGGGCTAG | 5204 |
| | 3 | MASDPAWF* | 5205 | ATGGCATCAGACCCGGCGTGGTTCTGA | 5206 |
| | 4 | MCPK* | 5207 | ATGTGTCCAAAATAG | 5208 |
| | 1 | MFASASREGNSML* | 5209 | ATGTTTGCATCGCCTCGCCGGAAGGAAACTCCATGTGTAA | 5210 |
| | 2 | MDSSAVITQISKEEARGPLRGRGKGTGAAGRGPKPGRRGR.REGAGHPRGAAAAAPGGRLSCARSSQPEREQGESLNSEAQRGAGPGAFGALFFARGEFETEAGHERELFGGFLAGIAWCMGAPPPLAPMGLGDGGAEEGAYGPPAETPPHPPPPPPRAAVR* | 5211 | ATGGACAGTCCGGCCGTCATTACTGAGATCAGCAAGGAGGAGGCTCGGGGCCCGCT GCGGGGCAAAGGTACCGGGGCTGCGGGAGGGGCCGAAGCGGGGCCCCTTGGG GCGAGAGAAAGGCCCCGGGATCTTCCCCAGGCGAGCAGGGAGCAGGGAGAGTTGA CCGCCTTAGCTGTGCCCGAAGCTCCAGTCCAGCAAGGAGGGCCTGCGCCCTGCGGCCGG ACTCAGAGAGCCTCAGAGACGCGCGGCGGGAGACCTGAGGCCTTTGGGGCCTCTG TTCGCTCGAGGTGAGGAAACTGAGGCAGGAATAGAGAGGAACTCTTCGGGGGTTT CCTGGCAGGCATTGCTGTGCAGGAGCGCCTATGGGCCTCGCCAATGGGGCT GGAGATGGGGAGCTGAGGAGGGCGCTATGGCCACCGCCTGCTGAGACTCCGCCCC ACCCCACCCCACCCCCGGGCTGCGGTCCGGTAG | 5212 |
| hsa-mir-26b | 2 | MGELRRAPMCHPLRLRPTPHPPPGLRSGRVLGGAEV TAGWGGLEGSPANTQLRSPQTSRHAWRRRPPRRHRED GRHFQESLGARGESRAPSGHAPPRKASPRRGCVPQRG WAGYCGGSVFSFSPCGPQDLDAAPRSAHPRLGLAAPELR ARWKG* | 5213 | ATGGGGGGAGCTGAAGAGGAGGGCGCCTATGGCCCACCGCTGAGACTCCGCCCACCGC CACCCCACCCCCGGGCTGCGGTCCGGTAGGGTCTTGGAGGGGGCGCGAGG CACAGAACTTCGCGTCACGCCTGGGAGTCGTTGGAGGAGATCTCCGCCAACACAGCTACGTTCC CGGCCGCACTTCAAGAGTCGCTTGGGGAGGGCTTGCGGGACCCTCGAGGCACAGAGGA GGCACGCACCACCGCAAAGCCTCGCGCGCCCGACGAGCCTGCGTCCCCAGCGT GGCTGGGCTGCCGGGTGGGGGTCTGCTCCTTTCCCGGTGTCTGGCTCTGCCCCAGCGCAGGAT CTGAGCGCTGCCCCCAGGTCGGAAAGGCTAG AGGGCAAGGTGGAAAGGCTAG | 5214 |
| | 4 | MATGHWFQAAGLHPCLWAQPQ* | 5215 | ATGGCCACTGGACACTGGCCCCAGGCTGCACCGTGCACCCTGCCCCCAGGGCCCA GCCGCAGTGA | 5216 |
| | 1 | MAPFGLFRAQ* | 5217 | ATGGCCCCATTTGGCCTGCCCAGGGCTCAATGA | 5218 |
| | 2 | MRGEIGHASCCSLLVPHGPSRYLCLSSPGAGTEGTARL QLPVWLLHMRKELPCDQRKHLGTWRGGVPKSHYLLCSLSLSPLQVPASGFPARCPPHPCATAGWGSWGWDLLPV TNHIARDFQPTLSSATEDAARGRGREAFKPVPGLRSRA * | 5219 | ATGAGGGGGGAGCTTGGCCATGCAAGTGTGTAGCCTCCTTGTCCGCATGGGCCC TCTAGGTATCTCCCGTGGTGGACTTGGCCTCTCCAGTCGAAGGAAAAGAGCTTCCTGTGATCAAAGG CAGCTCCACGTGTGGTGCCTCTGCATATGAGAAAAAGAGCTTCCTGTGATCAAAGG AAGCATTCTGGGGACCTGAGGGAGGTGTCCCCAAATCTCATTACCTCCTTTGCTCT CTCTCTTTTCTCCCCCTGAGTGGCCAGCCTGCCCGTGCCCCCTCACC CCTGTCCCACGGGCCGGGGATTTGCCAACGACCTGCAGAGCCTCTGCTGTCACCCTGTCACCAATC ACATTGCCAGGGATTCAACGACCTGCAGAGCCTCTGTCACAAATC GACGGGGTGGGGCAGAGAGGATTCAACGACCTGCAGAGCCTCTGTGCCGGG TCCTCGCATATGA | 5220 |
| hsa-mir-27a | 3 | MQVAVASLSRMGPLGISSASPVLGLERRAQLGSSSSPCGG SCI* | 5221 | ATGCAAGTTGCTGTAGCCTCGTTGTCCGCAATGGCCCTCTAGGTATCTCTGCCTC CAGTCGTGGGAACGGAGGGCACAGCTAGGCTCCAGCTTCCAGTCTGTGGTGGC | 5222 |
| | 4 | MGFASCHKSRCQGPTIDPELCHRGCCPGTGWQRGFEA CAWPEEQGLAACEQGPHQVVFTVAKFRPPGPHLLWPC RLSPAAACLPAILLPGLPGLCLPCLLS* | 5223 | ATGGGATTTGCTTCCTGCCACAAATCACATTGCCAGGGATTCCAACCGACCCTGA CTCTGCCACTGAGGATGTCTGCCGGGACAGGGCTGTCGTTGTGAGCAGGGTCCACCAAGTCG TGCCTGGCCTAGTGCAGGAGCAGGGCTTAGTGCTTGTGAGCAGGGTCCACCAAGTCG TGTTCACAGTGGCTAAGTTCCGCCGCCCCAGGCCTCACCCTCGTGCTGCCCTTGCCGCCTT GTCCCCTGCTGCCGCTGTCTGCCATCCTGCCCTGGCGTCTGCCCTGGCCCTGC CTCCCGTGCCTACTGAGCTGA | 5224 |

Figure 1 (Continued)

| | | | | |
|---|---|---|---|---|
| hsa-mir-27a | 1 | MVPWVPGDPAKGLSHGMRFPSPAAQPRLCGTPTCPPPABTARHWEGREAASGGLLSRLRLGLALLQAGRBRRLRRRQGEGAGYYPYLPPGSRGDRK* | 5225 | ATGGTTCCCTGGGTTCCTGGGTGACCCAGCTAAGGGCTTTCTCATGGGATGCGCTTCCCCAGTGCCCCAGCGCCAGCCTAGGCTCTGTGGCACCCTACTTGCCCCCTGCCAGGACAGCGAGGCACTGGAGGGACGGGAGGGGAGGGCGGCCTCAGGGGCCTCTCTCCCGGCTGAGGCTTGGCCCCTGCCGCCCTCTCCGCCCTCAGGGAGGATCGCGGAGGCTTGCGCGCCGCAGGAGGGAGGTGGCCGGTTATTTTACCTCCCTCCAGGCAGCCAGGGGCGACAGGAAGTGA | 5226 |
| | 2 | MGCASPVPQRSLGSVAPLLAPLLPGQRGTTGRDGRRPQGASSPG* | 5227 | ATGGGATGCGCTTCCCAGTGCCTTCCTGCAGGACAGCGAGGCACTGGAGGGACGGGAGGGGACCGGGGCCTCAGGGGCCTCTCCCGGCTGA | 5228 |
| | 3 | MWGARELGTATAGLAAGRERG* | 5229 | ATGTGGGGAGCCAGGGAGCTGGGAACAGCCACAGCTGGACTGGCGGCCGGCCGGGAGCGGGGTTAG | 5230 |
| | 4 | MWVVASLSLIWAPIPSLARGLSDPGQGGGPCPSPQGGPPGPSRVGGKRGRRPLAGPACHRHCLPVGCLLGNLTRPR* | 5231 | ATGTGGGTGGTGGCCTCGCTGTCCTCATCTGGCGCAATCCCCTCGCTGGCTCGAGGGCTCAGATCCTGGGCAGGGCTAGGCTCGACCCCCAGGGAGCCCCAGGGGACCCCAGGTCCAGGAGGTAAGGAGGGGAGCGGCCTCTGCCGCCGCCCCTGCCACCGCCATTGTTTACCCGTCGGCTGCCTCCTAGGAAACTTAACCCGCCGCCGCGGGTAA | 5232 |
| hsa-mir-27b | 1 | MRPRARVDDYTRRVPG* | 5233 | ATGCGCCCCGCGCGTGTGATGACTACACCCGGCGTCCGGCGTAG | 5234 |
| | 2 | MTSRPGACRGSP* | 5235 | ATGACGTCACCCGGCCCGGCTGTGCCGGGTAGCCCGTAG | 5236 |
| | 3 | MAAGTASFRSEGDGEPSLTLTFARPARTRIPSSVLPDSWG* | 5237 | ATGGCGGCGGGGACCAGCATCATTCCGTTCTGAAGGCGACGGGAACCCTCCCTTACCCTCACTTTGTCTCGACCAGCGAGGACCCGCATCCCTCCAGTTCTCCCAGACTCCTGGGCTGA | 5238 |
| | 4 | MNACMGGEGVAQ* | 5239 | ATGAACGCCATGCATGGCGCGGAGGGTGCACAGTAA | 5240 |
| hsa-mir-27b | 1 | MPARAGGRPAGGGAAAPLRQAPPLGARPPARAAAQAPRPPAPRLR* | 5241 | ATGCCGGCCAGGGCCGGAGGGCGACCTGCGGAGGCGGCGGCCGCTATACCTTTAAGGCAGGCCCCCCGCCCCTCGGTGCCGCCCCGCCGCCGCGCCCCAGGCCCCGCCCCGCGCCCGCCGCGCCCCAGGCCCCGCCCCGCGCCCGCCGCCTGAGGTGA | 5242 |
| | 2 | MRTPGGRRARAPAPPLRPPPRARYGAGTPS* | 5243 | ATGCGGACCCCTGGGCGGCGCCGCCGCCTGCCGCCGCCGCCGCCGCCGCCGCCGCCGCCGCCGCCGCCGCCGCCGCCGCCGCCGCCGAGGTACGGGGCGGCACGCCGAGGTAG | 5244 |
| | 3 | MAVRTLSPSLKCCGF* | 5245 | ATGGCCGTCAGGACCCTGCCCTCTTGAAATGCTGTGGTTTTGA | 5246 |
| | 4 | MLWFLNLRSRNGLE* | 5247 | ATGCTGTGGTTTTTGAACCTCAGGTCACGAAATGGATTGGAGTGA | 5248 |
| hsa-mir-28 | 1 | MVMGHVAGSAGHFYLGVWTAAFPGEFYPLQWDFKTRSA* | 5249 | ATGGTGATGGGACACGTTGCTGGGAGTGCTGGTCACTTTTATTTGGGGTGTGGACAGCTGCTTTCCCAGGGAGTACTTCTTACAGTGGGATTTCAAGACAAGATCGGCCTGA | 5250 |
| | 2 | MIKAKATSWKGCRDVCGHVGRGSFSLKTVMVGFKSMQNVDV* | 5251 | ATGATTAAGGCTAAAGCAACAAGCTGGAAGGGATGTCGGGATGTCTGTGGACATGTAGGGAGGGGTAGTTTAGCTTGAAAACAGTTATGGTGGGATTTAAGAGTATGCAAAATGTTGATGTGTAG | 5252 |
| | 3 | MSGCLWTCREG* | 5253 | ATGTCGGGATGTCTGTGGACATGTAGGGAGGGGTAG | 5254 |
| | 4 | MSVDM* | 5255 | ATGTCTGTGGACATGTAG | 5256 |
| hsa-mir-296 | 1 | MIGLPRALR* | 5257 | ATGATTGGCTTACCTCGGCTCTTGCCTAG | 5258 |
| | 2 | MRSEETLSAKGKREKDIQKQGYAEAGEKRPFAPPGQGPRLEPGRPREHLPRVSSAPLAAEFPGAGTTRVCEQRRKFFARAMAQITTQPVPKYKYTVGG* | 5259 | ATGAGAAGTGAGGAAACGCTTAGCGCAAAAGGGAAAAGAGAGAAAGACATACAGAAACAAGGTTACGCGGAGGCGGTGAAAAGCCCGCCTTCCCCGCGTTCCTGCCCAAGGGCCCGCTTATTTCCGGGAGGCCCGCGGAGCGACCTCCTGTCCTCCGCACCGCTTGCGCGCAGAGGCGCCGGGCGCAGTTACCACCAGAGTGTGAACAGGCGAAAGTTTTTTGCCCGGGCATGGCGCAAACCACACAGCCGTTCCAAGTACAAGTACACAGTCGCGGGGTAA | 5260 |
| | 3 | MHRRITQNMDTNTHQRQAV* | 5261 | ATGCACAGGCGCAACACAGAATATGGACACCAACACACCAACGACAAGCTGTCTGA | 5262 |

Figure 1 (Continued)

| | | | | |
|---|---|---|---|---|
| | 4 | MTPAHRGPHQPSQGSPGAPGPLPGSSWLT* | 5263 | ATGACCCCAGTCCACCGTGGACCCCACCAGCTAGCCAGGGGAGTCCGGGGCCCC GGGGCCCCTCCCCGGTCCAGTTCCTGGCTCACCTGA | 5264 |
| | 1 | MIGLPRALR* | 5265 | ATGATTGGCTTACCTCGGGCTCTTCGCTAG | 5266 |
| hsa-mir-298 | 2 | MRSEETLSAKGKREKDIQKQGYAEAGEKRFPAPPGQGP RLFPGRPRHLJPRVSSAPLAAERPGAGTTRVCEQRKFFAR AMAQITTQPVPKYKYTVGG* | 5267 | ATGAGAAGTGAGGAAACGCTTAGCGCAAAAGGAAAAAGAGAGAAAGATACAGA AACAAGGTTACGCGGAGGCGGCGAAAAGGGATTCCCGCTCCCCAGGCCAAGGG CCCGCTTATTTCCCGGGAGGCCCCGCACTTCCCGCGTGTTCCTCCGACCGCTT GCCGCAGAGCGCATGCGCAAACCACAACAGCCCGTTCCAAGTGCCAACAGCGAAAGTTTT TGCCCGGCCATGGCGCAAACCACAACAGCCCGTTCCAAGTACAAGTACACAG TCGGCGGGTAA | 5268 |
| | 3 | MHRRTQNMDTNTHQRQAV* | 5269 | ATGCACAGGCGAAACACAGAATATGGACACCAACACCACCAACGACAAGCTGTCTGA | 5270 |
| | 4 | MTPAHRGPHQPSQGSPGAPGPLPGSSWLT* | 5271 | ATGACCCCAGCCACCGTGGACCCCACCAGCTAGCCAGGGAGTCCGGGGCCCC GGGGCCCCTCCCCGGTCAGTTCCTGGCTCACCTGA | 5272 |
| | 1 | MDQGVEGGGCGPGVGRQSACSL* | 5273 | ATGGACCAGGGGGTAGAGGGGGTGGGTGGGACCTGGGGTCGGGCGCCAGTCAG CTTGCACGCTATGA | 5274 |
| hsa-mir-299 | 2 | MKDGKEGYRDRGRVGLRIARAAWHTVLG* | 5275 | ATGAAGGACGGAAAGGAGGGCTACAGAGATAGGGAGAGTGGGGCTGAGGATAG CCAGAGGGGCTTGGCACCAGTTTAGGGTAA | 5276 |
| | 3 | MTEPVTPGSSFKACLMGDSVVPVTKLGPESQGRAHQV AALP* | 5277 | ATGACTGAGCCGGTCACTCCAGGGTCTCCTTCAAAGCGTGTCTAATGGAGACAGC GTTGTCCCAGTAACCAAATTGGGACCAGAGTCCCAGGGAAGGGCTCATCAGGTGGC CGCTCTGCCTTGA | 5278 |
| | 4 | MILFPLDPAPLVPFSL* | 5279 | ATGATTCTCTTCCCTCGATCAGCGCCTCTAGTTCCTTTCACTTTGA | 5280 |
| | 1 | MCHTVFCNSSPCPSSLACIDPLKAMIRAGRRGSRL* | 5281 | ATGTGTCATACTGTGTTCTGTAATTCCTCTTTTGTCCATCTTCCCTGGCTTGCATTG ACCCCTTAAAAGCCATGATTAGGGCCGGGGCCGTGGCCTGAGAGAATAA | 5282 |
| hsa-mir-29a | 2 | MISVYFWINTRTHDRE* | 5283 | ATGATCAGTGTTTACTTTTGGATAAACACCTGACACATGATAGAGAATAA | 5284 |
| | 3 | MIENKCLRERMDLLGNTKN* | 5285 | ATGATAGAGAATAAATGTTTGAGAGAGAACCTGACAAATGACCTACTGGGTAACACCAAAAA CTAA | 5286 |
| | 4 | MFEREK* | 5287 | ATGTTTGAGAGAGAGAAATGA | 5288 |
| | 1 | MCHTVFCNSSPCPSSLACIDPLKAMIRAGRRGSRL* | 5289 | ATGTGTCATACTGTGTTCTGTAATTCCTCTTTTGTCCATCTTCCCTGCTTGCATTG ACCCCTTAAAAGCCATGGCCGGGGCCGTGGCCTCACGCCTGTAA | 5290 |
| hsa-mir-29b-1 | 2 | MISVYFWINTRTHDRE* | 5291 | ATGATCAGTGTTTACTTTTGGATAAACACCTGACACATGATAGAGAATAA | 5292 |
| | 3 | MIENKCLRERMDLLGNTKN* | 5293 | ATGATAGAGAATAAATGTTTGAGAGAGAAATGACCTACTGGGTAACACCAAAAA CTAA | 5294 |
| | 4 | MFEREK* | 5295 | ATGTTTGAGAGAGAGAAATGA | 5296 |
| | 1 | MVTLALGAFLHTSPTQFPQRLL* | 5297 | ATGGTAACTCTGGCTCTAGGAGCATTCCTTCATACCTCCCCGACACAGTTCCCAG AGGCTGTATAA | 5298 |
| hsa-mir-29b-2 | 2 | MVLNLC* | 5299 | ATGGTCTTAAACTTATGTTGA | 5300 |
| | 3 | MLRQLH* | 5301 | ATGTTGAGACAACTGCACTGA | 5302 |
| | 4 | MAGAV* | 5303 | ATGGCAGGCGCTGTGTGA | 5304 |
| | 1 | MVTLALGAFLHTSPTQFPQRLL* | 5305 | ATGGTAACTCTGGCTCTAGGAGCATTCCTTCATACCTCCCCGACACAGTTCCCAG AGGCTGTATAA | 5306 |
| hsa-mir-29c | 2 | MVLNLC* | 5307 | ATGGTCTTAAACTTATGTTGA | 5308 |
| | 3 | MLRQLH* | 5309 | ATGTTGAGACAACTGCACTGA | 5310 |
| | 4 | MAGAV* | 5311 | ATGGCAGGCGCTGTGTGA | 5312 |
| | 1 | MDQGVEGGGCGPGVGRQSACSL* | 5313 | ATGGACCAGGGGGTAGAGGGAGGTGGGTGGGACCTGGGGTCGGGCCAGTCAG CTTTGCACGCTATGA | 5314 |

Figure 1 (Continued)

| | | | | | |
|---|---|---|---|---|---|
| hsa-mir-300 | 2 | MKDGKEGYRDRGRVGLRIARAAWHTVLG* | 5315 | ATGAAGGACGGAAAGGAGGGCTACAGAGATAGGGAAGAGTGGGCTGAGGATAG CCAGAGCGGCTTGGCACACAGTTTTAGGGTAA | 5316 |
| | 3 | MTEPVTPGSSFKACLMGDSVVPVTKLGPESQGRAHQV AALP* | 5317 | ATGACTGAGCCGGTCACTCCAGGGTCTTCCTTCAAAGCGTGTCTAATGGAGAGACGC GTTGTCCCAGTAACCAAATTGGGACCAGAGTCCCAGGGAAGGGCTCATCAGTGBGC CGCTCTGCCTTGA | 5318 |
| | 4 | MILFHLDPAPLVPFSL* | 5319 | ATGATTCTTCTCCTCTGGATCCAGCCGCCCCTCTAGTCCTTTCACTTTGA | 5320 |
| | 1 | MGGSRWNGGANECEMLSDSCPMEALRASTACGHLSAAA VCGMSTHQHGGGGR* | 5321 | ATGGGCAGGAGCCGGTGGAACGGGGCTAATGAGTCGAGATGTTGAGTGACA GCTGTCCCAATGGAGCGCCCTCCGTGCAATGACACTGCGGCTTGCGCCGCCGCGG TCTGCGGAATGTCAACTATTCAACATGGAGGCGGAGGTCGATAA | 5322 |
| hsa-mir-301a | 2 | MSARC* | 5323 | ATGAGTGCGAGATGTTGA | 5324 |
| | 3 | MEAEVDKLELMVSAK* | 5325 | ATGGAGCGCGAGGTCGATAAGCTGGAACTGATGGTGAGTGCAAAGTGA | 5326 |
| | 4 | MASEVGHMLESPETPGGGGWTRVEFPPPAPKGAATVW CLNRLG* | 5327 | ATGGCCTCTGAGGTGGGCACATTTGGAGTCGCCGGAAACTCCGGCGGCGGAGG CTGACCAGAGTCCAGTTCCCTCCTCGCCAAAGGGAGCGCCCACCGTCTGGTG TCTAAACCGCTCGGGTAA | 5328 |
| | 1 | MPGAGPTIYTASHLLLATASPMGQV* | 5329 | ATGCCAGGTGCTGGCCAACAATTTACACCAGCATCTCATTGCTGCAACAGCC AGCCCTATGGGGCAGGTTGA | 5330 |
| | 2 | MNASPQSGSQSRRNQSLHFRSPYLPQIQKTTGPRTRSP* | 5331 | ATGAATGCTTCTCCGCAAAGTGGATCAATCACGACGAAGAAACCAAAGTTACACTTC CGTTCCCCATATCTCCCACAGATCCAAAAGACCACGGGGCCAGGACCCGGTCTCCA TAG | 5332 |
| hsa-mir-301b | 3 | MLLRKVDHNHEETKAYTSVPHSHRSKRPRGPGPGLHS PAIPGGFQESLTRVLPGDPGWLSWEGGYPSL* | 5333 | ATGCTTCTCGCAAGTGGATCACAATCACGAAGAAACCAAAGTTACACTTCCGTT CCCCATATCTCCCACAGATCCAAAAGACCACAGGGGCCCAGGACCCGGTCTCCATAGC CCAGCCCATACCCGGGGGTTTCAGGAGAGTCGCTCACTGGGTCCTGCCGGGCGATCCG GGGTGGTTGGAGGGGGCTACCCCAGTTGTAA | 5334 |
| | 4 | MHXKAARGRVHSRLGGGSGISTCGSRPPPLWARAWRPSP GPQALLSVSLENSQRLERKGQSSF* | 5335 | ATGCATAACAAAGCAGCGCGGCAGCGTCCACTGTGGGCCTGCGGCCTGCCCCTCACC GGGCTTCCAAGCGCTCTGTCGGTGCTAGAAAACTCGAGAGATTGGAGCTGA GAAAAGGCGGCAAAGTTCTTTGA | 5336 |
| | 1 | MVLAVNIDICHLQKKKKGSRPTQDHTFPES* | 5337 | ATGGTTTTAGCTGTTAACATCGATATGTATACTTCAAAAAAAAAAGGATCC AGACCCACCCAGGATCATACATTCCCTGAGAGCTGA | 5338 |
| hsa-mir-302a | 2 | MPFCFLSPQL* | 5339 | ATGCCATTTTGTTTCTTCTGA | 5340 |
| | 3 | MLGGLPSTLTWKCFL* | 5341 | ATGTTCGGTGGGCTCCCTCAACTTAAACATGGAAGTGCTTCTGTTTAG | 5342 |
| | 4 | MEVLSVTLKVSASMF* | 5343 | ATGGAAGTGCTTCTGTGATCTTAAACATGAAGTGCTTCCATGTTTAG | 5344 |
| | 1 | MVLAVNIDICHLQKKKKKGSRPTQDHTFPES* | 5345 | ATGGTTTTAGCTGTTAACATCGATACATTCCTATACTTCAAAAAAAAAAAGGATCC AGACCCACCCAGGATCATACATTCCCTGAGAGCTGA | 5346 |
| hsa-mir-302b | 2 | MPFCFLSPQL* | 5347 | ATGCCATTTTGTTTCTTCTCCTCAGTCTAA | 5348 |
| | 3 | MLGGLPSTLTWKCFL* | 5349 | ATGTTCGGTGGGCTCCCTCAACTTAACATGAAGTGCTTCTGTGA | 5350 |
| | 4 | MEVLSVTLKVSASMF* | 5351 | ATGGAAGTGCTTCTGTGACTTAAACATGAAGTGCTTCCATGTTTAG | 5352 |
| | 1 | MVLAVNIDICHLQKKKKGSRPTQDHTFPES* | 5353 | ATGGTTTTAGCTGTTAACATTGACATCGTATACTTCAAAAAAAAAAGGATCC AGACCCACCCAGGATCATACATTCCCTGAGAGCTGA | 5354 |
| hsa-mir-302c | 2 | MPFCFLSPQL* | 5355 | ATGCCATTTTGTTTCTTCTCCTCAGCTCTAA | 5356 |
| | 3 | MLGGLPSTLTWKCFL* | 5357 | ATGTTGGGTGGGCTCCCTCAACTTTAACATGAAGTGCTTCTGTGA | 5358 |
| | 4 | MEVLSVTLKVSASMF* | 5359 | ATGGAAGTGCTTCTGTGACTTTAAACATGAAGTGCTTCCATGTTTAG | 5360 |
| hsa-mir-302d | 1 | MVLAVNIDICHLQKKKKGSRPTQDHTFPES* | 5361 | ATGGTTTTAGCTGTTAACATTGACATCGTATACTTCAAAAAAAAAAAGGATCC AGACCCACCCAGGATCATACATTCCCTGAGAGCTGA | 5362 |
| | 2 | MPFCFLSPQL* | 5363 | ATGCCATTTTGTTTCTTCTCCTCAGTCTGA | 5364 |

Figure 1 (Continued)

| | | | | | |
|---|---|---|---|---|---|
| | 3 | MLRGLPSTLTWKCFL* | 5365 | ATGTTGGTGGGCTCCCTTCAACTTTAACATGGAAGTGTTTCTGTGA | 5366 |
| | 4 | MEVLSVTLKVSASMF* | 5367 | ATGGAAGTGCTTTCTGTGACTTTAAAAGTAAGTGCTTCATGTTTAG | 5368 |
| hsa-mir-30a | 1 | MSSDFSCTDGEAVLSYGQPPALCGYEAFKCGKSRLRSAEAPSTHWI* | 5369 | ATGTCAAGTGACTTTAGCTGCACAGATGGTGAAGCTGTGCTTCTGTGGGCAGCCACCAGCCCTGTGCTATGGCTATGAAGCATGAAGCATTTAGTACACATTGGATTTAA | 5370 |
| | 2 | MVKLCFLWGSHQPCVAMKHLNVASPD* | 5371 | ATGGTGAAGCTGTGCTTTCTGTGGGGCAGCCACCAGCCCTGTGCTATGAAGCATTTAAATGCACAAGTCCAGATTGA | 5372 |
| | 3 | MWQVQHICRSI* | 5373 | ATGTGGCAAGTCCAAGTTGAGATCTCAGAAGCATTTAG | 5374 |
| | 4 | MKKYKISH* | 5375 | ATGAAAAATACAAAATATCTCATTAA | 5376 |
| | 1 | MYTRAHSRSPSDTLEGKVKLKAREQRDRREPLPPPRAMTDAAEAAFSVRTPFPSSRRAPCPPPLARPSPWRWRVPAPSPPAAPGAPRARGAGRWEREGGRGRGPAASSPDPRPRAR* | 5377 | ATGTACACGCGCGCGCACGCACTGGAGGGAAAGGTCAAACTAAAGGCGAGCGGAGAGACCGGAGGAGCCTGCGCCGCGGATCCCAGCTCTCGCCCGACGCGCCCCTGCCCCCCGCCGGGCTTCTCAGTGCGACGCGCGACCATCCCAGTCTCGCGCGCCCCCCTCTCCCCGGCCGCTCAGCGCGCCTCAGCCCCGGCCTCCGGCGCCGGCGCCTGGGAGGAGCGTGGGGCGCGGCCGCCCGGCCTCCTCCGCCCGACCCCCGACCCCGGGCCAGGTGA | 5378 |
| hsa-mir-30b | 2 | MGRAAGIRWAPPRGS* | 5379 | ATGGGCGGCGCCGGGATCCGCAGGTGGCCCCTCCCGGGCTCGTGA | 5380 |
| | 3 | MFIRQLQETLPSGRGALLFAGASESCGPHSKTRVKPGWTGRE* | 5381 | ATGTTTATCCGGCAGTTGCAAGAAACTCTGCCCTCGGACGAGGGCGCTTGCTTTTTGCCGGGCGCGAAAGTGCGGATTTGCACAGCAAAACTCGGGTGAAGCCAGGGCTGGACCGGCGGGAGTGA | 5382 |
| | 4 | MGTRDERIRLCVAPGHDVCTLLCQCLMFVAYGYPRTK* | 5383 | ATGGGGACCAGAGATGAACGAATCCGCCTGTGTGCCCCTGGTCATGATGTGTGCACGTTGCTATGCAGTGTTTAATGTTTGCTTATGGTTATTTAGGACTAAATGA | 5384 |
| | 1 | MLCSCLARCCRRRARGVRVPRPGPRAPSHWRKATAGGLARDWSVAGRPRTWHLIGRASSGLGGDEGI* | 5385 | ATGTTGTGTCTCTGCCTGGCCCGCTGTTGCCGCCGCCGCGCTCGTGGGGTCGTGTCCTCCGGCCCGCCGATTGCCCATTGGCCGCCGCGGGACGCCTCCAGCCTCGTGTGAGTCCGTCAGGCCTCGGATTGCGTGATGCCGGGCAGCCCGCGCTCCGTTCTAGGGGTGATGAAGGAATCTGA | 5386 |
| | 2 | MKESEAAGMRASWARAAGAMTPCGAGVGLRREGEPRGFKGEERVMAWQVLWG* | 5387 | ATGAAGGAATCTGAGGCTGCAGGCATGCGCGCGTCCTGGGCTAGGGCGGGCGCAATGACCCCCTGCGGCGCAGGCGTGGGGTTGCGGCGAGAGGGCGAGCCTAGAGGCTTTAAGGGCGAAGAGAGGGTGATGGCCTGGCAGGTACTTTGGGGTAG | 5388 |
| hsa-mir-30c-1 | 3 | MAWEWGTLTFRGAFPGTCMAAQDWGVQALRVPGLETPKPK* | 5389 | ATGGCCTGGGAATGGGGCACTCTGACTTTCAGAGGTGCTTTCCTGGCACATGCATGGCCGCCCAAGATTGGGGTGTGCAGGCCCTCAGGTTCCAGGCTTGGAAACACCGAAACCCAAGTGA | 5390 |
| | 4 | MGDTHFQRCFSWYMHGPRLGCAGPQGSRLGNTETQVTG* | 5391 | ATGGGGGACACTCACTTTCAGAGGTGCTTTTCCTGGTACATGCATGGCCCAAGATTGGGTGTGCAGGCCCTCAGGGTTCCAGGCTTGGAAACACCGAAACCCAAGTGACAGGCTGA | 5392 |
| | 1 | MANSLLGKGRTAVRVFSGVDIPDSCFCISCCLLPPPSFGG* | 5393 | ATGGCGAATAGTTGTTGGGGGAAAGGGACGACAGCTGTTCGGGTTTTCAGTGAGTGGACATTCCAGACTCATGTTTCGTGCATCTCCTGTCCCTTTGTTTCCTCCGTCCTTTGGGGGGTAGGGGTATAG | 5394 |
| hsa-mir-30c-1 | 2 | MFLHLLPFVSSVLWGVGIGVT* | 5395 | ATGTTTCTGCATCTCCTGCCTTTGTTTCCGTCCTTGGGGGTAGGGATAGGAGTGACTTAA | 5396 |
| | 3 | MQFPVSLILCFVLK* | 5397 | ATGCAGTTCCCGGTAAGTTTAATTCTTGTTTGTTGAAATGA | 5398 |
| | 4 | MIETV* | 5399 | ATGATAGAAACTGTTTAG | 5400 |
| | 1 | MSSDFSCTDGEAVLSYGQPPALCGYEAFKCGKSRLRSAEAPSTHWI* | 5401 | ATGTCAAGTGACTTTAGCTGCACAGATGGTGAAGCTGTGCTTTCTGTGGGCAGCCACCAGCCCTGTGCTATGGCTATGAAGCATTTAAATGCACAAGTCCAGATTGA... wait GAAGCATTTAAATGCACAAGTCCAGATTGA | 5402 |

Figure 1 (Continued)

| | | | | | |
|---|---|---|---|---|---|
| hsa-mir-30c-2 | 2 | MVKLCFLWG3HQPCVAMKHLNVASPD* | 5403 | ATGGTGAAGCTGTGCTTTCTGTGGGGCAGCCACCAGCCCTGTGTGGCTATGAAGCATTTAAATGTGGCAAGTCCAGATTGA | 5404 |
| | 3 | MWQVQHEICRSI* | 5405 | ATGTGGCAAGTCCAGATTGAGATCTGCAGAAGCATTTAG | 5406 |
| | 4 | MKKYKISH* | 5407 | ATGAAAAATACAAAATATCTCATTAA | 5408 |
| | 1 | MAYTRAHSRSPSDTLEGKVKLKAREQRDRREPLPPPRAMTDAAEAAFSVRTPFIPSSRRAPCPPPLARPSPWRWRVPAPSPPAAPGAPRARGAGRWEREGGRKGGPAASSPDPRPRAR* | 5409 | ATGTACACGCGCGGCGAGGAGCGAGGAGAGACCCTCCTCAGACACACTGGAGGGAAAGGTCAAACTAAAGGCGAGGAGGCGGCGGACCGGAGGAGGCCTGCCCGCCGCGATCCCAGCTCTATGACGGACGGCGACGGCGGCGCTGCTCGTCAGTGCGAGCACCCTTCACCTGGCGCTGGCGCTGCGCCCGCGCCCCTCGCCCGCCGCCTCCAGCGCGCGTCGGCGGCCGGGCGGCCGGCCCCTCTCCCCCGCCGACCGGCCCCTCGCGGGCGTGGGGGCCTGGGAGCGGGAGGTGGGGGCCGCCGGCGCCTCCTCGCCCGACCCCGACCCCGGGCCAGGTGA | 5410 |
| | 2 | MGRAAGGRWAPPRGS* | 5411 | ATGGGCGCGGCGGGCGGAGGCAGGTGGCCCCTCCCGGGCTGTGA | 5412 |
| | 3 | MFIRQLQFTLPSGRGALLFAGASESGGFHSKTRVKPGWTGRE* | 5413 | ATGTTTATCCGCAGTTGCAAGAAACTCTGCCTCTCGGAACGGAGCGCCTTGCTTTTGCCGGGGCCAGCGAAAGTGGCGAGTTCACAGCAAAACTCGGTGAAGCCAGGCTGAGCGGCCGGAGTGA | 5414 |
| | 4 | MGTRIDERJRLLCYAPGHDVCTLLCQCLMFVAYGYPRTK* | 5415 | ATGGGGACCAGAGATGAACAGAATCCGCCTGTGTGTAGCACCAGGCATGATGTGTGCACGTTGCTATGCCAGTGTTTAATGTTTGCTTATGGTATTTTAGGACTAAATGA | 5416 |
| hsa-mir-30d | 1 | MLCSCLARCCRRRARGVRVPRRPGPRAFSHWRKATAGGLARDWSVAGRPRJWHLIGRASSGLGGDEGI* | 5417 | ATGTTGTGCTCTTGCCTGGCCCGCTGCTGTCGCCGCCGCGCTCGTGTGGTCCGTGTCCTCGCGGCCGTCCCCATTGGCGAAGCGACGGCGGGGGGGCTCGCTCTGATTGGTCGTGATGCGCCGGACCTGGCACCTTATTGGACGCGCCAGTCCGGTCTAGGGGGTGATGAAGGAATCTGA | 5418 |
| | 2 | MKRESEAAGMRASWARAAGAMTPCGAGVGLRREGEPRGFKGEERVMAWQVLWG* | 5419 | ATGAAGGAATCTGAGGCTGCGGGCATGCGGAGCTGGGCCAGGGCGGCTGCGGGAGCTAGGGCGGAGCCTAGAGGCTGGGTTCGGGAATGGGAGGAATGGAAAGGGGGAGGGGTTGAATGGCCTGGCAGGTGATGGCCTGGCAGGGTACTTTGGGGGTAG | 5420 |
| | 3 | MAWEWGTLTFRGAFPGTCMAQDWGVQALRVPGLETPKPK* | 5421 | ATGGCCTGGGAATGGGGGACACTCACTTTCAGAGGTGCTTTTCTGGTACATGCAAGATTGTGCCCAAGATGGGGGTGTGCAGGCTTCAGGGTTCAGGGCTTGAAAACACCGAAACCCAAGTGA | 5422 |
| | 4 | MGDTHFQRCFSWYMHGPRLGCAGPQGSRLGNTETQVTG* | 5423 | ATGGGGACTCACTTTCAGAGATGCTTTTCCTGGTACATGCACGGCCCAAGATTGGGGTGTGCAGGCCCTGCAGGTTCAGGGTTCAGGGCTTGGTACATGCAATGGCATGCGGAAACACCCAAGTGACAGGCTGA | 5424 |
| hsa-mir-30e | 1 | MAANSLLGGGRTAVRVFSGVDIPDSCFCISCCLLFPPSFGG* | 5425 | ATGGCGAATAGTTCCTGCATCCTCCGCTGCCTTGTTTCCGTCTTGGAGGACAGCTGTTCGGGTTTCAGTGGAGTGGACATTCCAGACTCATGTTTCTGCATCCTGCCTTTGTTTCCGTCCGTCCTTTGGGGGTAG | 5426 |
| | 2 | MFLHLLLPFVSSVLWGVGIGVT* | 5427 | ATGTTTCTGCATCCTGCCTTTGTCCGTCCTTGGGGTAGGGATAGGAGTGACTTAA | 5428 |
| | 3 | MQFPVSLILCFVLK* | 5429 | ATGCAGTTCCGGTAAGTTAATTCTTGTTTTGTGTGTTGAAATGA | 5430 |
| | 4 | MIETV* | 5431 | ATGATAGAAACTGTTTAG | 5432 |
| hsa-mir-31 | 1 | MGRKCGNVHSRAPLSGTRAASQEELGEQLRPVHMLGRRQGLAGSTSGAWRRKTRVPGRGAEAGWGTAWSRARAGRRCSVSRLVWGAGGGKRPLRVRLGEAGRRFCPPTRTR* | 5433 | ATGGGGCGAAGGTGCGGGAACGTCACTCCCGCGAGCCGCCCCTCTGGGAGACCAGGGCCGCCAGGGAGGCAGCTGGGCTGGGAGGGCGCTGGGCCCAGGGCTCGCAGTGGGAGCTCGCACTGGGAGGAGAAGGAAGAGCGCGTGCCCGCCGCCGCCGGACCCGCCGAGCTGGAGGCGGGTTCCGTGACGTGGGCCTGGGGGCCGGGAAGCGGCCCCTTCGTGTGCGCTTGGGGCAGGGCCGAGGGCGGCCCGACCCGACCCGGAGGTAA | 5434 |

Figure 1 (Continued)

| | | | | |
|---|---|---|---|---|
| | 2 | MRRGVRRIPERRPPLALRGTAASSCPNLRSSSWPEVTGS LSVPKPRGRSCVCP* | 5435 | ATGCGCCGCGGGGTCCGGCGCATCCCGGAGCGCCGGCCGCCTTGGCTCTTCCGG AACCGCCGCCTCTGTCCCTAAACTCGAGGAAGGAGTTGTGTGTCAGTGA | 5436 |
| | 3 | MSYLAFSAFIQRCLS* | 5437 | ATGAGCGTGTTGGCGAGAGCGCTTTACCACTAAATTACTGTCACTTTGA | 5438 |
| | 4 | MFELSSFYHLKLLSL* | 5439 | ATGTTTGAGTTGAGCTCATTTTACCACTAAATTACTGTCACTTTAA | 5440 |
| hsa-mir-32 | 1 | MADGGGPKDAPSLRSSPGPAPRVPRAVGPSGGGETPR TAALALRFDKPIKQAFYNTGAVLPVCLCCGAAVLVYFL EAFLRPLLWAVLCGTFLHPFKSSLTRLGRHWQRLJ3RA HTPIVLAALLPLCFVDYGVEALGEQALRRRLLLLGA GGPLLYGLYCLGSYLGVQVLLVHAATLICRGLDYFSSL WVSERQSSAPYPRPWSRRSGVQSCSCSSRCRGDEGPHLC CSDRPSPLSFSHLRNLADILPKRGRA* | 5441 | ATGGCCGACGGCGGGCCCAAGGACGCGCCCTAAGGACCTGCGAGCTCTCCGGGCC GGGCCGCCGGGGTCCGCGGAGCCAGTGCGCGCGGCCCAGTGCGGGAGACCCGC GAACCGGCGGCGCTGGCGCTGCGCTTCGACAAGCCCATTAAGCAGGCCTTCTACAACA CCGGGGCCGTGCTGCCGGTGTGCCTGTGCTGCGGGGCGGCCGTGCTCGTGTACTTCA TCCTGGAGGCCTTCAAGAGCTCCTGCGGCTTTGGGCTGTCCGTGCTGTGTCGGGCCACTTTCTGC ACCCCTTCAAGAGCTCGACGGCCTGACGCGCCTCGGCCGCACTGGCCAGCGCGTGCACC GCGCACACGCCATCCGCCGCGGCAGTCGCCGCGTGCTGCCGCGCGTCCGTGACT CTCGGCCGCGAGGCCTGGAGTGCGTACGGCCTACGCCTCGCAGCTACTTGGG GTGCAGGTGCTGCTGGTGCACGCTCATCTGCGCCGGGGCTGGACTACTTC AGCAGCCTGTGTGGGGTGCAATCCTGCAGCTGTTCCTCCGCCCGTTCCTTCCACCTCAGGAATTT CACACCTGTGTCTGAGAGCTGGACGTGCTGGCGAGGGCGACGGCGCG GGGCGGACATTCTTCAAAAGGGGCGCGGCGTGA | 5442 |
| | 2 | MRHFSAPLQELADAPGPPLAAAPRAHRPGRAAPA ALL.RRL RRGPGRAGAAPPPAPAARRRRRPAPVRPLLPR QLLGRAGAAGARCHAHLPRAGLLQQPVGE* | 5443 | ATGGGCACTTTTCTGCACCGCGGCTGCTGACGCGCCTCGGCCGCGACTG GCTCAGGCCTCGTCGTCCTGACTACGGCGTTGGAGGCTGCTGCGGCCGGGAGGAAGCCGGCCGGCGCCGG GCTCTGCTTCGTCGCTCCTCGCCGCCGGCGCGGGCCGGGGCGCGCTGGCGGCGCCGAG GCCGCAGCTACTGGGCGGCAGGGCGCTGGTGCAGGCCTCGTACGGCCTCTACGCC TCGGCAGCTACTGGACTACTTCAGCAGCCTGGGTGAGTGA | 5444 |
| | 3 | MAVGLGFTSGWRGRGCGHPQFCASECQSWKGP* | 5445 | ATGGCAGTGGGGCTTGGTTTACTTCTGGTTGGAGAGGGCGGGGTGCTTCGRGCCA CCCTCAGTTCTGCCATCTGAATGTCAGAGCTGGAAGGGACTTAG | 5446 |
| | 4 | MSELEGTLEILGQLAHLQIGKVTSYQARAT* | 5447 | GGAAAGGTGACCTCTTACCAGGCTAGGCTACTTAG | 5448 |
| hsa-mir-320 | 1 | MGEQL* | 5449 | ATGGGGGAACAGCTTAG | 5450 |
| | 2 | MDCHHNFPRQS* | 5451 | ATGGACTGTCACCACAATTTCCAAGGCAAGTTAG | 5452 |
| | 3 | MAGRCGSCL* | 5453 | ATGGCTGGCGCTTGTGGCTCATGCGTAA | 5454 |
| | 4 | MPVIPALWEAKVGGSRGQEFKISLAKMVKPVSTKNYKK* | 5455 | ATGCCTGTAATCCAGCACTTGGAGGCCAAGGTGGGTGGATCACGAGGTCAGGA GTTCAAGATCAGCTGCCAAGATGGTGAAACCGTCTACTAAAACTACAAAAA GTAA | 5456 |
| hsa-mir-322 | 1 | MRQMSNCLYLTLFVYLQK* | 5457 | ATGATTCAGATGTCAATTGCCTACCTTATTGTCTACTTGCAGAAGTAA | 5458 |
| | 2 | MVKL* | 5459 | ATGGTGAAGTTATAA | 5460 |
| | 3 | MVQNVRRCYTPSWGR* | 5461 | ATGGTTCAAAACGTGAGGCGCTGCTATACCCCTCGTGGGAAGGTAG | 5462 |
| | 4 | MMLHFGTPPPCSGRM* | 5463 | ATGATGCTTCATTTTGGCACCCCTTCCTGCTCAGGTAGAATGTAA | 5464 |
| hsa-mir-323 | 1 | MDQGIVEGGGGCGPGVGRQSACSL* | 5465 | ATGGACCAGGGGGTAGAGGGGTGGGTCCAGGAGGGCGGGCCCAGTCAG CTTGCAGCCTATGA | 5466 |
| | 2 | MKDGKEGYRIDRGRVGLRIARAAWHTVLG* | 5467 | ATGAAGGACGGAAAGGAGGGCTACAGAGATAGGGGAAGAGTGGGGCTGAGGATAG CCAGAGCGGCTGGCACACAGTTTAGGGTAA | 5468 |

Figure 1 (Continued)

| | | Protein | SEQ ID | Nucleotide | SEQ ID |
|---|---|---|---|---|---|
| | 3 | MTEPVTPGSSFKACLMGDSVVPVTKLGPESQGRAHQVAALP* | 5469 | ATGACTGAGCCGGTCACTCCAGGGTCTTCCTTCAAAGGCGTGTAATGGGAGACAGCGTTGTCCCAGTAACCAAATTGGGACCCAAGGAAGGGCTCATCAGGTGGCCGCTCTGCCTTGA | 5470 |
| | 4 | MILFPLDPAPLVPFSL* | 5471 | ATGATTCTCTTCCCTCTGGATCCAGCCCCTAGTTCCTTTCACTTGA | 5472 |
| | 1 | MAAQRWSTRAWPSEEGKQKGDDSHSPLLFLIISAAVCTDSLRVVNKAEWALLCL* | 5473 | ATGGCAGTCAAAGGTGGAGTACTAGAGCCTGGCAAGTGAGGAAGGAAAGCAGAAAGGTGACGATTCTCACTCACTCTTGTTTTTAATAATCGCCGCTGTTTGTACAGACAGGCCTGCGTGTTGTAAATAAAGCAGAAGTGGGCTCTTTGTTTTATAG | 5474 |
| | 2 | MVRFLKAQASLAWVLRGPRLGYTPGGWETVAEGSDHVAGALGGVRRSRDWEGIT* | 5475 | ATGGTTCGTTTCCTGAAGGCACAGGCCAGTCTAGCTGGGTGCTCAGGTGCTCAGAGGACCTCGGCTGGGGGTACAGTTTGGCGGCTGGGAGACCGTTGCTGGAGACGTTCACGTGATGGAGGGGATCACGTGA | 5476 |
| hsa-mir-324 | 3 | MWRGH* | 5477 | ATGTGGCGGGGCACTAG | 5478 |
| | 4 | MRRGGRVPGGSSRRRWRWRAAAAETGALSRTPRPAPRRHPRRSVLFPLCFSPVLGQSCPRSRVGLRVCAGAAGAISFLGGRWSPGARGRDHGG* | 5479 | ATGAGGAGAGGTGGGGCGGGTACCTGGAGGAAAGCTCGCGGCGTCCGGTGGCGGTGGCGGCGCGGGCGCTGAGACCGGTGAGACCGTGCAGATCCGCGCACCCGTGCTTTGAGTCGCACCCGGCGGCTGAGACCGCCCCACCCTGCGCGCTCGCTCCGGTCGTTTGCGGGTGTGCGCAGGCGCGGCAGGGCATTAGCCCTTTGGGGTGGGCGGTGGAGCGCCGGAGACCATGGCGGTAG | 5480 |
| | 1 | MGDKGTR* | 5481 | ATGGCGGACAAAGGGACCCGTG | 5482 |
| | 2 | MWAAAPGPDTQLADTQHWPAAAETHGGRLTHNTRTGTLTRGTGMLAHTLATASTRSSHAVARRHTRLGQHILADSLVGMRSSQSNTHQF* | 5483 | ATGTGGGCCGGCAAACCCGGCCCCGACACCCAGCTCGCTGACACCCAGCATTGGCCGGCAGCCGCAGAGACGCACGGGCGGGAGACGCCATTGACACACTACGGACACGGACACCGGCACGCTGCCGTCAGTACACCCGGTGCACACGCCATGGCCGGTCACACGCTCGGTGCACAGCTCAACACACCAATTCTAG | 5484 |
| hsa-mir-326 | 3 | MSHQHSGAQGHTNTDHRHNQTDALKDWHPTGTSC* | 5485 | ATGTCTCACCAACACAGCGGAGCCCAAGGCACACACACTGACCCCCACAGACACAATCAGACTGATGCCCTCAAAGACTGGCACCCGACTGGCACGAGCTGCTAG | 5486 |
| | 4 | MPSKTGTPQARAASPRPADTHASGPTWPFEVETHTSHRVERPPPPAWGKQJAFHPNRSHPSTLPPFPLTS* | 5487 | ATGCCCTCAAAGACGTTCAGGCCCAGCGGCACTAGCCCAAGGCACGAGGCTGCTACCCACGGCTGGGAAACACACGGAGAAGTGGAAAACACACATCCATCCACACAGGTAGAGCCGCCCCCCGCCACCCGACGCTGGGGAAAACAGATGCATTCATCCAAATATGATCCCATCATCTACTCTGTTCCCTTCCTGACCTCGA | 5488 |
| | 1 | MACKQSQDQVGVRSYLQTMGLPQL* | 5489 | ATGGCTGCAAGCAATCACAGGATCAGGTTGGGGTCAGAAGTTACCTCCAAACCAT | 5490 |
| | 2 | MIRR* | 5491 | ATGATCCGCAGGTAG | 5492 |
| | 3 | MMRCRQEATVLLILPFSLVSYRAPSATQPGPRSAET* | 5493 | ATGATGAGATCCGTCAGGAGGCCACGGTCCTCCTCCTCTCCCCACCAGCCTGGTGAGCTATAGAGAGCTCCATCCGAACTCAGTCAGTTCCGTTAGTGCAGAAACCTAG | 5494 |
| hsa-mir-328 | 4 | MPSGGJHGPPHSPHQPGEL* | 5495 | ATGCCGTCAGGAGGCCACGGTCCTCCCATTCTCCCACCAGCCTGGTGAGCTATAG | 5496 |
| | 1 | MDQGVEGGGCGPGVGRQSACSL* | 5497 | ATGGACCAGGGGGTGGAGGCGGAGGGCTACAGAATAGGGAAGACCTGGGGTCGGCGGCCAGTCAGTTTGCAAGCCTATGA | 5498 |
| | 2 | MKDGKEGYRIDRGRVGLRIARAAWHTVLG* | 5499 | ATGAAGGACGGGAAAGGGGAATATCGGATAGACAGAGGGCGGGTAGGGCTTAGACAGTTTAGGGTAA | 5500 |
| hsa-mir-329-1 | 3 | MTEPVTPGSSFKACLMGDSVVPVTKLGPESQGRAHQVAALP* | 5501 | ATGACTGAGCCGGTCACTCCAGTAACCAAATTGGGACCTGAGTCTCAAAGGCGTCTAATGGGAGACAGCGTTGTCCCAGGACCCAAGGAAGGGCTCATCAGGTGGCCGCTCTGCCTTGA | 5502 |
| | 4 | MILFPLDPAPLVPFSL* | 5503 | ATGATTCTCTTCCCTCTGGATCCAGCCCCTAGTTCCTTTCACTTGA | 5504 |

Figure 1 (Continued)

| | | | | | |
|---|---|---|---|---|---|
| hsa-mir-329-2 | 1 | MDQGVEGGCGPGVGRQSACSL* | 5505 | ATGGACCAGGGGTAGAGGGAGGTGGGTGTGACCTGGGCGGCCAGTCAGCTTGCAGCCTATGA | 5506 |
| | 2 | MKIDGKEGYRDRGRVGLRIARAAWHTVLG* | 5507 | ATGAAGGACGGAAAGGAGGAGGCTACAGATAGGGGAAGAGTGGGGCTGAGGATAGCCAGAGCGGCTTGGCACACAGTTTAGGGTAA | 5508 |
| | 3 | MTEPVTPGSSFKACLMGDSVVPVTKLGPESQGRAHQVAALP* | 5509 | ATGACTGAGCGGTCACTCAGGGTCTTCCTTCAAAGCGTGTCTAATGGAGACAGCGTTGTCCCAGTAACCAAATTGGGACCAGAGTCCCAGGGGAAGGGCTCATCAGGTGGCCGCTCTGCCTTGA | 5510 |
| | 4 | MHLFPLDPAPLVPFSL* | 5511 | ATGATTCTTCTCCCTGGATCGCAGCCCCTCCAGTTCCCTTTCACTTTGA | 5512 |
| | 1 | MSSFGAG* | 5513 | ATGAGTAGCTTTGGAGCTGGGTGA | 5514 |
| | 2 | MVSPLF* | 5515 | ATGGTTTCTCCCCTTTCTGA | 5516 |
| | 3 | MGKGSVEACLLG* | 5517 | ATGGGGAAGGGCTCGGTGGAAGCTTGCTTGTGGGGTGA | 5518 |
| hsa-mir-330 | 4 | MGLVSVPDLWGCPGRGWLRENVPEGPPCAHDDPRRAGTHLQPGHTLGAAFLPAQAGVGVSFCWNLLGAFPPGGNRKAVKAAQACNLSTLGGSFEAKSLRPAWATHKTSTARSRAMWPEWDWCI* | 5519 | ATGGGGCTGGTGTCAGTGCCTGACCTCTGGGGTGTCCTGGCAGAGGATGGCTCGTGAAAATGTTCCTGAGCGGCCATGATGATCCAGAGCGAGCTGGGACCACCTACAGCCTGGACCTGCAGACACGCTCGGAGCTGCCTTGTGCGGCTCAAGCTGGAGTGGGTGTATCCTTTTGCTGGAATCTCCTTGTGCTCCCATCCCCAGGAGGAAATAGAAAGGCAGTCAAGGCAGTCTAGGCCTGTAATCTCAGCCTGGGAACAGCTTGGGAGATCGTTTGAGGCCAAGAGTTTGAGACCTGGCTGGGGCAACATACAAAACAAGCACGCACGTTCAAGGGCTATGTGTGCCCAGATGGGATTGGGATTCATAA | 5520 |
| | 1 | MAAGASSTPCPRLSYHLYFHQAGNQGFLCGCQQ* | 5521 | ATGGCAGGGCGAGCTCCACACCTGCCCCGTCTAAGCTACCACCTTTACTTCCACCAGGCTGGAACCAGGGTTCCTTGGGTTGTCAGCAATGA | 5522 |
| | 2 | MSLGMSLREKGERGHFGLRPSHPGKMSGVGGATRGVILAAPIGWRAKSGARGTEAK* | 5523 | ATGAGTCTGGGTATGAGTATTCTCGGGAAAATGAGCGGGGAGCGAGGGCACTTCGGTCTCCGCCCCTCCACTTGGGAAATGAGCGGGTTGGGGGGCGACTCGGGAGTCAATTTGGCTGCACCCATAGCTGGAAGCCAAATCGGGGCGCGGGTACAGAGCCGAAATAA | 5524 |
| hsa-mir-330 | 3 | MPAGEEFGCQSGLLHLPWFWVCHALPATPKSAARGRRSSVLAAGSRVEPQGEERRGNGEARHDLLAWKVLETVKRRWYS* | 5525 | ATGCCTGCTGGGGAAGAGTTTGGTTGTCATCCGGTCTGCATCTCCTTGGGCTTCTGGGTGCCATGCGTCCTGCAACCCCAAGTCGGCCAGGRGCGCCAAGCGGCGCCCGAAGCTCTGTCCTTGCAGGTTGGCTGGCTCTAGGGGTGCAACCCCAGGGTGCAACCCCAGGGTGAAGGAGGGGAAACGGGAGGCTAGGCATGACATGACCTTTTGCCTTTGAAAGTCTTAGAAACAGTGAAGAAGACGTTGGTATTCATAA | 5526 |
| | 4 | MRCLQPPSPPPGAAEALSLQLALGSNPRVRRGGETGRLGMTFWLGKS* | 5527 | ATGCGCTGCCTGCAACCCCAAGTCGCCGCCAGGGCCCGCCGAAGCTCTGTCTTGCAGCTGGCCCTAGGCAGCAACCCAGGGTGAGGAGGGGAAACGGGAGGCTAGGCATGACATTTTGGCTTTGGAAAGTCTTAG | 5528 |
| | 1 | MFIISETFQGRGLITILPKCQNNPEWLTVALPTKLPLRTRSGD* | 5529 | ATGTTTATTATATCTGAAACATTTCAAGGAAGACATTTCTCATAACTATACTCCCAAAATGTCAGAATAATTCCAGTTGGCTCACAGTTGCACTTGCCACAAACAAAACTGCCTCTAGAAACCCGGAGCGGTGACTAA | 5530 |
| hsa-mir-331 | 2 | MMTYLEHLKLWPLQPWELPPQSPSSSGLAVRPFSSSGVSQCHSLBPHPVSSSGFFYSLCQQASETQLAE* | 5531 | ATGATGACCTATCTGGAACACTTAAAGCTATGGTTTCTCAGCATGGAACTTCCCTTCCAGTCTGGAACCTCTTCCATCTTCCAGGTTTGGCGTTGTCGTCTCTGGTTTCTCTACTCACTCTGAGTGCCACTCCTTACACCTGCCATCAGTTTGGCTGGCATGACAACCTCAATTAGCGAATGA | 5532 |
| hsa-mir-331 | 3 | MVYSPAMGTSLPVSFHFGCSSFLLWGFSVPLLTPSSSSLLWFLLTLPGIRMSISRMMQLAKENGEGKREGIGRRKGGRETHCLLIPSHYFLPPYHS* | 5533 | ATGGTTTCTCCAGCCATGGGAACTTCCCTTCCAGTCTCCTTCCACTTCGGTTGTTCCAGCTTTCTCCTTCTGGGTTCTTCAGTCCGCACTCTCCTTCTCAGGGAAGCCACATGTCAGGAATGATGCAGCTAGCAGAAAATGGAGAAGGGAAAAGAGAGAAAGGGATTGGAATAAGAAGGGGGAGGAGAAAGAGAAAAGAGAGAAAGGGATTGGAATAAGAAGGGGAGGAGGATTGGAATAAGAACCACTACCTGACAGTCAGAGATAA | 5534 |
| | 4 | MHAHTHTHHSQR* | 5535 | ATGCACGCGCACACACACATACACAGTCAGAGATAA | 5536 |

Figure 1 (Continued)

| | | | | |
|---|---|---|---|---|
| hsa-mir-335 | 1 | MPEAIVEATACHFPEAIGGADAWQCEGGSTCWARGR WACARTWRKSSPEPRIRGRVLPGNRVKAENLWPQEAH AQPVLRMMESCRQGLT* | 5537 | ATGCCGGAGGCTATTGTGTGCAGGAGCCACGCGCTGCATTCATACCCTTTGCAATAGT GGCATGACGCCTGACAGGCGCAGGAAGCGGCAAGCACATGCTGGGCTCGGGGCGATG GGCTTGTGCGCGGACCTGGCGACGCTCTAGCCGCGACCGGTATCGTGCCGATG CCTCCCTGGGAACAGGGTGAAGCCCGAGAACCTCTGCCTCAGGAAGCGCATGCGCT AACCGGTTCTCCGAAACATGGAGTCCTGTAGGCAAGGTCTTACCTGA | 5538 |
| | 2 | MLGSGAMGLCADLATL* | 5539 | ATGCTGGGCTCGGGCGCGATGGGCTTGTGCGCGGACCTGGCGACGCTCTAG | 5540 |
| | 3 | MRNRFSETWSPVGKVLPESGKRRAGKEWSLPVHPRSPL QEWD* | 5541 | ATGCGCAACCGGTTCTCCGAAACATGGAGTCCTGTAGGCAAGGTTCTTACCTGAATCA GGTAAGAGAGGCGGGCGGGGAAGGAGTGGAGCCTCCCGTGCACCCTGCAGGCCGCT CCAGGAGTGGGACTAG | 5542 |
| | 4 | MWEGSNRKKKKRERATVPVLKPFPPPSSQAARKLPV* | 5543 | ATGTGGGAAGGTAGTAACAGGAAAAAAAAAGCGAGAAAGAGCGACTGTG CTGTGCTGAAGCCCTTTCCTCCGTCCAGGCAGCTAGAAATTGCCTGTCT GA | 5544 |
| hsa-mir-335 | 1 | MVRRDRLRR* | 5545 | ATGGTGCGCCGAGATCGCCTCCGCAGGTGA | 5546 |
| | 2 | MECSERGTSLG* | 5547 | ATGGAATGTTCAGAACGCGGACCTCCTTGGGTTAG | 5548 |
| | 3 | MFRTRDLLGLGFLDPGVVVRFRISGPRHLDMT* | 5549 | ATGTTCAGAACGCGGGACCTCCTTGGGTTAGGATTTCTAGACCCCGGGATCGTCGTG GTGAGATTTAGGATTTCTGGACCCCAGGCGTCATCTGATATGACTTAG | 5550 |
| | 4 | MTLVSP* | 5551 | ATGACCCTGTCTCACCCTGA | 5552 |
| hsa-mir-335 | 1 | MVNPILCT* | 5553 | ATGGTTAATCAATTCTGTGCACCTGA | 5554 |
| | 2 | MFTERMNGHMND* | 5555 | ATGACAGAAAGAATGAATGGACACATGAACGACTGA | 5556 |
| | 3 | MEMPGTARKELPMGLSFISLWAPEVHKREKRQEEKCQ GVKDRAKERQK* | 5557 | ATGGAAATGCCTGGCACCAGCCAAGGAGGCTGCCCATGGGATTGTCATTCATCTCA CCTCTGGGACTTCTGAGGTCCATAAGCGTGAAAAGAGGCAGGAAGAAGTGTCAGGG AGTCAAAGATAGAGCTAAGGAAAGGCAAAATGA | 5558 |
| | 4 | MKLNESERENKEKPKKRTNTWVYL* | 5559 | ATGAAACTAAATGAAAGGAAAACATAAAGAAAATAAAGAAAACCAATAAAAAGAGAA CGAATACGTGGGTGTATCTGTAA | 5560 |
| | 1 | MGDPGRNIGEGMAPQRPGQPAALSTWYSPRQYETQPG SSPMAVAARYRSRPVCKASHPHSTSTGATQRAWGGGA AASRLETCK* | 5561 | ATGGGGGATCCTGGGAGAAACATAGGGGAAGGGATGGCCCTCCAGCGCCCAGGCCA ACCTGCTCCCTAAGCACCTGTACAGTCCACGGCAGGTGGAGACTCAGCCAGGTTC TTCCTTCATGGCTGTTCGCAGCACGAGGTACCAGGGAGCAGGCCTGTGCAAAGCCAGCCA CCCCACTCCACCAGCACCAGGTTCCACCAAAGGGCATGGGTGGGGGGCGGCTG CCAGCGCCCTCGAAACCTGCAAGTGA | 5562 |
| | 2 | MGWGGGCQPPRNLQVRRGPLSTKTRPGCAPGFPHLSP* | 5563 | ATGGGCTGTGGGGGCGGCTGCCAGCCGCGCTGCCAAGCTCCAGCCTGCGAAACCTGC AAGTGAGGCGGAGGAGGCC CCTGAGCACCAAGACCCCTGGGTGTCCTCCCGGGTTCCCCCCCACTCCTCCCCTG A | 5564 |
| hsa-mir-338 | 3 | MPPLRVPPPSPLLCPPLRAPLCLPLRVPLSVLPPCHPGRG GPPPPRRSARAPARVFGLHQRSPAAPGPGGAPRLSPPPP PVRALRLRRGARGAGALRTCGGRWVMRRLGPGPRAS* | 5565 | ATGCCTCCCCTCCGTGTCCCGTGTCCCCTCCCCCCTCCAAGCCCCTTCTGTCCCCACTCCGTCTC CCCTCTGTTCCCGCCCCCCCCCGTCCCGTCCTCCGGCCCCCATGCCACCCGCCGG CGGAGGAGCCCCCCAGGGGCCGGGAGCCCCTCCAGGCCGGGGAGCGCCTCGTCTGCGC ACTGCACCGCCCCCACCGGTGCGCCACCGGCTGCGCGGCGCGGGGGCCCGGCCCCGGCGG GCCGGGGGGCTCGGA | 5566 |

| | | | | |
|---|---|---|---|---|
| | 4 | MSGHGHAGHDVNHV* | 5591 | ATGTCTGGAATTGGACAGGGGGACAGATGTTAACCATGTTTAA | 5592 |
| | 1 | MGGGSALLKAGLTLTWGAGPCRKAASAATQLEFTLRWAJTW AQVGAGRRVGRRGGRRVRAPGDPEPRGGLPRGSAPS TWVRGGPARRDRAAALGSAVLGRLVRPVRPVRPGAGS DTRTRLWVNSARASGRDSAGS* | 5593 | ATGGGAGGCTCCGCACTTCTGCGGCACTGGGCGCGGGCTCC CTGCCGGAAGGCTCCGCGTCGGACGCAGCTGTTCACGCTTAGGTGGCGACGTGGG CGCAGGTGGGCGACGCAGTAGGCCGTGGGGCCGGCGGGTGGCCGGCGGTCAG GCGCCAAGGAGACCCAGAGCCCGGAGGCCCGGCCTCCCGGGGCTCCGCCCCCTCA GGCGGTGCGCGAGGGCCGGGCCGGTGGCGCGGCGGCGGCGGTCCGA GTGCTGGGGGAGGCTCGTGCGGCAGGCCCGGGCGCGCGGCCGGGCTCCGA CACCCGCACCCGCCCTCGGGTTAACTCAGCGGCGAGTGGAAGGCGACTCAGCTG GCTCCTAG | 5594 |
| hsa-mir-339 | 2 | MRAPPHPDNP* | 5595 | ATGCGCGCCACCACCACCCGGATAATTTTAA | 5596 |
| | 3 | MFFVEMGSHHVTQAGLEFLGSSDGSSCLGLPKCWDYR SEPTRLASLSHSMLSVSFLPSPHSFLKNVHWVPPALPGA LGYSCQQVETSL* | 5597 | ATGTTTTTTGTAGAAATGGGGTCTCTGCCTGCGTCACCAGCTGGTCTCGAATTCTTG GAGCCAAGCGATGATCCTCTGCTCACTTCCATCATAAGCATGCTTTCGTTTCCTTCCTTC CGTCATTCATTCATTCATTTAAAAAACGTTCAATGGTTCCTCCTGCACTGTTCGG GGCATTGGGCTACACGTTGTCAACAAGTGGAGCAACAGTCGTGA | 5598 |
| | 4 | MLPRLVSNSWAQAMDPPASASASQSAGUGYSQRAWPHFP S* | 5599 | ATGTTACCCAGCTCGTCTCGAATTCTTCTGGGCTCAAGGATGATCCTCCTGCCTCG GCCTCCAAAGTCTCGGATTACAGGAGTGAGCAACGCGCTTGGCCTCACTTTCCA TCATAA | 5600 |
| | 1 | MSLVPLTTNRGARGLEAGPQGARAGAGESRPALSYRRP GATQTWRRVAPVGEAVPGGGCRVSWAVATAPPPRLPE RDGRGGFCAEPGDGRQRRAGWSGDHGDPHGAGRRAD PGRHRR* | 5601 | ATGAGCCTGGTCCATTGACAACAACAGGGGGCGCGGCGGCTGGAGGCGGGGCC GCAGGGGGCAACGCAAACATGGGCGGCAGCGTCGGTGGCACCGTCGGTGCCGGGC CGGGGCAAGCAAACATGGGCGGCAGCGTCGGTGGCACCGTCGGTGGCGTGCCGGGC CGGGGTGTCGGGGTGCATGGCGGCTTCGCGGAGCCGGGCGATGGACGAGGGGGA GCTGGTGGCTCTGAGACCATGAGAGACCCTCACGGAGCTGGGCGACGAGCTGACCC TGGGAGACATCGACGGTGA | 5602 |
| | 2 | MAAGGTRR* | 5603 | ATGCGCGCGGTGCCACCCGTCGGTGA | 5604 |
| | 3 | MGKGDKHTAPASP* | 5605 | ATGGKGGGTTGKGGTCATGGCATCGCCCCGGTCTCCTGA | 5606 |
| hsa-mir-33a | 4 | MDDSGELGGLETMETLTELGDELTLGDIDGEWVGGS AGAARGRGYGGAPGCACAHPPTAPVRAGRTPCARCP RRSSTLPALRA* | 5607 | ATGGACGACAGCAGCGGCGAGCTGACCCTGGAGACATGCAGCGTGACCCTCACGGAGCT GGGCGACGAGCCGCGCGGCGGGAGCAGGGCGTTACGCGCGGCGCCGGTTGGCGTGGCG CCACCCCCGACCAGTCCGTTCGCGCGGGAAGAACCCGGTTGCGCACGGTGCCGCC GGGCGGTCCTCAACCCTTCCGGCGCTGCGAGCGTGA | 5608 |
| | 1 | MDCTFEGIFCGLPTSPLYNASVSCRFSWGGRACGLRNL SRKEEPLPEGEGYTVTSSLGKWRATSNQISVPCNSRGKGL LRDPKAASRPKRVWRERVVFSTFSAPALGDQEEAGRR ARCPSATASALFSTPAYCGHLRLFRKTVGALDCQNCOF FFQASVSPTYRRGSHGLG* | 5609 | ATGGATTGCACTTTCGAAGGTATTTTGAGGCTCCGCACCCAGCCCTTTATACAAT GCCTCCGCTCCTCGCCCCAGTCCCCGCTGGGTGGGCGGCATGCGGCGCTACGCAACTTG AGCAGGAAAAGAGCCCCCTGCTACCCTCCGAGGAGAAGGTGACAGTTGACAGCTGCTGG GAAGTGGAGGCTACCTCCAACCAAATTAGCTTCCCTGCAACTCAAGGGAAGG GTTGCTTAGAGACCCAAAGCAGCTCCACCTTTGACACCAGGTTGAGGGAGCAGG GTGGTCTTCTGTACATTCTTGCACCCGCTTGGGACAGACGTCTGCCATTCAGCAGGG AGGAGGGCGGTTGTTGCCTCTGCCAGAGACGTTTGTCAAATTCTATCTAT TGTGGGCATCTTAGACTTTCAGAAGACAGTGGAGCCTAGAGTTGCCAAATTGT CAGTTTTCTTCTTCAGGCCTCAGTTTCCCCATCTATGAAGAGGCTCACACGGACTG GGGTAA | 5610 |
| hsa-mir-33b | 2 | MPPSPAGSPGVGGHAGYAT* | 5611 | ATGCCTCCGTCTTCTGCAGGTCTCTGGGTGGCGGGCATGCGGGCTACGCAACT TGA | 5612 |
| | 3 | MRATQLEQERAPSRGRRCDSYQLAGEVEGYLQPN* | 5613 | ATGCGGGCTACGCAACTTGAGCAGGAAAGAGCCCCTGCTGCGGAGGAGAAGGTGTGA CAGTTACCAGCTCGCTGGCGAAGTGGAAGGCTACCTCCAACCAAATTAG | 5614 |

Figure 1 (Continued)

| | | | | |
|---|---|---|---|---|
| | 4 | MGNPAVESPL* | 5615 | ATGGGAAACCCTGCAGTTGAAAGTCCATTATGA | 5616 |
| hsa-mir-33b | 1 | MDEPPSEAALEQALGEPCDLDAALLTDEGASGRAGLE AAPGGASRGRAGVSLAFVSPTGASSVLCSRGTSRCL* | 5617 | ATGGACGAGCCACCTTCAGCGAGGCGGCTTTGGAGCAGGCGCTGGGCGAGCCGTG CGATCTGGACGCTGGCGCTGCTGACCGACGATGAAGGTGCGTCAGGCGGGGCAGGGC TTGAAGCTGCGGCAGCGGGTGGGCGAGTAGGGGCGCAGGGTCTCCTGGCCTTT GTCTCTCCCACGGCGCTCCAGCTCCGTGCTGTGCTGCGCGGGACTTCCCGGTGTCTC TGA | 5618 |
| | 2 | MATAEAGDPGVAEAPPQRQP* | 5619 | ATGGCTACGGCTGAAGCTGGGGACCCAGGCGTTGGGGACCCAGGCCTCTGCCTGCCCAGCCCA GCCGTGA | 5620 |
| | 3 | MRMGAASRPSPASGCRVLPVCDGHRSLRTHSLTSTECCQAP S* | 5621 | ATGCGCATGGGAGCTGCTCGCCGCCTTCCCGCCTCCGCTTCTCCCGTC TGCGACGGGCACAGCCTCCGCACTCATTGACATCCACTGACATCACCTGACATCACCCGCCCG TCTTAG | 5622 |
| | 4 | MPGPVLGTEGHLQTDLGTPSFREHKNLPGNQTGH* | 5623 | ATGCCAGGCCCCGTCTTAGGCACCGAGGGTTTACAGACAGACCTGGGTACCCCTCT TTTAGGGAAACACAAAATCTCCGGGAAACCAACCGGTATTTAG | 5624 |
| hsa-mir-340 | 1 | MRSGRDCALGLRVAARPAGGRGGGHAPQAAAAREG LCVPLTLLGALPPVPFPSPAASLRGASHSVGPTRGDGG GTLLQPSWDPEETPACDLRRRPRRGPMGASPQAGSGRE GGERRGRGVQEGRARARPRAGRARALPPPGPRPPRL* | 5625 | ATGCGCTCGGGCGGGACTGCGCCTTAGGCTGCGCGTTGCCGCTAGACCAGCAGCGGG TGTGTTCCCGTGACCTCTGCGAGGCGCCTCCATTCGGTGGGACCGACCACCGGGGGATGGAGGG GGCACGGCTTCTACAACCCTCGGGACCCGAAGAGACGCCCGCGTGCGACCTGAG ACCGCCGCCTCCCGAGGAGCCATGGCGTCCCACAGCGGCAGTGGACGTG AGGGGCGCGCAGGCGCGAGCCGCGCGGCTCCGCCGGCCGCCCGCC GGERRGRGVQEGRARARPRAGRARALPPPGPRPPRL*TCTTAG | 5626 |
| | 2 | MEGARFYNPPCGTPKRRPRAT* | 5627 | ATGGAGGGGCACGCTCTACAACCTCTGGGACCCGAAGAGACGCCGCGTGC GACCTGA | 5628 |
| | 3 | MSCAGRAGPARLAALALLTCSLWPARADNASQEYYTA LINVTVQEPGRGRAPLTPFRJDRGRYGLDSPKAEVRGQVL APLPLHGGECRPGGGRGRWSLHPA* | 5629 | ATGAGCTGCGGCGGGCCGGGCCGGCCGGCACGGCTAGCCGGCCTGCGCCCGCCTGCTGAC CTGCAGCTGGGCGGCCGGCACGGCAGACAACCGGAGCCGAGCCAGGAGTACTACACGGCGC TCATCAACGTGACAGTTCAGGAGCCTGGCGTGCAGGAGCCTGCTCACGTTTCGCATCG ACCGGGGCGGCTACGGGCTTGACTCCCCCAAGCCGAGGTCGCGGCCAGGTGCTG GTGCGCCGCCCCTCACGGAGGTGAGTGCCGGCCGGGAGGGGCGGCCGGCGGCCGTGGTC GCTGCATCCCGCGTAG | 5630 |
| | 4 | MGRTSQPVFWKRQVPQFTDLRLR* | 5631 | ATGGGGAGGACGTCAGCTCAGCTGTCAGTTGGAAGCGGCAGGTTCCTCAATCACGAC TTAAGGCTGCGCTAG | 5632 |
| hsa-mir-342 | 1 | MAGAGAQLSVAAAALPRS* | 5633 | ATGGCAGGGGCCGGGGCCCGGGCCCCCGCCAGCTGTCAGTTGCCGCCCCTTCCCCGCAG CTAG | 5634 |
| | 2 | MSPRCPPQPSQTRSRRARCRLPR* | 5635 | ATGAGCCCCCGCTGCCCGCCGCAGCGCAGCGCGGACGCGGAGCCGCGCGCCGGGG CCGGGCTCCCCGCTAG | 5636 |
| | 3 | MASREPWGRLESREGLQGLWGAVPFCKGQAALALAACG VLLGSGPAAAWEADPRGQVWPCPDRARTEVGGSPCA VPSSPEEAGLKPPGVAEASPCQRPEPRLGFYRCSFPSTW SPSTPSSPNSQPFFFFLHASKVQGPQMYRSLMYHPARE PADYQAKK* | 5637 | ATGGCTTCGCAGAGCCGTGGGGGCGTTGCAGGGTGCGGGGTCTGCAGGCGTT GTGGGGGCAGTGTTCGGGGGCGTCTGCAAGGGCCTGCGCCGGACGGCAGACCCCGCCGGCAG GTGGGCCGTTGTCGACGGGCGAGGAGCCGAAGTTGCGGAAGCCTCGTGCGTT GCCTTCCAGCCCGGAGGAGGCTGCGTTGGCTTTACAGGGTAGTTCCCCGACTT CCTGCCAGCCGTCAACCCTCAGAGCCGGCTTCGTCTCCTAATTCTCAACCCCGTCGACTT GGAGCCCGTCAAAGTGCAAGCCCCCAAATGTACCGCGCGTTGATGTATCACCAGCTCG GGAGCTGCTGATTATCAGGCCAAGAAATAA | 5638 |
| | 4 | MTMK* | 5639 | ATGACAATGAAATAA | 5640 |

Figure 1 (Continued)

| | | | | | |
|---|---|---|---|---|---|
| hsa-mir-342 | 1 | MAIR* | 5641 | ATGGCCACAAGGTGA | 5642 |
| | 2 | MSRGNLES* | 5643 | ATGTCAACAGGAAACCTAGAATCTTAA | 5644 |
| | 3 | MGCRNYLRSP* | 5645 | ATGGGCTGTAGAAATTATCTCAGTTCCCTTAG | 5646 |
| | 4 | MTRGQGAYMRLHSRLVTVCSLSSRWSFHYTGLCLLMP VTENGF* | 5647 | ATGACCAGAGGACAGGGGCTTACATGAGGTTACACAGAGTTAGTGACAGTTG CTCCCTCTCTAGCCGCTGGTCTCTTACATTACACAGGGCTGTGTCTTGATGCTGTG ACCTTTAATGCTTCTGA | 5648 |
| hsa-mir-345 | 1 | MDMISPRWAYEDGQRRTFQARRLRERRAEETTDYFGG AKQACFQVKCSCPKPRCFQEGSTDGSATAEGTLPRGK NFHSPKPGRRCWPGDSPSPPPAGADSGWGARVEQTARS EAGGEGENGIRRGHAPSVSRAPSD* | 5649 | ATGGATATGATGATCTCTCCCAGGTGGGCTATGAGGATGGGCAGGAAGGACATTCCA GGCAAGCAGGCCTGCTTCAGGTGAAGTGTTCCGCCCCAAACCGGGTGTTCCAG GAGGGCAGCACAGACGGTAGCGCCACTGCAGAAGGAACTCTCCCATCCGGCGAAA GAATCCCCACTCCCCAAAGCTGGAAGCTGATAGTGGTGGGAGCAAGGTTGGCTGGACAGCCTTACC CCCACCCGTGAGCTGATATGTGGTGGGAGCAAGGTGGAGCAAACAGCGAGAT CAGAAGCGGGAGGGAAGTGGAAATGGAATCGCAGAGGAACACGCCCCTCTGTC TCCAAGGCACCCAGCGATTAG | 5650 |
| | 2 | MRMGSEGHSRQGGCASDVQRRPQMCREAPSRPAFR* | 5651 | ATGAGGATGGGCAGCGAAGGACATTCCAGGCAAGGAGGCTGCGCGAGCGACGTGCA GAGGAGCACAGATGTGCAGAGGCCAAGCAGGCCTGCTTTCAGGTGA | 5652 |
| | 3 | MESAEDTPLSPGHPAISSKFWALCPAASHWVTDREVL TPLSAQHLPNTLPFQRVSPPRSRLRRHRPNT* | 5653 | ATGGAATCGCAGAGAGACACGCCCCTGTCTCCAGGGCACCCAGCGATTAGCAG CAAATTCTGGGCTTTGTGCCCCGCACACAGCCCTCACTGGGTAACCGACCGGAAGTTCT AACTCCCCTCAGCGCACAACACCTCCCAACACACTCCTTTCAACGAGTCTCTCC CCAAGAAGCAGGCTCCGACGCCACAGATTTAATACTTAA | 5654 |
| | 4 | MKRR* | 5655 | ATGAAGAGGCGGTGA | 5656 |
| hsa-mir-346 | 1 | MTSCRARRSPTPSRSSRPTTHSRLCRKVSDRCAQGPLGH GLRGVAAVGTGGVGTSWAAQGTLCSSAAAVPCAVARL PRPT* | 5657 | ATGACATCTCGCAGAGGCGAGAAGATCACCTACTCATCAAGGTCATCGAGGCAAC AACCCATTCCAGGTGTCAGGTGTCAGAGGAAGGTGAGTGACCGTCTGTCCCAGGGCCCACTGG GACACGGCTGCGAGGGCCTCGGAGGCCACCCTCTGTTCCTCGCAGCCGCGGTTGGACGAGCTGG GCTGCGCAGGGCACCCTCTGTTCCTCGCAGCCGCGGTTGGACGAGCTGG CCTTCCCGGCCGCCACCTAG | 5658 |
| | 2 | MRGGAPSPAHLGSAGAGTALRCGPARRACERGELVFLRV AWRPSGCVGAGVRPALAAQACVARGSLCFSVFGGCRV CVPGTCIGRTSPDLSGPVFSSLRGEERPAAGARPVSFSRA* | 5659 | ATGCGCGGTGGCGCCCTTCCGGGCGTCCTCACGGAGAGCCTGGCGCCGGAGCTGCT TGGCGTGGCGCCCTTCCGGGCGTCCTCACGGAGAGCCTGTGTGGGCGCGCGTGTGCGCG CAGGGCGTGCGTCCGGCAGTCTTTGTTCTCGGTGTTGGGGCGTGTC TGCCTGCTTCGAGGTACCTGTATCGGAGGACGCCAGCGGCTGCAGTCCAGTCCAGTGCCCGGTGGCGCGGTC TCCTGCTTCGAGGTGGAAGAGCGTCCAGCGGCGCCGAGCGGCTGCCGCCGGTGTTT CGGGCATAA | 5660 |
| | 3 | MGTLGPAPLSAGAS* | 5661 | ATGGGGACTCTGGGGCCAGCGCCCTCAGTGTGCTGGGGCAAGTTAG | 5662 |
| | 4 | MQGFLAGGTGREV* | 5663 | ATGCAGGGATTCCTTGCTGGAGGAACTGGTAGAGAAGTGTAG | 5664 |
| hsa-mir-346 | 1 | MSRAPGGHGSADAVASPLDMPVRVGAGRLHHPHR* | 5665 | ATGAGCCGGCCCCCGGGGGACATGGAAGCGTGACGCTGTGGCTTCTCCCCTGGA TATGCCAGTGCGTGCTGTCGGTGCGGGGCCGGGCCGGGCCGAGGTAG | 5666 |
| | 2 | MEALTLWLLPWICQCVSVRADSHHHGKRGWRPGRGWA EAPTGQGVRGVQTWRFPGPRGSACGAPPKGRAAPPGG GAVHRRPRRAPAGCLPLPGAPISARGPAAASTDT* | 5667 | ATGGAAGCGCTGACGCTGTGGCTTCTCCCCTGGATATGCCAGTGCGTGCTCGGTGCGG GCCGACTGCACATCCACATCGTTAAGGCAGCGGTGCGGGGGCCGTCAAACTGGCGTTCCTGGGC GGGGGCCCAACGGGGCAGGGTGGGTCGTCCTCGAAGGGCCGCCGCCGCGCCGGGA CGAGCTGTGCACCCCGGCCACCCGCTGCTTGCCGCCGCCCGCCCCGGCT CCGATCTCCGCCGCGCGGTCGAGACCCGCCCCTTAG | 5668 |
| | 3 | MBARRDPRP* | 5669 | ATGGACGGCGGCGTCGAGACCCGCCCCTTAG | 5670 |
| | 4 | MCVGACCQRVSLCAPGTVSVLL* | 5671 | ATGTGTGTGGGGTGCCGTGTTGTCAGCGTGTGCTGTTGCGCCTGGCACGGTGTCG GTGTTACTGTGA | 5672 |

Figure 1 (Continued)

| | | | | |
|---|---|---|---|---|
| hsa-mir-346 | 1 | MLAAAGPLWLPSCPGAWPGAPPRSLFLLPPRSHSTRNGLFRPGT* | 5673 | ATGCTTGCGGCGGCCGGCCCGGTCCCCTGGCTCCCCAGCTGTCCTGGGCCTGGCCCGGCGCCCCGCCCCGGTCTCTCTTGTTCCTCCCCAGGTCCCACTCCACGAGGAACGGTCTGTTTCGGCCGGGGACATGA 5674 |
| | 2 | MTRDARLLRSPGRFGSPSRAVSGRPSSILPPLANRRRRPEPSELGAPQPRPVPAAVPVSERFPSRERGAPGAPSEPRAGESRAARLRLRSHVVERRAEGREAGREGSKAEGEGEGRGRPPFQFAPRRGSDTQPAQSRHAGPAAATASASPEAALAAGSAAATAAGRPRRAGLGSSCQHRRSRHRSRSGSPTALGWAGLGWGGRRAQGRARGRRTGGLGSPGERPGTAPGPAPPRFALPSASPRARVDEPRARGTWKR* | 5675 | ATGACCCGAGACGCGCGGCTGCTGAGGTCGCCAGGTGCCTTCGGAGCCCCTGAGGCCAGTTAGCGCGGCCGGCCTCTCCATTCTCCCGCCCTGGCCCGGGAACCGGAGAAGGTAGGCCCCGAACCGTCAGAGCTCCCGAGCCAGGGCGCTGTGCCCGGTGTTCGGGAGCGTCCGCGAGCGCCGGCCAGCGCGGTGGAGCAACCGGCCGCCTCGAGGAGGCGGGAGGGGAGGGAGGAGGCGGCAGGGAGGGAGGGAGCTGAGGGAGGGGGAGGGGAGGGGGAGGTCGCTCCTCGCCGGGGCTCAGACACAGCCAGCCAGAGCCCAGAGCGCTTAGGCCCGGAAGCGCTGCTGCCACGCGCGGGCCAGCCTCCCCGAAGCCGCTTAGCGCGTGGGAAGCGCTGCAGCGCGCTGGCCTCAAGCTGCCAGCACGCGGCAGCCTCCCGAGCGGAGCGGCGCCCGACGCAGGACGCCAGGGAGCGGTGCGCGGGAGAACGCCTGCACCGGCACGGGCGGCTCGGCTCTCCCGGGGAGCGGCCGCCCGGGGCCGGCGGACTGCACCCGGGGAAGAACGCCACGCGCTCCCGCGCTCGCGCTGCCCTCGGGCGGGCCGGCCGCTTGATGAGCGCGCGCATGGAAGCGCTGA 5676 |
| | 3 | MSBRAPGGHGSADAVASPLDMPVRVGAGRLHHPHR* | 5677 | ATGAGCCGTGCGCCGGGACATGAAGCGCTGACGCTGTGGCTTCTCCCTGATATGCCAGTGCGTGTCGGTGCGGTATGCCAGTGCGTGTCGGTGTCGGATATGCCGACTCCATCATCCACATCGGTAA |
| | 4 | MEALTLWLLPWICQCVSVRADSHHGKRGWRPGRGWAGAPTGQGVRGYVQTWRFPGRGSAGGAPPKGRAAPPGGGAVHRPRRAPAGCLPLPGAPISARGPAASTDT* | 5679 | ATGGAAGCGCTGACGCTGTGGCTTCTCCCTGGATATGCCAGTGCGTGTCGGTGCGGGGGCGACTCCATCATCCAACGGGCAGGAGGGTCGCGACGGTCTGGAGCGGGCCGTGGAGCTGAGGGCTGGACGGTCCCGCGGGCAGCGAGCAAAACTTGACGTTTCCTGGGCGGGGCCTCGGCGGCGGCCCGCGGCCCCCGAAGGGCCGCCGCTCCGGGGGCCGAGGCCGCAACGCCGCCTGAGCAAGCTCCGGGCAGGAGAGGGGAGCCTGGAAGCCTGCACCTGCTCGCCCCCGTCCACCGACACTTAG |
| | 1 | MRPAWPPGPLSFSGGGDAAVPSVWGQPSSPDPGLERRVAAPGGTSRKEDPAAGSAWACLGLPRAGLLGHDHADRGHLEHLRESCSQAPGQERPGSLHYLLAPSQHAPR* | 5681 | ATGCGCCCTGCCTGGCCCCGATCCCCAGCTTGTCTCTTTCTTCAGGTGGAGAGATGCCGCTGTCCCGCTGCCCGGAGGCTGCGGGAACCAGCCAGCCTCCCGGATCCGGGCTGGAGCAGAGGTGGCACCGGCGGCAGGACTCCGGCGTGGACTGCCCGCCTGGGACTCCCGGCCAGGTGATCGGGGGCATTGAGATTGCGGAGCCTCTGCAGCAAGCTCCGGGCAGGAGACCCCCCGTCGCGGCCCTGCGGGCCTGAGGAGCTGGAAGCCTGCAGCTCCCCCCGTCCGACCCGTTCTCCGCCCCGTCCAGCATGCACCCAGGTAA |
| hsa-mir-34a | 2 | MPLSRRSGDSPAPRIPGWRDASRPRGLVARAGRTRRRALPGLAWACSEPGCPSVFTQIGGIWRFCGSPAAKLRCRRGLEACTTCSFRPSMHPGKRLCFSVRAKVCKEGGGN* | 5683 | ATGCCGCTGTCCCGTCCGCGGTCCGGTGACTCCCCGGCACCAGCCCCAGCTCCGGATCCGGGCTGGAGAGACGCGTCCCGCCTGGGAAGAAAGGAGGAACCCGGACGGCGGCTCTGCCAGGTCGAGGGATGAGCCGGCTCCGAGGAGCCCTCGAGGAGCCCGACCCGGAGGAGTCGGCAGGTTTGGGAGGATTTGGGGCATTGGGAGCGGCCTGGAGCATTTGGAGATTTGCGGGCATTGGGAGCCCTCGAGGAGCCCGACCCAGGAGAGCCTTGTGTTTCTCAGTCGCTGCGAAAGTTTGCAAAGAGGAGGCGGGAACTAG |
| | 3 | MKTLFNCVASVRGRISKKQQNVL* | 5685 | ATGAAAACCCTGTTCAATTGTGTAGCCTCGTAAGGGAAGAATTCCAAGAAGCAACAAAATGTTCTTTGA |
| | 4 | MFFDFIISGEKGFLFWGFARLVLSSLLYLQRGARKADWPMGGKWGPWLSCAAGHGDIAANAQPPQFLSSP* | 5687 | ATGTTCTTTGATTCATAATCTCTGGGAGAAAGGATTCCTTTTTGGGGTTTGCTCGGCTAGTTCTTCTTCCCTCCTCATCTCCAGCGTGGGCGTGGAAGGCGACTGGTTCATGGGTGGCAAATGGGGACCCTGCTCTTGCTGCTGCCACCGTGATATTGCAGCAAAATGCTAACCTCCCCAGTTCCTCTCTCACCTTGA |

Figure 1 (Continued)

| | | | | | |
|---|---|---|---|---|---|
| hsa-mir-34b | 1 | MGVGARLPAWEGAGPPRQRRPLAQLRVLCAARPAGVPLGPGVSSGAACAQPW* | 5689 | ATGGGGTCGGGGCGGCCGGCTCCCGGCCTGGGAGGGCGGGTCCTCCCCGGCAGCGCCGGCCGCTGGCCCAGTACGCTGTGTGCGCTGCGAGGCGCGGGTCCTGCGAGCGCGGGGTCCCGCTGGGCCCGGAGGGTCTCCTCGGGATGTCCACCCCAGCCATGGTAG | 5690 |
| | 2 | MVGRPPVKWGPRRAPTPRRCGPSGSCSRGCPVLGL* | 5691 | ATGGTAGGGCGTTCCCGAGGCGTGAAATGGGGTCGAGGCGGGCCCGACCCCGGTCGGCGCTGCGGACCGTCCGGGAGCTGCAGCCGCGGGTCCCGGTGCTCGGTTTGTAG | 5692 |
| | 3 | MGSEAGPDPASALRTVRELQPRVPGARFVGSVIS* | 5693 | ATGGGTCCGAGGCGGGGCCCGGACCCTGCGGCGTCGGCTCGGCGCTGCGGCTGGCGAGCGCGGGTCGGTTTGTAGGCAGTGTCATTAGCTGA | 5694 |
| | 4 | MPEKRGVGVGPAQPAPRAPAASARKPAVSPDTVKLLLALSRSHRR* | 5695 | ATGCCTGAGAAGCGCGGGGTCGGGGTGGGTCCTGCGCAGCCTGCGCCGGCGAGCGCTGCAAGTGCGAGGAAACCCGGTTTCTCCAGATACAGTTAAACTGTTAGCTCTCTCTAGGAGTCACAGAAGATGA | 5696 |
| hsa-mir-34c | 1 | MGVGARLPAWEGAGPPRQRRPLAQLRVLCAARPAGVPLGPGVSSGAACAQPW* | 5697 | ATGGGGTCGGGGCGGCCGGCTCCCGGCCTGGGAGGGCGGGTCCTCCCCGGCAGCGCCGCCGCTGGCCCAGTACGCTGTGTGCGCTGCGAGGCGCGGGTCCTGCGAGGGCCGGGAGGGTCCCGCTGGCCCAGCCATGGTAG | 5698 |
| | 2 | MVGRPPVKWGPRRAPTPRRCGPSGSCSRGCPVLGL* | 5699 | ATGGTAGGGCGTCCCGAGGCGTGAAATGGGGTCGAGGCGGGCCCGACCCCGGTCGGCGCTGCGGACCGTCCGGGAGCTGCAGCCGCGGGTCCCGGTGCTCGGTTTGTAG | 5700 |
| | 3 | MGSEAGPDPASALRTVRELQPRVPGARFVGSVIS* | 5701 | ATGGGGTCCGAGGCGGCCCGGACCGTGCCGGTCGGCTCGGCGCGTCGCTGCGGACCGTCCGGAGCTGCAAGTGCAGTGTCATTAGCTGA | 5702 |
| | 4 | MPEKRGVGVGPAQPAPRAPAASARKPAVSPDTVKLLLALSRSHRR* | 5703 | ATGCCTGAGAAGCGCGGGGTCGGGGTGGGGTCCTGCGCAGCCTGCGCCGGCGAGCGCTGCAAGTGCAAGGAAACCCGGTTTCTCCAGATACAGTTAAACTGTTAGCTCTCTCTAGGAGTCACAGAAGATGA | 5704 |
| hsa-mir-361 | 1 | MHCFLFRLPRRECLT* | 5705 | ATGCACTGTTTCTTTCGCTTCACGAGGAATGCTAACTGA | 5706 |
| | 2 | MPNLISFPQVIVT* | 5707 | ATGCCTAACTTGATCTCATTTCCACAAGTAATAGTCACATGA | 5708 |
| | 3 | MTRFPSRWRILSLRSLM* | 5709 | ATGACACGTTTCCGTCAGATGGCGAATACTCTCCTTTCGAGTTTGATGTGA | 5710 |
| | 4 | MADTLPSEFDVTVTGTGMCSLVLPGQSLGRLSCFCFFCQWRVLGQTSWVESGREN* | 5711 | ATGGCGGATACTCTCCCTTCGGAGTTTGATGTGATATAGGACGGTATGTGTAGCCTGGTTGCTGCGTGACAAAGTTTAGGAAGACTGTCTTGTTTTCTGTCAGTGGCGAGTTTGGGACAAACATCGTGGGTCGAGAGTGGGAGGGAGAACTGA | 5712 |
| | 1 | MSRAPASLPLLPGWAV* | 5713 | ATGAGCCGCGCCGCCAGCCTCCCGCTCCTGCCTGGCTGGGCTGTGTGA | 5714 |
| hsa-mir-362 | 2 | MKLCRLRGALTQLGVLDARADRARCPPAADTGSAAPDLGDR* | 5715 | ATGAAGCTCTGCCGCTACGGCGGGGCGCTCACTGTGCTCGGCGTCCTGGATGCTCGAGACGCCAGAGGGCGCCCGCTCCGGACCTCGGCGACAGGTAA | 5716 |
| | 3 | MGLPRARRWQPGA* | 5717 | ATGGGGCTTCCCCGGGCCCGGCGTTGGCAGCCTGGCGCTAG | 5718 |
| | 4 | MVPGLPERSFLAERRQARPAFESECLAACVPPPGLG* | 5719 | ATGGTCCTGGGTTCCTGGCCGAGCGAAGTTTCCTTGCGGAGCGGCGCCAAGCGCCCGCTTTTGAATCGGAGTGTTTAGCGCCTGCTGTCCCTTTCCGGACTGGGTAG | 5720 |
| | 1 | MGKGF* | 5721 | ATGGGGAAGGGGTGGCGAATAG | 5722 |
| hsa-mir-363 | 2 | MSCLMNC* | 5723 | ATGTCTTGTTTAATGAACTGCTAA | 5724 |
| | 3 | MSLLGSYFYLFPLIG* | 5725 | ATGTCACTCTTGGGAAGTTACTTCACTTGTTCCTTTAATAGGATGA | 5726 |
| | 4 | MISSFPTFFCLSNQDT* | 5727 | ATGATTTCATCTTTTCCAACCTTTTCCTGTCTCTCCAACCAAGACACATAG | 5728 |
| | 1 | MGTGEGRWRRGSARFSRDSARDACLGCDCRRCRHPGSPSDPSPAPQRGV* | 5729 | ATGGGAACCGGGGAGGGAGGTGGCGGCGCGGGAGGCGCGCGCGGTTCTCTGGACTCGGCCGAGACCCTGTCTGGCTGCGATTGCCGCCGCTGCCGCCACCCGGGCTCCCCCTCGGACCCCGGAGCCCTCCCCAGAGGGGCGTGTGA | 5730 |

Figure 1 (Continued)

| | | | | |
|---|---|---|---|---|
| hsa-mir-365-1 | 1 | MPRAEQAGRARRSTCARAPLAWAAAPAGAGPRGSRTS REPPSPFSYRRPLKLSAPSPREAGSPGALALASAGRGQK N* | ATGCCGCGGCGGAGCAGCCGGCCGCCGGCCCGCTCACGTGCGCCGAGCCC GCTGGCATGGGCGGGGCGGCCTGCGGGGCCGGGCCGGGATCCCGGACTAGCC GGGAACCACCGTCCCAGAGAGTTACCGCKGCCGCCTAAAGTTGTCAGTCTCCCC CCGAGAAGCAGGCAGCCTGGCGCGTTGGCTTTAGCTCTCCAGGACGGGGGCAA AAAAACTAG | 5732 |
| | 2 | MGKGACGGRAPGPD* | ATGGGCGGCGGCGCTCGTGCCGGGCCCCGGAGATCCGGACTAG | 5734 |
| | | MRRLCPLRTHPYL* | ATGCGCGCGCTTATGTCCTGAGGACACATCCATATTTATAA | 5736 |
| | 4 | MALKGPDPAPVGHAVFSPRFTRRIF* | ATGGCGTTAAAAGGTCCAGACCCGGCACCTGTAGCCGTATTAGCCCTAGG TTCACCCGGAGAATATTTTAG | 5738 |
| hsa-mir-365-1 | 1 | MPYLALGSPGEYFRCYLKEEIWALVAGCHMARVESLPH RPGRDGRVLTGTGAQSPCQSFGAMRRVPRSQLATGASV LCGDAFSPRSQSEGSESTSIHRTHRGLSSLRWPSVISQAA * | ATGCCGTATTTAGCCCTAGGTTCACCCGGAGAATATTTTAGTGTCTACTTGAAAGAA GAGATCTGGGCCTAGTTGCCGGCTGTCACATGGCAAGGTAGAATCGTCCCTCAC AGCCTGCCCGAGATGGCCGGGTGCTACTGGTACACAGGTGCCAGAGTCCCTGCCA GAGCTTCGGGGCCATGCAGCGGGGTGCCAAGGAGCCAGTAGCCAGCTGGGGTCGG TTCTGTGTGGGGATGCCTTTCACCCGGTTCTCAATCTGAAAGCAGTGAATCCATTC CATTCACAGAACTCACAGAGGCCTCTCCTCTCTGAGATGGCCCAGTGTGATATCCCA GGCTGCGTAG | 5740 |
| | 3 | MAGGCSLVQVPRVPARASGPCDGCQGAS* | ATGGCCGGGTGCTCACTGGTACAGGTGCCCAGAGTCCCTGCCAGAGTCCGGGGCC ATGGACGGGTGCCAAGGAGCAGTAG | 5742 |
| | 4 | MPFHPVLNLKAVNPLPFTELTEASPL* | ATGCCCTTTTCACCCGGTTCTCAATCTGAAGGCAGTGAATCCACTTCCATTCACAGAA CTCACAGAGGCCTCTCCTCTGA | 5744 |
| hsa-mir-365-1 | 1 | MPWGRHPELLSPQILVAEPRDGTWDLSSKTRPLFPETVS YSYAQAGVQW* | ATGCCTTGGGGAAGACACCCTGAACTCTTAGTCCTCAGATCTTAGTGGCTGAACCA AGAGATGCACTGGGACTTAGCAGTAAAACCGTCCCGTTCTTTTTTGAGACAGTG TCTTACTCGTTGCCCAGGCTGGAGTGCAGTGGTGA | 5746 |
| | 2 | MAPGTLAVKPVPFFLRQCLTLLPRLECSGEHSSLQPELP RLKPHPPE* | ATGGCACCTGGGACCTTAGCAGTAAACGTCATCTAGCACCTGAGCTGAACTT CCTAGGCTCAAGCCTCATCCTCCTGAGTGA | 5748 |
| | 3 | MRVWNSHLKFGGNVTSPMMRLALGMMPCIHFGNLLW DSRSVYF* | ATGAGGGTCTGGAACAGTCATCTGAAGTTTGGGGGAAACGTCACGTCTCTATGATG CGCTGGCTTTAGGGAATAATCCTTGTATCCATTTGGAACCTGCTCTCTGGGATTCC AGATCTGTGGTTTTCGTGA | 5750 |
| | 4 | MRSLS* | ATGAGGTCCTTTCGTGA | 5752 |
| hsa-mir-365-2 | 1 | MGKLRPAAGALHRAGARPGSGAAGRGLPAPVSAGSA GSCSDGSKEEKGKLLGSGAGRTA* | ATGGGGAAGTTGAGGCCGGCCGGCGGCGGGGCCCGG GGAGCGGGAGCGGCCGGCAGGGGCGCTCCCGCGCCGGTCTCCGCGGGAGGAAGCGCT GGACAGCTGCTCGGACGGGTCAAACGGAGGAAAATTACTGCGCTCCGGGGC GGGAAGGACTGCGTGA | 5754 |
| | 2 | MCHQHVEPGRAAASKPTPPTFEGSRRPAPLPASSGSLS* | ATGTGTCACCAGCAGGTGGAGCCAGGTCGGCGCAGCAAGCCACCCCC AACTTTCGAGGGGTCCGCCGGCCCCCGGCTTCGTGGGCTCGCTCTC CTAG | 5756 |
| | 3 | MAPVPRQRCGLGLAGGCGLLREVGHGSCPAPRAPPS* | ATGGCCCCCGTGCCCAGGCAGCGGTGCGGCCTGGGTCTGGCGGGAGGGTGCGGCCT GCTGCGAGAGGTCGGCCACGGTCCTGCCCGCCCCGCCCCTCCGCCCGA GCTGA | 5758 |
| | 4 | MGAEGWVFAGEMRVSDQLAYKYPVLGPRDQRLLPGPR PRPASSRAGVRSGQAASQVHAGEGVVRCARPGCVR* | ATGGGAGCTGAGGGCTGGGTCTTTGCGGCGAAGATGAGGGTCGATCAACTGGC CTACAAAGTCCCAGTTCTCGGGCCTCGGGACCAGCGCTTCTTCCCGGTCCCCGGCCC CAGGCCGGCTTCCTCCGGGCTGGCGTCCGGCGCTGCCTCTCAGGTTCA CGCTGGAGAAGGAGTTGGTGAAGGCGTGAGATGAAGTGAGATGAGGTGCTGGTGCCTGCTCAGGTGCTGGTGCCTCGGTGA | 5760 |

Figure 1 (Continued)

| | | | | |
|---|---|---|---|---|
| hsa-mir-365-2 | 1 | MCHQHVEPGRAAASKPTPPTFEGSRRPAPLPASSGSLS* | 5761 | ATGTGTCACCAGCACGTGGAGCCAGGTCGGCTCGCCGCGGCGAGCAAGCCGACCCCC AACTTTCGAGGGGTCTCGCCGCTCTCCCGGCTTCGGTCGGCTCGGCCTCGCTCTC CTAG | 5762 |
| | 2 | MAPVPRQRCGLLAGGCGLLREYGHGSCPARPRPPS* | 5763 | ATGGCCCCCGTGCCAGGCAGCAGGGGTGCGAGCTCGGCTTGCCGGAGGGTGCGGCCT GCTRCGAGAGGTGCGGCCACGGCTCCTGCCGCCCCCCCCCCTCGCCGCCCCGA GCTGA | 5764 |
| | 3 | MGAEGWVFAGEMRVSDQLAYKVPVLGPRDQRLLPGPR PRPASSRAGVRSGQAASQVHAGEGVYRCARPGCVR* | 5765 | ATGGGAGCTGAGGGCTGGGTCTTCGCGGAGATGCGGGTCGGATCAACTGGC CTACAAAGTCCCAGTTCTCGCCGCCGGACCAGCGTCTTCCGCCGTCCTCGCCC CAGGCCGCCGCAGCTCGTCGCGGCAGCTGCCTCGCCGCCAGGTCCA CGCTGGAGAAGGAGGTGTGAGGTGCGCTCGCCCCGGCCTGGCTGCGGTGA | 5766 |
| | 4 | MGQALPLTEACPAVLSRAATLSLGVRTGHPDF* | 5767 | ATGGGCCAAGCCCTGCCACTTACCGAGCCTGCCTGCCTGTGCTTTCCAGGGCGGCA ACCTTGAGCTTGGGGGTGGGAGAACGCGGCCTGACTTCTAG | 5768 |
| hsa-mir-367 | 1 | MVLAVNIDCILQKKKKGSRPTQDHTPPES* | 5769 | ATGGTTTTAGCTGTTAACATTGACATCTGTATACTTCAAAAAAAAAAGGATCC AGACCCACCCAGGATCATACATTCCTGAGAGCTGA | 5770 |
| | 2 | MPFCFLSRQL* | 5771 | ATGCCATTTGTTTCTTCTTTCCTCAGCTCTA | 5772 |
| | 3 | MLGGLPSTLTWKCFL* | 5773 | ATGTTGGGTGGCTCCTTCAACATGAAGTGCTTTCTGTGA | 5774 |
| | 4 | MEVLSVTLKVSASMF* | 5775 | ATGGAAGTGCTTTCTGTGACTTTAAAAGTAAGTCTTCCATGTTTTAG | 5776 |
| hsa-mir-368 | 1 | MDQVEGGGCGPGVGRQSACSL* | 5777 | ATGGACCAGGAGGGGTAGAGGGAAGGCTACAGAGATGGGAAGAGTGGGCAGTCAG CTTGCAGCCTATGA | 5778 |
| | 2 | MKDGKEGYRDRGRVGLRLARAAWHTVLG* | 5779 | ATGAAGGACGGAAAGGAAGGCTACAGAGATAGGGAGTGGCACACAGAGCGT GTTGTCCCAGTCCGGTCACTCCAGGGTCTTCCTTCAAAGCGTGTCTAATGGGAGACAGC CAGAGCGGGCTTGGCACACAGTTTAGGGTAA | 5780 |
| | 3 | MTEPVTPGSSFKACLMGDSVVPVTKLGPESQGRAHQV AALP* | 5781 | ATGACTGAGCCCGGTCACTCCAGGGTCTTCCTTCAAAGCGTGTCTAATGGGAGACAGC GTTGTCCCAGTAACCAAATTGGGACCAGAGTCCATCAGGGCTCATCAGGTGGC CGCTCTGCCTTGA | 5782 |
| | 4 | MILFPLDPAPLVPFSL* | 5783 | ATGATTCTCTTCCCTCTGAATCCAGCCCTGCCTTGA | 5784 |
| hsa-mir-369 | 1 | MDQVEGGGCGPGVGRQSACSL* | 5785 | ATGGACCAGGAGGGGTAGAGGGAAGGCTACAGAGATGGGAAGAGTGGGCAGTCAG CTTGCAGCCTATGA | 5786 |
| | 2 | MKDGKEGYRDRGRVGLRLARAAWHTVLG* | 5787 | ATGAAGGACGGAAAGGAAGGCTACAGAGATAGGGAGTGGCACACAGAGCGT CCAGAGCGGGCTTGGCACACAGTTTAGGGTAA | 5788 |
| | 3 | MTEPVTPGSSFKACLMGDSVVPVTKLGPESQGRAHQV AALP* | 5789 | ATGACTGAGCCCGGTCACTCCAGGGTCTTCCTTCAAAGCGTGTCTAATGGGAGACAGC GTTGTCCCAGTAACCAAATTGGGACCAGAGTCCATCAGGGCTCATCAGGTGGC CGCTCTGCCTTGA | 5790 |
| | 4 | MILFPLDPAPLVPFSL* | 5791 | ATGATTCTCTTCCCTCTGAATCCAGCCCTGCCTTGA | 5792 |
| hsa-mir-370 | 1 | MDQGVEGGGCGPGVGRQSACSL* | 5793 | ATGGACCAGGGGGTAGAGGGGTGGGACCTGGGCGCCAGTCAG CTTGCAGCCTATGA | 5794 |
| | 2 | MKDGKEGYRDRGRVGLRLARAAWHTVLG* | 5795 | ATGAAGGACGGGAAGGAAGGCTACAGAGATAGGGAGTGGCGGGCTGAGGATAG CCAGAGGCGGCTTGGCACACAGTTTAGGGTAA | 5796 |
| | 3 | MTEPVTPGSSPKACLMGDSVVPVTKLGPESQGRAHQV AALP* | 5797 | ATGACTGAGCCGGTCACTCCAGGGTCTTCTTCAAAGCGTGTCAATGGAGACAGC GTTGTCCCAGTAACCAGAGTCCCAGGGAAGGGCTCATCAGGTGGC CGCTCTGCCTTGA | 5798 |
| | 4 | MILFPLDPAPLVPFSL* | 5799 | ATGATTCTCTTCCCTCTGGATCCAGCCCTGCCTTGA | 5800 |
| | 1 | MAEL* | 5801 | ATGGCTGAGCTGTAA | 5802 |
| | 2 | MESGSTQAGVQWRDVSSLQPLPPGF* | 5803 | ATGGAGTCTGGCTCTATCACCAGGCTGGAGTGCAGTGGCGTGATGAGCTCACTG CAACCTCTGCCTCCTGGGTTCAA | 5804 |

Figure 1 (Continued)

| | | | | | |
|---|---|---|---|---|---|
| hsa-mir-371 | 3 | MLFAVSFLSLAHLCSKCCTFSLMKELGLTRKVEHVLPQLARITNGKETLASWGPKSSPSLSHSLP* | 5805 | ATGCTATTTGCTGTCTCATTTCTATCTCTGCCATCCTTTGCAGCAAATGCTGTACATTTTCATTGATGAAGGAACTAGGTTTAATCCATCAGAAAGGTTGAGCACGTACTCCGCAGCTGGCTAGGATTACAACGCAGCTGAAGGAAAGGAAACCCTGGCCTCCTGGGTTAACCAGAAAGGTTGACTTCCTTGAGTCATTTCATTATTTGA | 5806 |
| | 4 | MLYFIDEGTRFNQKG* | 5807 | ATGCTGTACATTTTCATTGATGAAGGAACTAGGTTTAATCAAAGGTTGA | 5808 |
| | 1 | MRGWEGVGFNPIKVEWALTLYKNAAAVNLVLSGRPEVWTYHWPL* | 5809 | ATGAGAGGGTGGGAAGGTGCAGCTGAGTGGGCTCTCACCCTATATAAGAACGCAGCTGCAGTGCAGTGCACGTACTCCGCAGCTGAGGTTGTCTTTCTGCAGACCTGAGGTGTGGACGTATCATTGGCCTCTGTGA | 5810 |
| hsa-mir-371 | 2 | MLFYPLSFYFF* | 5811 | ATGTTATTTATTTCTTCATTTACTTATTTTAG | 5812 |
| | 3 | MKCTGRMMAPCSLDLLGLTLLASSSWDHRRAPPFPCAFFCPFFFFFRRDGVFYVIQAGLELLGSRAILPP* | 5813 | ATGAAGTGCACAGTAGGATCATGGCGCTTGCAGCTCCTGGACTCACCCTTTTAGCCTCCAGTAGCTGGGACCACAGGCGCGCACCATTCCCATGTGCGTTTTCGCTTTTTTTTTTTTTTAGGAGAAGATGGGGTTTTCTAJGTTATCCAAGCTGGTCTCGAACCTCTGGGCTCAAGAGCAATCCTACCACCGTAG | 5814 |
| | 4 | MCVFLLFFFFF* | 5815 | GTCTGCGTTTCGCTTGGCTGAACTGTAA | 5816 |
| | 1 | MAEL* | 5817 | ATGGCTGAGCTGTAA | 5818 |
| hsa-mir-372 | 2 | MESGSITQAGVQWRDVSSLQPLPPGF* | 5819 | ATGGAGTCTGGCTCTATCACCCAGGCTGGAGTGCAGTGGCGTGATGTGAGCTCACTGCAACCTCTGCCTCCCTGGGTTCTAG | 5820 |
| | 3 | MLFAVSFLSLAHLCSKCCTFSLMKELGLTRKVEHVLPQLARITNGKETLASWGPKSSPSLSHSLF* | 5821 | ATGCTATTTGCTGTCTCATTTCTATCTCTGCCATCCTTTGCAGCAAATGCTGTACATTTTCATTGATGAATACAAAGGTTAACCAGAACGTACTCCGCAGCTGGCTAGGATTACAAATGGAAGGAAACCTGGCCTCCTGGGCCCCAAGTCTTCCCCTTCCTTGAGTCATTTCATTATTTTAG | 5822 |
| | 4 | MLYFIDEGTRFNQKG* | 5823 | ATGCTGTACATTTCATTTGATGAAGAACTAGGTTTAATCCAGAAAGGTTGA | 5824 |
| | 1 | MRGWEGVGFNPIKVEWALTLYKNAAAVNLVLSGRPEVWTYHWPL* | 5825 | ATGAGAGGGTGGGAAGGGGTGGGCTTTAAATCCATCAAAGTTGAGTGGGCTCTCACCCTATATAAGAACGCAGCTGCAGTGGCAGTGGCGTGATGTGAGTTGAGACCTGAGGTGTGGACGTATCATTGGCTCTGTGA | 5826 |
| hsa-mir-372 | 2 | MLFYFLSFYIF* | 5827 | ATGTTATTATTCTCTCATTTACTTATTTAG | 5828 |
| | 3 | MKCTGRMMAPCSLDLLGLTLLASSSWDHRRAPPFPCAFFCFFFFFRRDGVFYVIQAGLELLGSRAILPP* | 5829 | ATGAAGTGCACAGTAGGATCATGGCGCTTGCAGCTCCTGGACTCACCCTTCTAGCTCCAGTAGCTGGGACTACAGGCGCGCACCACCATTCCCATGTGCGTTTTCTGCTTTTTTTTTTTAGTAGAGATGGGGTTTCTATGTTATCCAAGCTGGTCTCGAACCTCTGGCCTCAAGAGCAATCCTACCACCGTAG | 5830 |
| | 4 | MCVFLLFFFFF* | 5831 | ATGTGCGTTTCGCTTGCTTGCTGAGCTGTAA | 5832 |
| | 1 | MAEL* | 5833 | ATGGCTGAGCTGTAA | 5834 |
| hsa-mir-373 | 2 | MESGSITQAGVQWRDVSSLQPLPPGP* | 5835 | ATGGAGTCTGGCTCTATCACCCAGGCTGGAGTGCAGTGGCGTGATGTGAGCTCACTGCAACCTCTGCCTCCCTGGGTTCTAG | 5836 |
| | 3 | MLFAVSFLSLAHLCSKCCTFSLMKELGLTRKVEHVLPQLARITNGKETLASWGPKSSPSLSHSLF* | 5837 | ATGCTATTTGCTGTCTCATTTCTATCTCTGCCATCCTTTGCAGCAAATGCTGTACATTTTCATTGATGAATACAAAGGTTAACCAGAACGTACTCCGCAGCTGGCTAGGATTACAAATGGAAGGAAACCCTGGCCTCCTGGGCCCCAAGTCTTCCCCTTCCTTGAGTCATTTCATTATTTTAG | 5838 |
| | 4 | MLYFIDEGTRFNQKG* | 5839 | ATGCTGTACATTTCATTGATGAAGAACTAGGTTTAACCAGAAAGGTTGA | 5840 |
| | 1 | MRGWEGVGFNPIKVEWALTLYKNAAAVNLVLSGRPEVWTYHWPL* | 5841 | ATGAGAGGGTGGGAAGGGGTGGGCTTAATCCATCAAAGTTGAGTGGGCTCTCACCCTATATAAGAACGCAGTGCAGTGGCGTGATGTGAGACCTGAGGTGTGGACGTATCATTGGCTCTGTGA | 5842 |
| | 2 | MLFYFLSFYIF* | 5843 | ATGTTTATTTTCTTCATTTACTTATTTTAG | 5844 |

Figure 1 (Continued)

| | | | | |
|---|---|---|---|---|
| hsa-mir-373 | 3 | MKCTGRMMAPCSLDLLGLTLLASSSWDHRRAPPEPCAF FCFFFFRRDGVFYVIQAGLELLGSRAILPP* | 5845 | ATGAAGTGCACAGGTAGGATGATGGCGCCTTGCAGCTGACCTCCTGGACTCACC CTTTTAGCCTCCAGTAGCTGGGACCTGGGACCACAGGCGCGCACCACCATTCCATGTGCGTTT TTCTGCTTTTTTTTTTCTTCGTCGTTTTAGGAGAGATGGGGTTTCTATGTTATCCAAGCTG GTCTCGAACTCCTGGCCTCAAGCAATCCTACCACCGTAG | 5846 |
| | 4 | MCVELLFFFF* | 5847 | ATGTGCGTTTCTGCTTTCTTTTTTTTTTTAG | 5848 |
| hsa-mir-374a | 1 | MCGNIFFLFLRWGLTLLPRLATS* | 5849 | ATGTGTGGAAATATTTTTTCTTTTTGAGATGGGGTCTCACTCTGTTGCCCAGGC TGGCAACATCATAG | 5850 |
| | 2 | MGSHSVAQAGNIIAHCSLDFLGSSDSSTSAF* | 5851 | ATGGGGTCTCACTCTGTTGCCAGGCTGGCAACATCATAGCTGGCACAATCATAGCT CACTGTAGCCTCTGACTTCCTGGGCTCGAGTGATTCTTCCACCTCAGCCTTCTGA | 5852 |
| | 3 | MSPELVSNS* | 5853 | ATGTCACCCGAGCTGGTCTCGAACTCTGA | 5854 |
| | 4 | MGEGLTKEVWAEGGMMVEASVTEGRGKVEEAEWDSV LGKK* | 5855 | ATGGGAGAGGGATTGACGAAAGAAGTATGGCTGAGGAGGAGGATGGTGGAGG CCAGTGTGACCGAGGGAGGGGAAGAAGGTGGAAGAAGCAGAGTGGGATAGCGGTCCT GGGAAAGAAGTGA | 5856 |
| hsa-mir-374b | 1 | MCGNIFFLFLRWGLTLLPRLATS* | 5857 | ATGTGTGGAAATATTTTTCTTTTTGAGATGGGGTCTCACTCTGTTGCCCAGGC TGGCAACATCATAG | 5858 |
| | 2 | MGSHSVAQAGNIIAHCSLDFLGSSDSSTSAF* | 5859 | ATGGGGTCTCACTCTGTTGCCCAGCTGGCAACATCATAGCTGGCACAATCATAGCT CACTGTAGCCCTCGACTTCCTGGGCTCGAGTGATTCTTCCACCTCAGCCTTCTGA | 5860 |
| | 3 | MSPELVSNS* | 5861 | ATGTCACCCGAGCTGGTCTGAACTCTGA | 5862 |
| | 4 | MGEGLTKEVWAEGGMMVEASVTEGRGKVEEAEWDSV LGKK* | 5863 | ATGGGAGAGGGATTGACGAAAGAAGTATGGCTGAGGAGGAGGATGATGGTGGAGG CCAGTGTGACCGAGGGAGGGGAAGAAGGTGGAAGAAGCAGAGTGGGATAGCGGTCCT GGGAAAGAAGTGA | 5864 |
| hsa-mir-375 | 1 | MHQNILVEASRGEVVLTSRPRVIALPPFCVPR* | 5865 | ATGATCCAGAACATCCTGGTCGAGGCGAGCCGCGGCGAGGTGGTACTCACCTCCG GCCACCGGTCATCGCCGTTCTGCCTGCCCAGGTAA | 5866 |
| | 2 | MPAPSLSIDMPLGVTPGPLSTASKSI* | 5867 | ATGCCCGCGCCAGCCTCCGACATGCCGCTAGGGGTCACGCCTGGGCCTCTCTCC ACCGCCAGTAAAAGCATCTAG | 5868 |
| | 3 | MAGSSPGGLQRRGGNLGPGRMHLSAHTAAGLRPGR* | 5869 | ATGGCAGGGAGCAGCCCCGGCGGACTGCAGAGGCGCGGCGGGAACTTAGGGCCG GGAGGATGCACCTCCGCGCCACACTGGACTGAGACCTGGCGGCGCTAG | 5870 |
| | 4 | MDFHLSVPPNRPGASVLCFSAPPSQRQVGGKVTSGVV PEAPRVPSTLPSAPATKASEKLRSQSPGGGGGSAPPP* | 5871 | ATGGATACCCACCACCTCTCGGTTCCTCCCAGATCCAGGTGGGTGAAAAGTGACATCTGGTGTTGTTC CAGAGGCGCCCAGGGTCCCCAGGGTCCCCCAGCACGCCCCGCCCCCGCCACCAAGGCCTCGG AGAAGCTCCGGCTCCAGAGCCCCGGCGGCGAGGGGGAGCGCTCCGCCTCCATGA | 5872 |
| hsa-mir-376a-1 | 1 | MDQGVEGGGCGPGVGRQSACSL* | 5873 | ATGGACCAGGGGGTAGACGGAGGGGTGGGTGTGGACCTGGGGTCGGGCGCCATGGCAG CTTGCAGCCTATGA | 5874 |
| | 2 | MKDGKEGYRDRGRVGLRIARAAWHTVLG* | 5875 | ATGAAGGACGGAAAGGAGGGCTACAGAGATAGGGGAAGAGTGGGGCTGAGGATAG CCAGAGGGCTTGGCACACAGTTTTAGGGTAA | 5876 |
| hsa-mir-376a-2 | 3 | MTEPVTPGSSFKACLMGDSVPVPVTKLGPESQGRAHQV AALP* | 5877 | ATGACTGAGCGGTCACTCAGGGTCTTCCTTCAAAGCGTGTCTAATGAGAGACAGC GTTGTCCCAGTAACCAAATTGGGACCAGAGTCCCAGGGAAGGGCTCATCAGGTGGC CGCTCTGCCTTGA | 5878 |
| | 4 | MILFFLFDPAPLVPFSL* | 5879 | ATGATTCTCTTCCTCTGATCCAGCCCTCAGTTCCTTTCACTTTGA | 5880 |
| hsa-mir-376a-2 | 1 | MDQGVEGGGCGPGVGRQSACSL* | 5881 | ATGGACCAGGGGGTAGAGGAGGGGTGGGTGTGGACCTGGGGTCGGGCGCCAGTCAG CTTGCAGCCTATGA | 5882 |
| | 2 | MKDGKEGYRDRGRVGLRIARAAWHTVLG* | 5883 | ATGAAGGACGGAAAGGAGGGCTACAGAGGCTACAGAGATAGGGGAAGAGTGGGCTGAGGATAG CCAGAGGGCTTGGCACACAGTTTAGGGTAA | 5884 |

Figure 1 (Continued)

| | | | | |
|---|---|---|---|---|
| hsa-mir-376b | 3 | MTEPVTPGSSFKACLMGDSVVPVTKLGPESQGRAHQVAALP* | 5885 | ATGACTGAGCGGTCACTCCAGGGTCTTCCTTCAAAGCGTGTCTAATGGGAGACAGCGTTGTCCCAGTAACCAAATTGGGACCCAGGGAAGGGCTCATCAGGTGGCCGCTCTGCCTTGA | 5886 |
| | 4 | MILFPLDPAPLVPFSL* | 5887 | ATGATTCTCTTCCCTCTGGATCCAGCCCCTCTAGTTCCCTTTCACTTTGA | 5888 |
| | 1 | MDQGVEGGCGPGVGRQSACSL* | 5889 | ATGGACCAGGGGGTAGAGGGGGAGGTGGGTGGACCTGGGGTCGGGCGCCAGTCAGCTTGCAGCCTATGA | 5890 |
| | 2 | MKDGKEGYRDRGRVGLRIARAAWHTVLG* | 5891 | ATGAAGGACGGAAAGGAGGGCTACAGAGATAGGGGAAGAGTGGGGCTGAGGATAGCCAGAGCGGCTTGGCACACAGTTTAGGGTAA | 5892 |
| | 3 | MTEPVTPGSSFKACLMGDSVVPVTKLGPESQGRAHQVAALP* | 5893 | ATGACTGAGCGGTCACTCCAGGGTCTTCCTTCAAAGCGTGTCTAATGGGAGACAGCGTTGTCCCAGTAACCAAATTGGGACCCAGAGTCCAGGAAGGGCTCATCAGGTGGCCGCTCTGCCTTGA | 5894 |
| | 4 | MILFPLDPAPLVPFSL* | 5895 | ATGATTCTCTTCCCTCTGGATCCAGCCCCTCTAGTTCCCTTTCACTTTGA | 5896 |
| hsa-mir-377 | 1 | MDQGVEGGCGPGVGRQSACSL* | 5897 | ATGGACCAGGGGGTAGAGGGAGGTGGGTGGACCTGGGTCGGGCCAGTCAGCTTGCAGCCTATGA | 5898 |
| | 2 | MKDGKEGYRDRGRVGLRIARAAWHTVLG* | 5899 | ATGAAGGACGGAAAGGAGGGCTACAGAGATAGGGAAGAGTGGGGCTGAGGATAGCCAGAGCGGGCTTGGCACACAGTTTAGGGTAA | 5900 |
| | 3 | MTEPVTPGSSFKACLMGDSVVPVTKLGPESQGRAHQVAALP* | 5901 | ATGACTGAGCGGTCACTCCAGGGTCTTCCTTCAAAGCGTGTCTAATGGGAGACAGCGTTGTCCCAGTAACCAAATTGGGACCCAGAGTCCCAGGAAGGGCTCATCAGGTGGCCGCTCTGCCTTGA | 5902 |
| | 4 | MILFPLDPAPLVPFSL* | 5903 | ATGATTCTCTTCCCTCTGGATCCAGCCCCTCTAGTTCCCTTTCACTTTGA | 5904 |
| | 1 | MAGNDCGALLDEELSSFFLNYLADITQYRPAGAAGPGPGVLSCGGRSCSRGGREAAVGALG* | 5905 | AACTATCTCGCTACAACGGACTCGCGCGCAAGAGCTCTCTCCTTCCTCGGTGCTGAGCGTGCGGGGGCCCAGCGCGGGAGCCGGGACGCAGCGGTGGGAGCCCTGGGGTAA | 5906 |
| | 2 | MRSVTGAGSRRSPGACRSAGGATAAGEGLALAAWSLPPRGQNWGGYPRFLWEVEARHGVGYPQAGAGCWRRAVSARHLLPYFHVDLWPRHGCMPGSPESPSPPGCSPQSAVAGPPRLSTRARSAEFPASCRLKA* | 5907 | ATGCGCTCTGTTACCGGAGCCAGGAGCCGGAGGTCTCCGGCCGCGCTGGAGTCTGCCACCCCGGCGGGCAAAACTGGGGGGTACCGGCCTTCCTTTGGAGGCGGTCTAGCCTTGCGCAGAGCCGGCGACCACGGTGTGGGGGTACCCTCAGGCTGGGTGCAAGCCCGCCTGGGTGCTGGGACTTGTGACCTTGAGTTGTGGACGGCTCATGCCGGGCACTTGCTGGCGGATCTCCAGTTCTAGTCGCAGCGCGCTGTGTGCCGAGCCCCGGGGCGGGGAAGCCGGGAGCCAGGGGGAAGGCCGGAGCCGCCCCCCTGGCATAA | 5908 |
| hsa-mir-378 | 3 | MRAETASSWFRYRAEPPGGKSQAGWGRKDCLGAPGSPCGARPRCALHDAGGREGEAESQALAEPGSPTGDTRVTGEGALVCRGAGERGSWWLGDWERGAAGTSSHQKCQHEACAAPTPSPIFPTQELLQA* | 5909 | ATGCGGGCGGAGACAGCGTCTCCTGGTTCGCTATCGGCGGGACCCCTGGGGGGAAGCCAGGCTGGATGGGCGGAAGGACTGTCTGGGGCGCCCCCTGCGGTGCGCCAGGCACTGGCCCCACGATGGCAGGGGAGGCAGGAAGGAAGCGAGGCGGGTGCGGCCAGGCACTGGCCGAGCCCGGAGCGGCGCACGCGCGTGACAGGAGAGGGTGCTCTGGTGTGGGGAGCCGGGGAGCGGGGGGAAGCTGGTGCTTGGAGAGTGGGAGCGGCTGCTGTGGGAGCAAGCAGCCACCAACAAATTGCCCCACCCAATGCCTGTTGCAAGCATAA | 5910 |
| | 4 | MGAEGLSGGAWVPLRCAAPVRAPRCRGKGRRGGYVPGTG* | 5911 | ATGGGGCGGAGGCGCTCACGATGCAGGGGAAGGGAAGGGAGGCCGGAGTCCAGGCACT | 5912 |
| | 1 | MDQGVEGGCGPGVGRQSACSL* | 5913 | ATGGACCAGGGGGTAGAGGGAGGTGGGTGGACCTGGGTCGGGCGCCAGTCAGCTTGCAGCCTGA | 5914 |

Figure 1 (Continued)

| | | | | |
|---|---|---|---|---|
| hsa-mir-379 | 2 | MKDGKEGYRDRGRVGLRLARAAWHTVLG* | 5915 | ATGAAGGACGGAAAGGAGGGCTACAGAGATAGGGGAAGAGTGGGGCTGAGGATAG CCAGAGGCGGCTTGGCACACAGTTTAGGGTAA | 5916 |
| | 3 | MTEPVTPGSSFKACLMGDSVVPVTKLLGPESQGRAHQV AALP* | 5917 | ATGACTGAGCCGGTCACTCCAGGGTCTTCCTTCAAAGCGTGTCTAATGGGAGACAGC GTTGTTCCCAGTAACCAAATTGGGACCAGAGTCCCAGGGAAGGCGTCATCAGGTGGC CGCTCTGCCTTGA | 5918 |
| | 4 | MILFPLDPAPLVPFSL* | 5919 | ATGATTCTCTTCCCTCTGGATCCAGCCCCTCTAGTTCCCTTTCACTTTGA | 5920 |
| hsa-mir-380 | 1 | MDQGVEGGGCGPGVGRQSACSL* | 5921 | ATGGACCAGGGGGTAGAGGGAGGGCTGCAGAGATAGGGAAGAGTGGGGCTGAGGATAG CTTGCAGCCTATGA | 5922 |
| | 2 | MKDGKEGYRDRGRVGLRLARAAWHTVLG* | 5923 | ATGAAGGACGGAAAGGAGGGCTACAGAGATAGGGGAAGAGTGGGGCTGAGGATAG CCAGAGCGGCTTGGCACACAGTTTAGGGTAA | 5924 |
| | 3 | MTEPVTPGSSFKACLMGDSVVPVTKLLGPESQGRAHQV AALP* | 5925 | ATGACTGAGCCGGTCACTCCAGGGTCTTCCTTCAAAGCGTGTCTAATGGGAGACAGC GTTGTCCCAGTAACCAAATTGGGACCAGAGTCCCAGGGAAGGCTCATCAGGTGGC CGCTCTGCCTTGA | 5926 |
| | 4 | MILFPLDPAPLVPFSL* | 5927 | ATGATTCTCTTCCCTCTGGATCCAGCCCCTCTAGTTCCCTTTCACTTTGA | 5928 |
| hsa-mir-381 | 1 | MDQGVEGGGCGPGVGRQSACSL* | 5929 | ATGGACCAGGGGGTAGAGGGGTGTGGAAGAGTGGGGCTGGGTCGGGCGCCAGTCAG CTTGCAGCCTATGA | 5930 |
| | 2 | MKDGKEGYRDRGRVGLRLARAAWHTVLG* | 5931 | ATGAAGGACGGAAAGGAGGGCTACAGAGATAGGGCAAGAGTTGGGCTGAGGATAG CCAGAGCCGGCTTGGCACACAGTTTAGGGTAA | 5932 |
| | 3 | MTEPVTPGSSFKACLMGDSVVPVTKLLGPESQGRAHQV AALP* | 5933 | ATGACTGAGCCGGTCACTCCAGGGTCTTCCTTCAAAGCGTGTCTAATGGGAGACAGC GTTGTCCCAGTAACCAAATTGGGACCAGAGTCCCAGGGAAGGCTCATCAGGTGGC CGCTCTGCCTTGA | 5934 |
| | 4 | MILFPLDPAPLVPFSL* | 5935 | ATGATTCTCTTCCCTCTGGATCCAGCCCCTCTAGTTCCCTTTCACTTTGA | 5936 |
| hsa-mir-382 | 1 | MDQGVEGGGCGPGVGRQSACSL* | 5937 | ATGGACCAGGGGGTAGAGGGGTGTGGAACCTGGGGTCGGGCGCCAGTCAG CTTGCAGCCTATGA | 5938 |
| | 2 | MKDGKEGYRDRGRVGLRLARAAWHTVLG* | 5939 | ATGAAGGACGGAAAGGAGGGCTACAGAGATAGGGGAAGAGTGGGGCTGAGGATAG CCAGAGCGGCTTGGCACACAGTTTAGGGTAA | 5940 |
| | 3 | MTEPVTPGSSFKACLMGDSVVPVTKLLGPESQGRAHQV AALP* | 5941 | ATGACTGAGCCGGTCACTCCAGGGTCTTCCTTCAAAGCGTGTCTAATGGGAGACAGC GTTGTCCCAGTAACCAAATTGGGACCAGAGTCCCAGGGAAGGCTCATCAGGTGGCC CGCTCTGCCTTGA | 5942 |
| | 4 | MILFPLDPAPLVPFSL* | 5943 | ATGATTCTCTTCCCTCTGGATCCAGCCCCTCTAGTTCCCTTTCACTTTGA | 5944 |
| hsa-mir-383 | 1 | MRDKEGGRYIKHYTCAWQYRITSSPGLFLIIVSRKDPLA YLSPSLQDGPESSHLFIECSRRWNSYCKRKYTTPGESIVL VFQDCFRLIWILIY* | 5945 | ATGAGGGACAAAGAGGGAGGAGGTATATCAAAAACATTATACATGTCTTGGCAATA CAGAACTTCATCATTTGTTTCCGTAAAGACCCCTCTGCC TATCTTTCATTTCTCTGCCAAGATGGACCTAGAGTGACCTAGCCATTTATTATTGAATGTT CCAGAAGATGGAATTCATATGCAAAAGAAATACACTACCCCTGGAGAGAGTATA GTTTTTAGATATTTGAGACTCATTGGATCCGATTCTGATTTATTGA | 5946 |
| | 2 | MCLAIQNFIIWFVPTYCFP* | 5947 | ATGTGCTTGGCAATACAGAACTTCATTTGTTCCTACTTATTGTTCCCGTAA | 5948 |
| | 3 | MDLRVAIYLLNVPEDGIIHLAKENTLPLERV* | 5949 | ATGGACCTGAGAGTAGCCATTTATTTATTGAATGTTCCAGAAGATGGAATTCATATT GCAAAAGAAATACACTACCCCTGGAGAGAGTATAG | 5950 |
| | 4 | MFQKMEFILQKKIHYPWREYSFSISGLF* | 5951 | ATGTTCCAGAAAATGGAATTCATATTGCAAAAGAAAATACACTACCCTGGAGAGA GTATAGTTTTTAGATATTTGGAGATTGTTTTAG | 5952 |
| hsa-mir-409 | 1 | MDQGVEGGGCGPGVGRQSACSL* | 5953 | ATGGACCAGGGGGTAGAGGGAGGTGTGGACCTGGGGTCGGGCGCCAGTCAG CTTGCAGCCTATGA | 5954 |
| | 2 | MKDGKEGYRDRGRVGLRLARAAWHTVLG* | 5955 | ATGAAGGACGGAAAGGAGGGCTACAGAGATAGGGGAAGAGTGGGGCTGAGGATAG CCAGAGCGGCTTGGCACACAGTTTAGGGTAA | 5956 |

Figure 1 (Continued)

| | | | | | |
|---|---|---|---|---|---|
| hsa-mir-410 | 3 | MTEPVTPGSSFKACLMGDSVVPVTKLGPESQGRAHQVAALP* | 5957 | ATGACTGAGCCGGTCACTCCAGGGTCTTCCTTCAAAGCGTGTCTAATGGGAGACAGCGTTGTCCCAGTAACCAAATTGGGACCAGAGTCCCAGGGAAGGGCTCATCAGGTGGCCGCTCTGCCTTGA | 5958 |
| | 4 | MILFPLDPAPLVPFSL* | 5959 | ATGATTCTCTTCCCTCTGGATCCAGCCCCTCAGTTCCTTTCACTTTGA | 5960 |
| | 1 | MDQGVEGGGCGPGVGRQSACSL* | 5961 | ATGGACCAGGGGGTAGAGGGGGGCTACAGAGGAGGGCTGGGGTCGGGCGCCAGTCAGCTTGCAGCCTATGA | 5962 |
| | 2 | MKDGKEGYRDRGRVGLRIARAAWHTVLG* | 5963 | ATGAAGGACGGAAAGGAGGGCTACAGAGATAGGGGAAGAGTGGGGCTGAGGATAGCCAGAGCGGCTTGCACAGTTTAGGGTAA | 5964 |
| hsa-mir-411 | 3 | MTEPVTPGSSFKACLMGDSVVPVTKLGPESQGRAHQVAALP* | 5965 | ATGACTGAGCCGGTCACTCCAGTAACCAAATTGGGACCAGAGTCCCAGGGAAGGCTCATCAGGTGGCCGCTCTGCCTTGA | 5966 |
| | 4 | MILFPLDPAPLVPFSL* | 5967 | ATGATTCTCTTCCCTCTGGATCCAGCCCCTCAGTCCTTTCACTTTGA | 5968 |
| | 1 | MDQGVEGGGCGPGVGRQSACSL* | 5969 | ATGGACCAGGGGGTAGAGGGAGGTGGTGTGGACCTGGGGTCGGGCGCCAGTCAGCTTGCAGCCTATGA | 5970 |
| | 2 | MKDGKEGYRDRGRVGLRIARAAWHTVLG* | 5971 | ATGAAGGACGGAAAGGAGGGCTACAGAGATAGGGGAAGAGTGGGGCTGAGGATAGCCAGAGCGGGCTTGCACACAGTTTAGGGTAA | 5972 |
| hsa-mir-412 | 3 | MTEPVTPGSSFKACLMGDSVVPVTKLGPESQGRAHQV AALP* | 5973 | ATGACTGAGCCGGTCACTCCAtGGGTCTTCCTTCAAAGCGTGTCTAATGGAGACAGCGTTGTCCCAGTAACCAAATTGGGACCAGAGTCCCAGGGAAGGCTCATCAGGTGGCCGCTCTGCCTTGA | 5974 |
| | 4 | MILFPLDPAPLVPFSL* | 5975 | ATGATTCTCTTCCCTCTGGATCCAGCCCCTCAGTTCCTTTCACTTTGA | 5976 |
| | 1 | MDQGVEGGGCGPGVGRQSACSL* | 5977 | ATGGACCAGGGGGTAGAGGGGTAGAGGAGGGCTACAGAGGAGGTGGGGTCGGGCGCCAGTCAGCTTGCAGCCTATGA | 5978 |
| | 2 | MKDGKEGYRDRGRVGLRIARAAWHTVLG* | 5979 | ATGAAGGACGGAAAGGAGGGCTACAGAGATAGGGGAAGAGTGGGGCTGAGGATAGCCAGAGCGGGCTTGCACACAGTTTAGGGTAA | 5980 |
| | 3 | MTEPVTPGSSFKACLMGDSVVPVTKLGPESQGRAHQV AALP* | 5981 | ATGACTGAGCCGGTCACTCCAGGGTCTTCCTTCAAAGCGTGTCTAATGCAGACAGCGTTGTCCCAGTAACCAAATTGGGACCAGAGTCCCAGGGAAGGCTCATCAGGTGGCCGCTCTGCCTTGA | 5982 |
| | 4 | MILFPLDPAPLVPFSL* | 5983 | ATGATTCTCTTCCCTCTGGATCCAGCCCCTCAGTTCCTTTCACTTTGA | 5984 |
| hsa-mir-421 | 1 | MTITKNV* | 5985 | ATGACAATTAACATGACATGCATGTTTATAA | 5986 |
| | 2 | MFNMDMRML* | 5987 | ATGTTTAACATGGACATGCATGTTATAA | 5988 |
| | 3 | MLKTKHNK* | 5989 | ATGTTAAAAACAAAACACAATATAAAATAG | 5990 |
| | 4 | MQRMK* | 5991 | ATGCAGAGAATGAAGTGA | 5992 |
| | 1 | MVYGRGAHKYHFLRIYPDHVIRISSFKSISR* | 5993 | ATGGTGTGGGAGAGGAGCACACAAGTACCACATTTCTGAGGATTGTGCCAGACCATGTCATACGTATAAGCTCATTCAAATCGATTTCCAGATAA | 5994 |
| | 2 | MSYV* | 5995 | ATGTCATACGTATAA | 5996 |
| hsa-mir-422a | 3 | MCAVEPVGTRRGSCYRLSPLSRESGSPEVSPTRPGSWAL APGLSGGJSSRGRPEPRPGQPGAAPPAGAWDGAGRSAPS APRLLGGRVPGALGGEDCRAEPSAPRRVPPRSRRARRARRARRSRRAACRGRDRGSSASRRE* | 5997 | ATGTGCGCGGTAGAGCCCGGTAGGAGCCGCAGAGGGTCTTGCTACCGACTCTCCCGCTCTCCGGAGAGTCTGGGAGCCCTGAGGTCCCTACCGGCCGGGAAGCTGGGACCCGGGACTGTCCGGAGGGCTCAGCAGGGGCGCCGAGCCCGTCCGGGCAGCCGGCCCTCAGCTGGTCTGGGCGGGGCGCGCTGGGACGGCCTGCGGCCACCCCCTCCGGCTCCTAGCTGCTCGCGGGGACCCAGCGACCCGCGGGGCTCCCGTTCCGCGAGAGGACTGCAGGGCCGGACCGGGCACCCAGCCTCAGCCTGAGGTAG | 5998 |
| | 4 | MGGTGRAA* | 5999 | ATGGCGGGACCGGGCGCGGCAGGCAGTGA | 6000 |
| | 1 | MAPGRQ* | 6001 | ATGGCGATTCCGGGCAGGCAGTGA | 6002 |

Figure 1 (Continued)

| | | | | | |
|---|---|---|---|---|---|
| hsa-mir-423 | 2 | MRNYGDCIFGRGVLNALEVKGLCRQG* | 6003 | ATGAGAAACTACGGTGACTGTATCTTTGGCCGAGGAGTTTAAATGGCTGGAAGTG AAGGGACTGTGTCGAAGTGA | 6004 |
| | 3 | MRWK* | 6005 | ATGCGCTGGAAGTGA | 6006 |
| | 4 | MEARSLREKLVRK* | 6007 | ATGGAAGCCGAAGTTTGAGCGAGAAAACTTGTGAGGAAATAA | 6008 |
| hsa-mir-424 | 1 | MIQMSNCLYLTLFVYLQK* | 6009 | ATGATCCAGATGTCAATGCCTCTTAACCTTATTCGTCTACCTTCAGAAGTAA | 6010 |
| | 2 | MVKL* | 6011 | ATGGTCAAGTTATAA | 6012 |
| | 3 | MVQNVRRCYTFSWGR* | 6013 | ATGGTTCAAAACGTGAGGCGCTGTATACCCCCTGTGGGAAGGTAG | 6014 |
| | 4 | MMLHFGTPFPCSGRM* | 6015 | ATGATGCTTCATTTTGGCACCCCTTTCCTGCTCAGGTAGAATGTAA | 6016 |
| | 1 | MGEVYKLLC* | 6017 | ATGGGAGAAGTGTATAAATTATTGTGA | 6018 |
| | 2 | MLISKISAKG* | 6019 | ATGTTGATAAGCAAGATAAGTTGCCAAAGGGTAG | 6020 |
| hsa-mir-425 | 3 | MRAAPVTRPS* | 6021 | ATGAGAGCAGCTCCAGTTACTCGGCCTTCATGA | 6022 |
| | 4 | MTQEVEGGTCRGLQRKGQHQPV* | 6023 | ATGACACAGAAGTTGAAGGTGCACAGGCATTGGGCTGCAAAGAAAAGGCCAGCA TCAGCCTGTCTAG | 6024 |
| hsa-mir-425 | 1 | MGSQGSRVGRAGWVPEAEAQCTSGAQRAAMLEQRRR RRGASWVPAAAPVCGWSRGHPSRAAEGRPARRQCGRASG QLFDPRPPAWPRPTPPPPRAQRPHPGAVRSR* | 6025 | ATGGGGTCTCAGGGTCAAGGGTCGTTAGGGTGGTATGGCGTGGCTGGTTCCGGAAGCGGAAGC GCAGTGCACTTCCGGCGCGTCTTGGGTCCCGGCGCAGCGGAGCGGAGGCGGCGCA GAGGCGCGTCTTGGGTCCCGCGGCGGCGCCATGTTGGAGCAGCGGAGGCGGCGCA GCGCGCGAGAGGCGCCGTGAGGCGGCAAGGGCAAGCGGCCAAC TCTTCCCGGACCCGGGTCTTCCGCGGGCCTCAGCCGAGACCCCCGACCCCCCTCAAC CCCGCGCCCAGCGACCCCAGGGGCTGTGCGGGTCGGGTCCGGTAG | 6026 |
| | 2 | MCKDCAWRTVSGEGKCPRHLRIQECFQTKSPRAFPPGY SEDFCCIRAVGRNYTDGPHGPRDLPDPG* | 6027 | ATGTGCAAGGATTGTGCTTGGGAGGGAAGTTGCCAAGACA CCTGAGGATCCAAGAATGTTTCAAACAAAGAGCCCTAGGGCATTCCTCCAGGGTA TTCTGAAGACTTCATCTGCTGCATTAGAGCGCGTTGGGAAGAACTACAGACGGGC CTCATGCGCCCAAACAAAGAGCCCTAG | 6028 |
| | 3 | MFPNKEP* | 6029 | ATGTTTCCAAACAAAGAGCCCTAG | 6030 |
| | 4 | MARGTCLILADLMLWCSWGAASCFWEPSVLGWVLDV SYD* | 6031 | ATGGCCCGAGGCACCTGTCTGATCTTTTAATGCTCGTGGCAGCTGG GGAGCTGCCTCTTGCTTCTGGAACCCTGCAGTTTGGGTTGGGTATTAGATGTTAGT TATGATTGA | 6032 |
| | 1 | MGCRQPGQRPGELRSLQTQAGAGPSPPQGKVGPCADA AGFRVWSHLGPTGCVFRARAQCVGSRHGVYPSGQGLGR GQAPRGVTFLPPT* | 6033 | ATGGGCTGTCGCCAGCCTGGCCAGGGAGCTCCGGTCACTGCAGACACA GGCTGAACCCGGACCGGTCCTTCAGGGAAAGTGGGCCCCTGCCAGATCGG CTGGGTTCGGGGTGGCGCTCCAGGATCATCTTGGACCCACGGGCTGCGCTTCCGGGCACGGG CACAGTGTGTGGCCTCCAGGAGGGTCACTTCTTGCCGCTACCTGA | 6034 |
| | 2 | MRLGFGCGAILDPRAASSGHGHSVWAPGMGCPQGRAW AEGRLREGSRSCRLFDSRPSRKFSPEAATAVLRHFVRRR EAVASEVGA* | 6035 | ATGCGGCTGGGTTTCGGGTGTGGAGCCATCTTGGACCCACGGGCTGCTTCTTCCGGG CACGGACACAGTGTGTGGGCTCCAGGCATGGAGTGCCCCAAGGCAGGGCTGGGC AGAGGGCAGGCTCGAGAGGCACCTCGAGAGTTCTGCGCTACCTGAGCACTTTGTGCGGAGAC CTAGAAGTTCTCTGCCTCAGAAGTTGTGTGCGTAG | 6036 |
| | 3 | MTASPLGSGVCGGKGLVSAPSGQRPAEPMGGEVGAWG RGWSGTGAQPGEAGAGSQAPRYDWGGGNVSREVFY LNVKRLSTVAAAGNKVRPTEAQP* | 6037 | ATGACCGGTCTCCTGGCTGGGTGCTGGGGAAGGCTGGTTTCAGCA CCCTCTGGTCAGAAGCCGGACCGGGCGGTCGGGGAAGGCCCCCAGG TGGCTGCTGGTACTGACCAGTTGGGGGCTCAGAAGGTGAGCGGTTCCAGG CCCGCGCTATGACTGGGGTGGGGAACGTCTCTGTGAGGTTTTTACTTAAATG TGAAACGGCTCAGTAGGCTGGCGCAGCGGGAACAAGGTCCGACCCCACCGAGGCC CAGCCTTGA | 6038 |
| | 4 | MTGVGATSLVRFT* | 6039 | ATGACTGGGGTGGGGCAACGTCTCGTGAGGTTTTACTTAA | 6040 |
| | 1 | MVNPILCT* | 6041 | ATGGTTAATCAATTCTGTGCACCTGA | 6042 |
| hsa-mir-429 | 2 | MTERMNGHMND* | 6043 | ATGACAAGAAATGAATGGACATGAACGACTGA | 6044 |

Figure 1 (Continued)

| | | | | |
|---|---|---|---|---|
| hsa-mir-431 | 3 | MEMPGTARKELPMGLSPISLWAPEVHKREKRQEEKCQGVKIDRAKERQK* | 6045 | ATGGAAATGCCTGGCACAGCCAGGAGGAGCTGCCCATGGGATTGTCATTCATCTCACTCTGGGCACCTGAGGTCCATAAGCGTGAAAGAGGCAGGAAGAAGTGTCAGGGAGTCAAAGATAGAGCTAAGGAAAGGCAAAAATGA |
| | 4 | MKLNESERENKEKPIKKRTNTWVYL* | 6046 | ATGAAACTAAATGAAAGRGAAAATAAAGAAAATAAAGAGAAA |
| | | | 6047 | CGAATACGTGGGTATCTGTAA |
| | 1 | MVNPILCT* | 6048 | ATGGTTAATCAATTCTGTGCACCTGA |
| | | | 6049 | |
| | 2 | MTERMNGHMND* | 6050 | ATGACAGAAGAATGAATGGACAATGAACGACTGA |
| | | | 6051 | |
| hsa-mir-432 | 3 | MEMPGTARKELPMGLSPISLWAPEVHKREKRQEEKCQGVKIDRAKERQK* | 6052 | ATGGAAATGCCTGGCACAGCCAGGAGGAGCTGCCATGGGATTGTCATTCATCTCACTCTGGGCACCTGAGGTCCATAAGCGTGAAAGAGGCAGGAAGAAGTGTCAGGGAGTCAAAGATAGAGCTAAGGAAAGGCAAAAATGA |
| | | | 6053 | |
| | 4 | MKLNESERENKEKPIKKRTNTWVYL* | 6054 | ATGAAACTAAATGAAAGCGAAAATGAAAAGAAAACCAATAAAAGAGAAACGAATACGTGGTGTATCTGTAA |
| | | | 6055 | |
| | 1 | MVNPILCT* | 6056 | ATGGTTAATCAATTCTGTGCACCTGA |
| | | | 6057 | |
| | 2 | MTERMNGHMND* | 6058 | ATGACAGAAAGAATGAATGGACACATGAACGACTGA |
| | | | 6059 | |
| hsa-mir-433 | 3 | MEMPGTARKELPMGLSPISLWAPEVHKREKRQEEKCQGVKIDRAKERQK* | 6060 | ATGGAAATGCCTGGCACAGCCAGGAGGAGCTGCCATGGATTGTCATTCATCTCACTCTGGGCACCTGAGGTCCATAAGCGTGAAAGAGGCAGGAAGAAGTGTCAGGGAGTCAAAGATAGAGCTAAGGAAAGGCAAAAATGA |
| | | | 6061 | |
| | 4 | MKLNESERENKEKPIKKRTNTWVYL* | 6062 | ATGAAACTAAATGAAAGCGAAAATAAAGAAAACCAATAAAAGAGAAACGAATACGTGGGTATCTGTAA |
| | | | 6063 | |
| hsa-mir-443 | 1 | MLSADWLLLAPPLIPLLAQERGADSPARGRRSGACCGRFLPQMHRSSRYCLWSG* | 6064 | ATGCTGAGTGCTGATTGGCTGCTCTCGCCCTCATCCGCTTTTGGCCAAGAGCGTGGTGCAGATTCACCTGCCGTAGGCGCTCTGGTGCTTGGCGGAAGGACGCTTCCTTCCTCAGATGCACGTCACGGGTCGATACTGCCTTTGGAGGGCTAG |
| | | | 6065 | |
| | 2 | MNSSSVVCTSLSSESSRSSWRSCDGLRPFRVV* | 6066 | ATGAACTCTTCTTCTGTGCTGTACATCGTTGTCGTCGGAGTCGTCGATCGTCGTCGTGGCGCTCGTGTGATGGCCTTGTGCCCGTTTAGAGTAG |
| | | | 6067 | |
| | 3 | MAFVRLE* | 6068 | ATGGCCTTCGTGAGGCTGTTTAGAGTAG |
| | | | 6069 | |
| | 4 | MLEVVSY* | 6070 | ATGCTCGAGGTCGTCAGTTACTAA |
| | | | 6071 | |
| hsa-mir-449a | 1 | MVPWGTPCSGGGRSGGPGGRW* | 6072 | ATGGTACCCTGGGGAACACCTTGCAGCGGGCGGTGGGAGGAGGTGGGGGACCTGGAGG |
| | | | 6073 | |
| | 2 | MVLGDGTPGV* | 6074 | ATGGTCCTGGGGACGGGACTCCAGGGGTTGA |
| | | | 6075 | |
| | 3 | MEWKLERTAPRRVRTEEEMLWVSNTLFCILPNSLMRGRRPRS* | 6076 | ATGGAGTGGAAACTGGAGCGCACCGCGCCTCGGAGGTCCGCACGGAAGGAGATGCTGTGGGTGAGTAACACCCTTTTCTGCATTCTCCCTAACCTCTAATGCGGGGCCGAAGGCCCGTTCATAA |
| | | | 6077 | |
| hsa-mir-449b | 4 | MIFLNSFSLNMLSYFSKESIMRVLSKDLKQKRSQDSANVSPGLVLVLCFNSDLEQTNSW* | 6078 | ATGATTTTCCTAAATAGTTTCTCCCTCAATATGTTATCTGTTTCAAGGAAAGTATCATGCGTGTGCTCTCAAAGACTTGAAGCAGAGAAGATTCGCAACTGAGTCCAGGGTCTGTTCTCGTTTTAATTCTGATCTTGAACAAACGAATTCTTGGTAA |
| | | | 6079 | |
| | 1 | MVPWGTPCSGGGRSGGPGGRW* | 6080 | ATGGTACCCTGGGGAACACCTTGCAGCGGGCGGTGGGAGGAGGTGGGGGACCTGGAGG |
| | | | 6081 | |
| | 2 | MVLGDGTPGV* | 6082 | ATGGTCCTGCGCGACGGGACTCCAGGGGTTGA |
| | | | 6083 | |
| | 3 | MEWKLERTAPRRVRTEEEMLWVSNTLFCILPNSLMRGRRPRS* | 6084 | ATGGAGTGGAAACTGGAGCGCACCGCGAGCGCACCGCCTCGGAGGGTCCGCACCCTTTTCTGCATTCTCCTAACTCTCTAATGCGGGGCCGAAGGCCCG |
| | | | 6085 | |
| | | | 6086 | |

Figure 1 (Continued)

| | | | | | |
|---|---|---|---|---|---|
| | 4 | MIFLNSFPSLNMLSVFSKESIMRVLSKDLKQKRSQDSANVSPGLVLVLCFNSDLEQTNSW* | 6087 | ATGATTTCCTAAATAGTTCTCCTCAATATGTTATCTGTGTTTCAAAGGAAAGTATCATGCTGTGTCTGCTCTCCAAAGACTTGAAGCAGAAGAGAAGTCAAGATTCCGCCAACGTGAGTCCAGGGCTTGTTCTGTTCTCTGTTTAATTCTGATCTTGAACAAACGAATTCTTGGTAA | 6088 |
| hsa-mir-450a-1 | 1 | MIQMSNCLYLTLFVYLQK* | 6089 | ATGATCCAGATGTCCAATTGCCTCTACTTAACCTTATTGGTCTGAGAAGTAA | 6090 |
| | 2 | MVKL* | 6091 | ATGGTGAAGTTATAA | 6092 |
| | 3 | MVQNVRRCYTPSWGR* | 6093 | ATGGTTCAAAACGTGAGGCGTGTATACCCCTCGTGGGAAGGTAG | 6094 |
| | 4 | MMLHFGTPFPCSGRM* | 6095 | ATGATGCTTCATTTTGGCACCCCTTTCCGTGCAGGTAGAAATGTAA | 6096 |
| | 1 | MIQMSNCLYLTLFVYLQK* | 6097 | ATGATCCAGATGTCCAATTGCCTCTACTTAACCTTATTGTCTCAGAAGTAA | 6098 |
| hsa-mir-450a-2 | 2 | MYKL* | 6099 | ATGGTGAAGTTATAA | 6100 |
| | 3 | MVQNVRRCYTPSWGR* | 6101 | ATGGTTCAAAACGTGAGGCGTGCTATACCCCTCGTGGGAAGGTAG | 6102 |
| | 4 | MMLHFGTPFPCSGRM* | 6103 | ATGATGCTTCATTTTGGCACCCCTTTCCGTGCTCAGGTAGAAATGTAA | 6104 |
| hsa-mir-450b | 1 | MIQMSNCLYLTLFVYLQK* | 6105 | ATGATCCAGATGTCCAATTGCCTCTACTTAACCTTATTGTCTCAGAAGTAA | 6106 |
| | 2 | MVKL* | 6107 | ATGGTGAAGTTATAA | 6108 |
| | 3 | MVQNVRRCYTPSWGR* | 6109 | ATGGTTCAAAACGTGAGGCGTCTATACCCCTCGTGGGAAGGTAG | 6110 |
| | 4 | MMLHFGTPFPCSGRM* | 6111 | ATGATGCTTCATTTTGGCACCCCTTCCGTGCTCAGGTAGAATGTAA | 6112 |
| hsa-mir-451 | 1 | MLVGAGMLAVSASCCCYPWEPGNVALGQGPA* | 6113 | ATGCTGGTAGGCGCGGGTAATCTGCAGTTCAGCTTCTGCGTTGTTGCTACCCTTGGGAACCTGGCAATGTGCCCTGTGAGCAAGGCCCAGCTGA | 6114 |
| | 2 | MLPLAKAQLELWQPAFQAKE* | 6115 | AAGTTGCCCTTGCCAAGGCTCAGCTGAGCTGTGGCAGCCTGTCCCAAGCCAAAGAATAA | 6116 |
| hsa-mir-452 | 3 | MPVIPALWAPKAGRSPEVRSSRPARPTWRNPISTNNLKISQTWWWLPVIPATWEAEAGESLESGRRKLH* | 6117 | ATGCCTGTGATCCCAGCACTTTGGGCACCTAAGGCACAGGCAGATCCAGAGGTTCGAGCAAGTTCAGGTCAGCCCGGCTCAACATGGCGAAACCCATCTCTACTAACAATTTAAAGATTAGCCAGACGTGGTGGTTGCCTGTAATCGCAGCACTTGGGAGCGCGGAAGTTGCATTGAAGGAGAATCACTTGAATCTGGGAGGCGGAAGTTGCATTGA | 6118 |
| | 4 | MAKPHLY* | 6119 | ATGGCGAAACCCCATCTCTACTAA | 6120 |
| | 1 | MLSKVLPVLLGILLIHLQSR* | 6121 | ATGTTGTCCAAAGTTCTTCCAGTCCTCCTAGGCATCTTATTGATCCTCCAGTCGGGTTGA | 6122 |
| | 2 | MRAGLGPPHCRMGSRGP* | 6123 | ATGCGCGCGCTCGGCCTCGGACCGCCGCACTGTAGGATGGGCTCCGGGGTCCTTGA | 6124 |
| hsa-mir-453 | 3 | MCECCLVCSLLTFFLRVPIEFQALRQATLTLLASHAAAPVGASLRHELWFSLRVPAPAMPPLHR* | 6125 | ATGTGTGAGTGTTGCCTGGTCTGCTCGTTGTTACATTTTTTAAGAGTGCTACTGAGTTCCAGGCACTCTCGACAAGGCAGCCAACTCTGACATTACTGCTCCATGCCGCTGCTCCTGTTGGTGCCAGTCAAGGCACGAGCTCTGGTTAGTCTAAGGGTTCCGCAC | 6126 |
| | 4 | MPLLLLVPYSGTSFGLV* | 6127 | ATGCCGCTCTCCTCCTGTTGTGCCAGTCAAGCGCACGAGCTTTGGTTAGTCTAA | 6128 |
| | 1 | MDQGVEGGCGPGVGRQSACSL* | 6129 | ATGGACCAGGGCGGTGAGGGTAGAGGAGGGCTGGGGTCGGGCGTCCAGTCAG | 6130 |
| hsa-mir-454 | 2 | MKDGKEGYRDRGRVGLRIARAAWHTVLG* | 6131 | ATGAAGGACGGAAAGGAGGGCTACAGAGATAGGGGAAGAGTGGGCTGAGGATAGCCAAGGGGCTTGGCACACAGTTTTAGGGTAA | 6132 |
| | 3 | MTEPVTPGSSFKACLMGDSVYPVTKLGPESQGRAHQVAALP** | 6133 | ATGACTGAGCCGGTCACCCCAGGTTCTTCCTTCAAAGCGTGTCTAATGGGAGACAGCGTTGTCCAGTAACCAAATTGGGACCAGAGTCCCAGGGAAGGCTCATCAGGTGGCCGCTCTGCCTTGA | 6134 |
| | 4 | MILPLLRPAPLVPFSL* | 6135 | ATGATTCTCTTCCTCCTGAGATCAGCCCCTCTAGTTCCTTCACTTGA | 6136 |
| hsa-mir-454 | 1 | MGGSRWNGGANECEMLSDSCPMEALRASTACGLSAAAVCGMSTIQHGGGR* | 6137 | ATGGGCGGGAGCCGGTGGAACGGGGAACGAGGAGCAATGAGCTAGTACGCTGCGGTCAACATGGAGGCGGAGTGCGATAA | 6138 |
| | 2 | MSARC* | 6139 | ATGAGTGCGAGATGTGA | 6140 |

Figure 1 (Continued)

| | | | | |
|---|---|---|---|---|
| | 3 | MEAEVIDKLELMVSAK* | 6141 | ATGGAGGCGGAGGTCGATAAGCTGGAACTGATGGTGAGTGCAAAGTGA | 6142 |
| | 4 | MASEVGHNLESPETPGGgGWTRVEFPPAPKGAAITVW CLNRLG* | 6143 | ATGGCCTCGGAGGTGGGGCACAACTTGGAGTCGCCGAAAACTCCGGCGGCGGAGG CTGGACCAGAGTCGAGTTCCCTCCTGCACCAAAGGGAGCCGCCACCGTCTGGTG TCTAAACCGCCTCGGGTAA | 6144 |
| hsa-mir-455 | 1 | MGNHCYPLDNNYCLVGNHCYLLENKYCLMGKHCYLL DNKY* | 6145 | ATGGGTAACCACTGTTACCCACTGTGAAATAATATTATTGCCTTGTGGTAACCACTGT TACCTGCTGGAAATAATATATTGCCTCATGGGTAAACACTGTTACCTGCTGGATAAT AAGTATTGA | 6146 |
| | 2 | MGNTCYPVDNKYGLMGNHC* | 6147 | ATGGGTAACACCTGTTACCCTGTGGATAATAAGTATGGCCTCATGGGTAACCACTGT TAA | 6148 |
| | 3 | MASWVTVNRWHSTGSWVTTVTQWHSIPSWVTTVTIW WHSTASSVTTVTVTRWHNIASWVATVTQWHSIASWVTTHT WWHSVASWLTTVIQWHSVAS* | 6149 | ATGGCCTCATGGGTAACCACTGTTACCGTGGATAATAAGTACTGGCTCATGGGTA ACCACTGTTACCCAGTGGATAATAAGTATTCCTTCATGGGATGGACAGTGTACCTGG TGGATAATAAGTACTGGCTCATCAGTAACCACCTGTTACCTGGTGGATAATAAGTATT GCCTCATGGGTAGCCACTGTTACCCAGTGGATAATAAGTGTTGCCTCGTAACACTGT TGCCTCATGGGTAACAGTGTTACCACTGTTACCCAGTGAATAAGTATTGTGCTCTGGGT ACTATTACCTGGTGGATAATAAGTGTTGCCTCTGGTAACCACTGTTACCCAGTGGAT AATAAGTGTCCAGTGGAACAGTGTTGCCTCGTTAATAATAAGTGTTGCCTCAGTGG ATAATAAGTGTTGCCTGTGA | 6150 |
| | 4 | MGNHCYPVDNKYSFMGNHCYLVDNKYCLISNHCYSV DNKYCLMGSHCYLVDNKYCLVGNHYYLVDNKCCLLV NHCYPVDNKCCLVSNHCYLLDNNCCLMGNHCYPMHH KCCLVGNHCYQVDNKYFLWVTTVTRCHSVAFCVTTVT QWTHSIASWITTVTKWKHIASWVTTVTLWHGIASWVTT ATRWVISITSWVNTVTQWHSVASWVTSYTRWHNVA* | 6151 | ATGGGTAACCACTGTTACCCAGTGGATAATAAGTATTCCTTCATGGGTAACCACTGT TACCTGGTGGATAATAAGTACTGCCTCATCAGTAACCACTGTTACCTGGTGGATAAT AAATATTGCCTCATGGGTAGCCACTGTTACCCAGTGGATAATAAGTATTGCCTCTGT GGTAACCACTATTACCTGGTGGATAATAAGTGTTGCCTCGTTAACCACTGTTAT TGTGCCTCATGGGAACCACTGTTACCAATGCATCATAAGTGTTGCCTCTGGATAAATAAT AACCACTGTTACCAAGTGGATAATAAGTATTTCTGTGGGTAACCACTGTTACCCGG TGTATAATAAGTGTTGCCTTCTACCAGTGGACAATAAGTATTGCCTCATGGGTAACC GCCTCATGGATAACCACTGTTACCAGTATTGCCTGTGGGTAACCACTGTTACCCATGGGTAACC ACTGTTACCCTGTGGATAATAAGTGTTACCCGTGGTAACCACTGTGATAATAAGTGTTGCC TCGTGGGTAACCAGTGTTACCCGTGTTACCCAGTGAATAAATGTTGCTTAG | 6152 |
| | 1 | MCDSCLAGPGLRGAG* | 6153 | ATGTGTGATTCGTGCCTTGCGGGCCAGGAGACGGGGAAGCGCTGCGGGTAA | 6154 |
| | 2 | MLTRCQRDRERKTGVGGARMERGVGRSHGRRHIRDI SPTPPLALSATFPNRSPGRGGEGLLV* | 6155 | ATGTTGACCAGGTGCCAGCGAGATCGCGAGCGGGAGAAGACGGGGGTGGCGGGGGCCA GGATGGAGAGGGGGCCAGTTGGCACGGCCATGCGGCAGGAGTCGGACATC TCCCCACACGCCCCCTCTGCTCTGTCCGCAACATTCCAAACAGAGTCCGGAGA GGGGAGAGGGGCTGCTGGTCTGA | 6156 |
| hsa-mir-483 | 3 | MADATFATSPPHPLWLCPQHFQTGVPGEGERGCWSEA KKGRAPDFERGRGPCPVGGSVEVSHQQGGKETPPFTALC RDEPGVQDGSPWHFATGWSRAPGWGCRREETGWEEG BGGSKGAGEWSAGRGVGGRVEPGLGGVGSHKAEALT SLQTGH* | 6157 | ATGGCAGACGCCACATTCGCGACATTCTCCCACACGCCCCTCTGGCTCTGTCCGCAA CATTTCCAAACAGAGCCTGGACCCGGAAGGGCAGAGGCCGGGCTGCTGGTCTGAGGCTAA GAAGGGCAGAGCTTCGATACAAGGAGGTGGGAAGGGAGACCCCCCCGTTCACTGCCTGT TGGAAGTTTCATACAAGGAGGTGGGAAGGGAGACCCCCGTTCACTGCCTGT GCAGAGATGAGCGGGGTGCAGGATGGGAGCCATGGCACTTCGCTACGGATGG TCCAGGGCTCCGGGTTGGGGCGTCAGGAAGCAGAAGAGACTGGGAGAGGGAG AGGGCGGGAGCAAGGCGGGGAAGGCGGGAGGGAGTGGTCAGCAGGGAGGGGGGGTAG GTGGGAGCCGGACCCGGGGCTGGGAGGAGTCGCTCACACATAAAAGCTGAGGCACTGACCA GCCTGCAAACTGGACATTAG | 6158 |
| | 4 | MSRGCRMGAHGTSLRDGPGLPVGGAGEKRLAGRRERA GAKARGSGQQGEGWGVGWSPGWEESAHT* | 6159 | ATGAGCCGGGGTGCAGAATGGCAGAATGGGAGCCCATGCCACTTGCTACGGATGGTCAGG GCTCCCGGTTGGGGTGCAGCGCGGGAGAGAAGAGACTGCTGGGAGGAGAGGCG GGAGCAAAGGCGCGCGGGAGGGAGTTGCTCAGCAGGGAGGCGTGGGGGTGGGTGA GCCTGGGCTGGGAGGAGTCGGCTCACACATA | 6160 |

Figure 1 (Continued)

| | | | | |
|---|---|---|---|---|
| hsa-mir-483 | 1 | MAERGRGRGPGGREIPPAAPSPWLGLGGGGLAGCGHLC VVFDLVKITVLSYIVQTLQEMVSPDPQHVVAPETELAS MQVQRTEDGVTIIQJFWVGRKGELLRRTPVSSAMQVGF ELCFPP* | 6161 | ATGGCGGAGCGAGGGGGCGAGGGGGCGAGGGGGCCAGGGGGCGCGAGATTCCGCCGGCGG CCCTTCCCCTTGGCTAGGCTTAGGCGGCGGAGGGCTGGCGGGGTGGAGATTTGT GGTGGTTTTGACTGGTAAAATCACAGTGCTTCTTACATCGTTCAAACTCTCA GAGATGGTTCCCAGATCCAACGCACTGAGGACGGGGTAACCATTATCCAGATATTTGGGT GCTATGCAAGTCAAGTCAACGCACTGAGGACGGGGTAACCATTATCCAGATATTTGGGT GGGCCGCAAAGGCGAGCTACTTAGACAGTCCGGTGAGCTCGGCCATGCAGGTAG GATTTGAGCTGTGTTTCCCGCCCTGA | 6162 |
| | 2 | MGPLNSLERAFSMALALCGSLPPTQPRPRAPSPCDRRP PPGAPGPPARTPRPALGSGCGCGPGAGRGLRGRPLARA RGQRGPRGPWAAGWRDYKSRAWAPAVRLLSGGAA* | 6163 | ATGGGGCCCCTGAATTCTCTAGAACGGGCATTCAGCATGGCCTTGGCCTCTTGCGCC TCCCTGCCCCAACCCAGTCTGCGCCCGCGCCACCGCAGCCTCCCCGCCCTCTTGCTCG GGTGCGGGGGCCGGGCCGGGAGGCCCGGAGGGCTCGCGGGGCGCCCATTGGCGC GGGCGCGAGGCGAGCCAGCGAGGCCCGGGCGGCTCGGCCCTGCCTCGCGGACTAT AAGAGCCGGGCTGGGGCCGTGCGGGCCAGTTGCGTGCCTCTCCGGCGGAGCTGCGTGA | 6164 |
| | 3 | MCDSCLAGPGLRGAG* | 6165 | ATGTGTGATTCGTGCTTGCGGGCCCTGCGGGGCTGGGTAA | 6166 |
| | 4 | MLTRCQRDRERKTGVGGARMERGRVGRSHGRRHIRDI SPTTPLALSATFPNRSPGRGGEGLLV* | 6167 | ATGTTGACGCGGTGCAGCGAGACGCGAGAGAAGACGCGGAGTCATGGCAGGAGCC GGATGGAGAGGGGCGAGTTGGCAGGCGTCGCAACATTCCAAACAGGAGTCCGGGAGA TCCCCACACCCCTCGCTCTGTGCCCGCAACATTCCAAACAGGAGTCCGGGAGA GGGGGAGAGGGCGGCTGGTCTGA | 6168 |
| hsa-mir-483 | 1 | MCQQSGLGCMGRGALLLKFVISAISFCFSPGAEESPPSL CGRRWIPAFSPRALNRCQLSPLPSLPHSLSPSRFESPVLR * | 6169 | ATGGGACAGGGCTCAGGTCTGGGGTGTATGGGAGGGCTTTGCTTTAAAAGA CTTGTGGGAGGAGTTGATTCGCTGAATGGCCGAAGTTCTGAATCGCTGCCA GCTCAGCCCTGCCCTGCCCAGCCTGAGCCTGAGCCTGAATCGCTGCCA AGTCCTGAGGTGA | 6170 |
| | 2 | MGGRKWVEREKGKISLGKNLKTQGKLGSAGGCETPGF SPPQAAGHGVLHQWPDLSVGLYLSKWVTVSGLLAVQN * | 6171 | ATGGGGGCAGAAAGGTCAGAAAGGGTAGAGAGGAAAAGGGAAAATATCATTGGGAAGA ACCTAAAAACCCAAGGAAAGCTGGCTTCTGCTGGCGTGTGAGACCCCGGGTTC TCCCCGCCCCAGCCTGCTGCCATGGGAGTTGCACTCAGGCCTCACTGACCTTCTGTC GGTCTGTATTATCAAAGTGGGTGACAGTCCTGGCGTTGTTCAGAATTGA | 6172 |
| | 3 | MGSCTNGLTFLSVCIYQSG* | 6173 | ATGGGCTCTGCACCAATGCCTGTACCTGCCACGACAGGGCCTGCAGGAGGGATCCAGC | 6174 |
| | 4 | MDWSPCTCPTTGPAGRDPAGDSSG* | 6175 | ATGGATTGAGTCCCTGTACCTGCCACGACAGGGCCTGCAGGAGGGATCCAGC AGTGACTCTTCAGGCTGA | 6176 |
| hsa-mir-484 | 1 | MRRA* | 6177 | ATGAGGAGAGCATAG | 6178 |
| | 2 | MGVIHETLQGRCLDYMR* | 6179 | ATGGGTGTGATAATAATAGAAACCACCTTACAAGGCCGTTGTTTGGATTACATGAGG TAA | 6180 |
| | 3 | MLFP* | 6181 | ATGTTGTTTCCTTAG | 6182 |
| | 4 | MTAETMFSYPLFQLLSLVQCLAYFNK* | 6183 | ATGACAGCAGAGACTATGTTTTCTTATCCAACTCTGTCCTTAGTACAAT GCCTGGCATATTTTAATAAATAA | 6184 |
| hsa-mir-485 | 1 | MDQGVEGGGCGPGVGRQSACSL* | 6185 | ATGGACCAGGGGGTAGAGGAGGAGGGCTACAGAGATAGGGAGGAAAGTGGGACCTGGGGGTCGGGCGCCAGTCAG CTTGCAGCCTATGA | 6186 |
| | 2 | MKDGKEGYRDRGRVGLRIARAAWHTVLG* | 6187 | ATGAAGGACGGAAAGGAAGGGCTACTCAGGGTCTTCTTCAAAGCGTGTAATGGGAGAGCAGC CCAGAGCGGGCTTGGCACACAGTTTAGGGTAA | 6188 |
| | 3 | MTEPVTPGSSFKACLMGDSVVPVTKLGPESQGRAHQV AALP* | 6189 | ATGACTGAGCCGGTCACTCCAGGGTCTTCTTCAAAGGCTTGTTTAATGGGAGACAGC GTTGTCCCAGTAACCAAATTGGGACCAGAGTCCCAGGGAAGGGCTCATCAGGTGGC CGGCTCTGCCTTGA | 6190 |

Figure 1 (Continued)

| | | | | |
|---|---|---|---|---|
| | 4 | MILFPLDPAPLVPFSL* | 6191 | ATGATTCTCTTCCCTCTGGATCCAGCCCCTCTAGTTCCTTTCACTTTGA | 6192 |
| hsa-mir-486_os | 1 | MPYSVGFREVSTGRLLGWTGRCQEGATQAAPVGSTRAAALHITPPASPPRGLPALA* | 6193 | ATGCCCTATTCTGTGGGCTTCCGCGAAGTGAGTACTGGGCGGCTGCTCCGGGTGACGGGGAGATGTCAGGAGGGCACCCAGGCCGCCAGTAGGCACGCAGCACGCGAGCAAGAGCAGCTTTGCACACCCAGCCTCGCCTCCCGTGAGCTCCCTGCCTTAGCAT AG | 6194 |
| | 2 | MSGGGHPGRASRQHASKSSPAHPTRLASPWAPCLSHAAHRPCS* | 6195 | ATGTCAGGAGGGGGCCACCCAGGCCGCGCCAGTAGGCACGCGAGCAAGAGCAGCTTTGCACACCCACCGCGCTCGCGCTCCCGTGGGCTCCCTGCCTTAGCATAGCGGCACATGCGACCTTGTGATCTGA | 6196 |
| | 3 | MSCQQ* | 6197 | ATGTCCTGTCTCAGCAATAG | 6198 |
| | 4 | MVFGL* | 6199 | ATGGTTTTTGGATTATAG | 6200 |
| | 1 | MDQGVEGGCGCGPGVGRQSACSL* | 6201 | ATGGACCAGGGGGTAGAGGGAGGTGGGTGTGGACTGGGGTCGGGCGCCAGTCAGCTTGCAGCCTATGA | 6202 |
| hsa-mir-487a | 2 | MKDGKEGYRDRGRVGLRLARAAWHTVLG* | 6203 | ATGAAGGACGGAAAGGAGGGCTACAGAGATAGGGGAAGAGTGGGGCTGAGGATAGCCAGAGCTGGGCTTGGCACACAGTTTAGGGTAA | 6204 |
| | 3 | MTEPVTPGSSFKACLMGDSVVPVTKLGPESQGRAHQVAALP* | 6205 | ATGACTGAGCCGGTCACTCCAGGTTCTTCTCAAAGCGTGTCTAATGGAGACAGCGTTGTCCCAGTAACCAAATTGGGACCAGAGTCCCAGGGAAGGGCTCATCAGGTGGCCGCTCTGCCTTGA | 6206 |
| | 4 | MILFPLDPAPLVPFSL* | 6207 | ATGATTCTCTTCCCTCTGGATCCAGCCCCTCTAGTTCCTTTCACTTTGA | 6208 |
| | 1 | MDQGVEGGCGCGPGVGRQSACSL* | 6209 | ATGGACCAGGGGGTAGAGGGAGGTGGGTGTGGACTGGGGTCGGGCGCCAGTCAGCTTGCAGCCTATGA | 6210 |
| hsa-mir-487b | 2 | MKDGKEGYRDRGRVGLRLARAAWHTVLG* | 6211 | ATGAAGGACGGAAAGGAGGGCTACAGAGATAGGGGAGAGTGGGGCTGAGGATAGCCAGAGCTGGGCTTGGCACACAGTTTAGGGTAA | 6212 |
| | 3 | MTEPVTPGSSFKACLMGDSVVPVTKLGPESQGRAHQVAALP* | 6213 | ATGACTGAGCCGGTCACTCCAGGTTCTTCTCAAAGCGTGTCTAATGGAGACAGCGTTGTCCCAGTAACCAAATTGGGACCAGAGTCCCAGGGAAGGGCTCATCAGGTGGCCGCTCTGCCTTGA | 6214 |
| | 4 | MILFPLDPAPLVPFSL* | 6215 | ATGATTCTCTTCCCTCTGGATCCAGCCCCTCTAGTTCCTTTCACTTTGA | 6216 |
| | 1 | MGAEA* | 6217 | ATGGGGCGCTGAAGCTTGA | 6218 |
| | 2 | MSGT* | 6219 | ATGAGCGGGACTTAA | 6220 |
| hsa-mir-489 | 3 | MPNSAGAIGTLLFDYRNVV* | 6221 | ATGTTTAACAGTGCAGGTGCTATAGGCACCTTGCTTTTTGATTATAGAAATGTGGTTTGA | 6222 |
| | 4 | MWFDCGACGSHVGSARS* | 6223 | ATGTGGTTTGATTGCGGTGCTTGTGGTTCTCATGTAGGGTCAGTCTAGGTCTTAG | 6224 |
| | 1 | MFSPEIVRPLQLIEHTRTNTDTLSCCTKGARAQRPRERARAHTHTHTHQTHTHSHTPGCGLARAWKSQJSPGNRRGTRIGVASQN* | 6225 | ATGTTCTCCCCAGAAATTGTCGCCTGTATGAGTAATGAACACACAGGGAGCGCGCGGGCGCAAAGACCTAGGGAGCGCGGGGCACACAGCTCACACAAGAGGACACAAGCACTAGGGAGCGCTCCAGGCGTGGGTTGCCAGCACAGACACACACAGACCTAGGGAGCCCTGAAATCGCAGATTTCACCAGGAAATCGCCGAGGTACCCGAATAGGTGTTGCCTCCAAAACTAA | 6226 |
| | 2 | MNPAQLAEASRSPFVFGLQALRESQV* | 6227 | ATGAATCAGCCCAGCTGACTCGCGAGCATCCAGGTCTCTATTTGGTCTCCAGGCTCTTCGTGAAAGCCAGGTTTGA | 6228 |

Figure 1 (Continued)

| | | | | |
|---|---|---|---|---|
| hsa-mir-490 | 3 | MAGLKGRGRGTARGEVPLRFRRSLSPAECGESHLGAA LSRRRSLFQPPRPSTVADPPPATHSRCSHGQDKESFVPPA PRVPSCWGLTASSVRVGWRPGSLGLRAVPRLRFRSSPW ALERFPIAVSRSRWPRRRSM* | 6229 | ATGGCRGTCTGAAACGAAGRGGCAAACGAGGCACAGGCGAGGCGAGGTACCC TACGGATTCCGACGGTCACTGGCTCCTGCTCCTATTCCAGCGTCCAGCCAGCAGCCTGGGAGCT GGGCTGTCCGGCGCTCCGCACCACTCCAGATGCAGCCATGGACAAGGAGGAGCTTCGTCC CCCCTCCCGCGACCCCTGGGTCCTCCGTTCCTTCCGGGTCTGACCGCGCGTCTTCTGTCGGTGTG GATGGAGGCCCGGCGCTCGCTCGGCGTCCGGCTCCGAGCTGTCCCCCGGCTCCGCTTCCGGAGCA GCCCTTGGGCGCTGGAGAGGGTTTCCAGGTCGGCTCCAGGTCATGGCCCAAGGAGG AGAAGCAATTAG | 6230 |
| | 4 | MWRKQPGSCAVPASLPIPAFHSLYCC* | 6231 | ATGTGGCGAAAGCAGCCTGGGAGCTGCGTCCCGGCGTCCCTCCCTATTCCAGCC CCCATTCCCTCTACTGTTGCTGA | 6232 |
| hsa-mir-491 | 1 | MAGAPPAASLPPCRLISDCCASMQ* | 6233 | ATGGCGGGGCCCCCTCCCGCAGCCTGCCTGCCGCTCTGCCGCTTGCAGGTTGATCTCAGACTGC TGTGCTAGCAATCAGTGA | 6234 |
| | 2 | MPRPASARARCMHPLTCAHCLALPSEMNSVSQMEMQK SPSSPSLTLGAVDRSCSYSAIFAPPCN* | 6235 | ATGCCTCGCCCTGTTCGGCTCGCAGGTGCATGCACCACTGACCTGCGCCAC TGTCTGCACTCCAGTGGAGATGAATAGTGAGATGCAGATCAACCTGTATCCAGACCTGCGGCCCAC CCGTCTTCTCATCGCTGACCTGTCGGAGCTGTAGACCGGAGCTGTCCCTATTGGCC ATCTTTGCTCCTCCCCTGCAACTAA | 6236 |
| | 3 | MLKFQPLVPQNVTVFGNRAFKEVIK* | 6237 | ATGCTGAAGTTCAACCCTAGTACCCTAGAATGTACGAATGTGACTGTATTGAAATAGGCC TTTAAAGAGGTGATTAAGTGA | 6238 |
| | 4 | MAKPHFY* | 6239 | ATGGCAAAACCCATTCTACTAA | 6240 |
| hsa-mir-491 | 1 | MFRPASARARCMHPLTCAHCLALPSEMNSVSQMEMQK SPSSPSLTLGAVDRSCSYSAIFAPPCN* | 6241 | ATGCCTCGCCCTGCTTCGGCTCGCAGGTGCATGCACCACTGACCTGCCGCCAC TGTCTGCACTCCTAGGTGAGATGAACTCGGTATCTCAGATGGAAATGCAGAATCA CGGTCTTCTCATCGCTGACCTGTCGGAGCTGTAGACCGGAGCTGTCCTATTGGCC ATCTTTGCTCCTCCCTGCAACTAA | 6242 |
| | 2 | MLKFQPLVPQNVTVFGNRAFKEVIK* | 6243 | ATGCTGAAGTTCAACCCTAGTACCCTAGAATGTGACTGTATTGGAAATAGGGCC TTTAAAGAGGTGATTTACTGA | 6244 |
| | 3 | MAKPHFY* | 6245 | ATGGCAAACCCATTCTACTAA | 6246 |
| | 4 | MAPLPSSLGNRVRLCSPPPAPHKKI* | 6247 | ATGGCACCACTGCCCTCCAGCCTAGGGAACAGAGTGAGACTCTGCTCCCCCCCC GCCCACACAAAAAATTTAA | 6248 |
| hsa-mir-491 | 1 | MQPPGSLLQSPPPGYVRGGGAGHVRQPALG* | 6249 | ATGCAGCCCCATTGGCTCCTCCTGCAGTCCCGCCCCCCGGGCGTTCGAGCGGCGGCGG CCACGTCAAGGCAGCCGGCGCTGGCTGA | 6250 |
| | 2 | MEGG* | 6251 | ATGGAGGGCGGCTGA | 6252 |
| | 3 | MWRQGRVAARGSREGAFCPRPVLLGLSASGGLGLLRL RSSEIPGQGWLW* | 6253 | ATGTGGCGCCAGGGCCGGTCGCGGCCGCAGGGCAGCCGGGAGGGGCAGCCGGGGCTTTTTGCCC TGTGCCGTCTGCTGGGGCTCTCAGCTTCTGGACTAGGCCTTCGAGGTTACG GAGCTCCGAGATACCTGGCAGGGCTGGCTGTGGTGA | 6254 |
| | 4 | MSTYNAKYG* | 6255 | ATGTCCACTTATAATGCAAAGGCTTATGGGTGA | 6256 |
| hsa-mir-492 | 1 | MEKWDIVEDQGDRVFEVLHVAWCTVSTQYILTHVTAF FLSPMFLPPYRGHHKYTMVPPRQHPSQYDGSSWPMRK SYRLMPSFEGMKSPHSDSQYSDSWFSSSSLVTLLPSTEN MKTQLRNFHRAESCKLF* | 6257 | ATGGAAAAGTGGGATATTGTGGAAGACCAAGGAGACATGATCATGATTGAAGTGCTTCA TGTTGCCTGGTGCACAGTAGTCACACATACCTCCTTACAGAGGAATAATCACAAATATACT CTCCTTCCTTTCAGGCAGCACCCCTCCAAGTGCACGGAAGCAGTTGGCTATGCAC ATGGTTCCTTTTCAGGCAGCACCCCTCCAAGTGCACGGAAGCAGTTGGCTATGCAC AAATCATATATCGGATGTTCTTCATGTCCTCATTCGTCCTATTCGATTCAC AGTACAGTGATTCATGTCAATTAAGAACCACAGGGTTCACCTCCTCCCCTCACTGA AAACATGAAAACACAATTAAGAACCACAGGETCAAAACCAACCAGGGTTCACAAAGTCCAGAGACTCTTCTAA | 6258 |
| | 2 | MYLKCFMLPGVQ* | 6259 | ATGTATTTGAAGTGCTTCATGTTGCCTGGTGTACAGTAA | 6260 |
| | 3 | MVLFLFSCHPPPLH* | 6261 | ATGGTTCTCTTCTTCTGTCATCCTCCTCCCACTGA | 6262 |
| | 4 | MPAEGLKQNTP* | 6263 | ATGCCGGCAGGGTCAGGAAGCAAATACACCCTGA | 6264 |

Figure 1 (Continued)

| | | | | |
|---|---|---|---|---|
| | 1 | MVNPILCT* | 6265 | ATGGTTAATCCAATTCTGTGCACTTGA | 6266 |
| | 2 | MTERMNGHMND* | 6267 | ATGACAGAAAGAATGAATGGACACATGAACGACTGA | 6268 |
| hsa-mir-493 | 3 | MEMPGTARKELPMGLSPISLWAPEVHKREKRQEEKCQGVKDRAKERQK* | 6269 | ATGGAAATGCCTGGCACAGCCAGGGAGCTGCCATGGATTGTCATTCATCTCACTCTGGGCACCTGAGGTCCATAAGCCTGAAAAGAGGCAGGAAGAGAAGTGTCAGGGAGTCAAAGATAGAGCTAAGGAAAGGCAAAAATGA | 6270 |
| | 4 | MKLNESERENKEKPKKRTNTWVYL* | 6271 | ATGAAACTAAATGAAAGCGAAAGTGAAAATAAGAAAAAACCAATAAAAAAGAGAACGAATACGTGGGTGTATCTGTAA | 6272 |
| | 1 | MDQGJVEGGGCGPGVGRQSACSL* | 6273 | ATGGACCAGGGGGTAGAGGGAGGTGGTGTGGACCTGGGGTCCGCGCCAGTCAGCTTGCAGCCTATGA | 6274 |
| hsa-mir-494 | 2 | MKIDGKEGYRDRGRVGLRIARAAWHTVLG* | 6275 | ATGAAGGACGGAAAGGAGGGCTACAGAGATAGGGGAAGAGTGGGGTGAGGATAGCCAGAGCGGCTTGGCACACAGTTTAGGGTAA | 6276 |
| | 3 | MTEPVTPGSSFKACLMGDSVVPVTKLGPESQGRAHQVAALP* | 6277 | ATGACTGAGCCGGTCACTCCAGGGTCTTCCTTCAAAGCGTGTCTAATGGGAGACAGCGTTGTCCCAGTAACCAAATTGGGACCAGAGTCCCAGGGAAGGGCTCATCAGGTGGCCGCTCTGCCTTGA | 6278 |
| | 4 | MILFPLDPAPLVPFSL* | 6279 | ATGATTCTTCCCCTGGATCCAGCCCCTCTAGTTCCCTTTCACTTGA | 6280 |
| | 1 | MDQGVEGGGCGPGVGRQSACSL* | 6281 | ATGACCAGGGGGGTAGAGGGAGGTGGTGTGGACCTGGGTCGGGCGCCAGTCAGCTTGCAGCCTATGA | 6282 |
| hsa-mir-495 | 2 | MKIDGKEGYRDRGRVGLRIARAAWHTVLG* | 6283 | ATGAAGGACGGAAAGGAGGGCTACAGAGATAGGGAAGAGTGGGGCTGAGGATAGCCAGAGCGGCTTGGCACACAGTTTAGGGTAA | 6284 |
| | 3 | MTEPVTPGSSPKACLMGDSVVPVTKLGPESQGRAHQVAALP* | 6285 | ATGACTGAGCCGGTCACTCCAGGGTCTTCCTCAAAGCGTGTCTAATGGGAGACAGCGTTGTCCCAGTAACCAAATTGGACCAGAGTCCCAGGGAAGGGCTCATCAGGTGGCCGCTCTGCCTTGA | 6286 |
| | 4 | MILFPLDPAPLVPFSL* | 6287 | ATGATTCTCTCCCTCTGGATCCAGCCTCTAGTTCCCTTTCACTTGA | 6288 |
| | 1 | MDQGVEGGGCGPGVGRQSACSL* | 6289 | ATGGACCAGGGGGTAGAGGGGAGGTGGTGTGGACCTGCGGTCGGGCGCCAGTCAGCTTGCAGCCTATGA | 6290 |
| hsa-mir-496 | 2 | MKIDGKEGYRDRGRVGLRIARAAWHTVLG* | 6291 | ATGAAGGACGGAAAGGAGGGCTACAGAGATAGGGAAGAGTGGGGCTGAGGATAGCCAGAGCGGCTTGGCACACAGTTTAGGGTAA | 6292 |
| | 3 | MTEPVTPGSSFKACLMGDSVVPVTKLGPESQGRAHQVAALP* | 6293 | ATGACTGAGCCGGTCACTCCAGGGTCTTCCTTCAAAGCGTGTCTAATGGGAGACAGCGTTGTCCCAGTAACCAAATTGGGACCAGAGTCCCAGGGAAGGGCTCATCAGGTGGCCGCTCTGCCTTGA | 6294 |
| | 4 | MILFPLDPAPLVPFSL* | 6295 | ATGATTCTTCTCCCTCTGGATCCAGCCCCTCTAGTTCCCTTTCACTTGA | 6296 |
| | 1 | MGWDGFWGGVPNSJDWEWRNPS* | 6297 | ATGGGCTGGGACGGGTTTTGGGGGGTGTCCCAATTCTGACTGGGAGTGGAGGAACCCCTCCTGA | 6298 |
| | 2 | MRLGRLLSPAPQM* | 6299 | ATGCGACTGGGCGGCTCCTTTCTCCTGCACCCCAAATGTGA | 6300 |
| hsa-mir-497 | 3 | MHPKFCSFQNRGPGSQGRVAEVSGEGSVLCFQERRGGWGGGLEVRAGVGLALSVLELGG* | 6301 | ATGCACCCTAAATTTGCTCTTTTCAAAATAGGGACCAGGATCTCAGGGGAGAGTAGCTGAGGTAAGTGGGGAGGGAAGTGTCCTGTTTCAGGAGACGTGGCGGTTGGGGGAGGTTTGGAGGTGCGTGCTGGGGTTGGCTTGTCAGTCTTGAATTGGGGGATGA | 6302 |
| | 4 | MIGEAFSYTPKLQPPRRKPKAETREPPMIPSR* | 6303 | ATGATTGGAGAGGCTTTCTCTTATACCCTAAACTGCAGCCCCCAGACGGAAACCAAAGGCTGAGACCAGAGAGCCCCCAACATCCCAGCCGTTAG | 6304 |
| | 1 | MSIR* | 6305 | ATGTCAATCAGATGA | 6306 |

Figure 1 (Continued)

| | | | | |
|---|---|---|---|---|
| hsa-mir-498 | 2 | MINYVKRPATREGTPPRTHQRHHKENSFECKDCGKAF SRGYQLSQHQKIHTGEKPYECKECKKAFRWGNQLTQH QKIHTGEKPYECKDCGKAFRWGSSLVIHKRIHTGEKPY ECKDCGKAFRRGDELTQHQRFHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGHQLTQHQKTHSGAKSYECKEC GKACNHLNHLREHQRIHNS* | 6307 | ATGATCATCAATTATGTCAAATATGTCTACTAGAGAAGGACCCCTAGAACA CATCAGAGACATCATCATAAGGAGAATTCCTTGAATGTAAGGACTGTGGGAAGGCTTT AGTCGTGGCTATCAACTTAGTCACATCAGAAAATCCATACTGGTGAGAAACCTTAT GAATGTAAAGAATGTAAGAAGGCCTTCCGTTGGGCAATCAGCTTACTCAACATCAA AAATTCATACTGGGAGAAGCCCTACGAATGTAAAGACTCATACTGGTGAAAACCCTATGA ATGTAAAGACTGTGGAAAGGCCTGTTATTCATAAGAGAATTCATACTGGTGAAAACCTATGA GATTCCACACTGGGGAGAAAGACTTACGAATGTACAAGACTGTGGGAAGACCTTTAGC CGTGTGTATAAACTTATTCAGCACACAGAGAATTCATAGTGGGAGAAGCTTACGA GTGTAAAGACTGTGGGAAGGCTTTATTGTGGTTCAAGCCTCATTCAGCATAAAG AATTCACACAGGTGAGAAACCCTATGAATGTCAAGAATGTGGAAGGCCTTTACTCG AGTCAATTACCTTACTCAGAAGGCCTTCGTGCAGCCTGTGAAGCCTCACGAATG TAAGGAGTGTGGGAAGGCTTTCATTTATGGATCGAGCCTCGTGAAACATGAGAGAAT TCATACCGGGTGAAACCTATGGTGTACAGAATGTGGGAAGAGCTTTAGTCACG GCCATCAGTTACAACAACATCGAAAAACCACAGTCGGGCGAAATTCTACGAATGT AAGGAGTCGGGAAGGCATGTAACCACCTAAACCATCTCGAGAACATCAGAGGAT CCACAACAGTTGA |
| | 3 | MSKDLLLEKAPLLEHIRDIRRIPLNVRFTYGRPLVVAINL VNIRKSILVRNLMNVKNVRRPSVGAISLLNIKKFILGRSP CTCGTTATTCTAAGAGGATTCATACTGGTGAAAGACTTGTGGGAAGGCTTTGATGGGCTCAAGC ERG... MSKDLLLEKAPLLEHIRDIRRIPLNVRFTYGRPLVVAINL VNIRKSILVRNLMNVKNVRRPSVGAISLLNIKKFILGRSP GVVMSSLSTRDSTLGRKTNAKTVGRPLAVCINLFSTRE FIVGRSLTSVKTVGRLLFVQASFSIKEFTQVRNPMNVK NVGRPLLESFLLSIRRSTPVRSLTNVRSYGRPFAGVRAS LSTRGYIRARSRTSAQNVGRPSIVAITSLSTRESTQAKPRI NVRSVGRLSFMDRAS* | 6309 | ATGTCAAAAGACCTGCTACTAGAGAAGGCACCTCCTAGAACACATCAGAGACATC ATAAGGAGTAGCCTTGAATGTAAGGACTGTGGAAAGCTTTAGTGTGGCTATC AACTTAGTCACATCAGAAAATCCATACTGGTGAGAAACCTTATGAATGTAAAGAAT GTAAGAATGTAAGAAGGCCTTCCGTTGGGCAATCAGCTTACTCAACATCATATACTG GGGAGAAGCCCTATAAGACTGTAAAGACTGTGGGAAGGCTTTTGATGGGCTCAAGC CTCGTTATTCTAAGAGGATTCATACTGGTGATGAGTCAAAGACCCTTAGCCGTGTATAAAC GGAAAGGCCTTTGGTGATGAGTCAAAGACCCTTAGCCGTGTATAAAC GVVMSSLSTRDSTLGRKTNAKTVGRPLAVCINLFSTRE GGAAAAGACTACGAATGCAAAGAGACTTACAGTGGGAGAAGCCTTAGCCGTGTATAAAC TTATTGTGCAACAAGAAAGACTTGTAGCTCAAGAGCTACCTCACAATAAAGAATTCACACAGGT GGGAAGGCCTTTATTGTGAATGTCAAGCCTCATTCAGCATAAAGAATTCACACAGGT GAGAAACCCTATGAATGTCAAGAATGTGGGAAGGCCTTTACTCGAGTCAATTACCT ACTCAGCATCAGTTACAAGCAGCAATGGAAGCGTCCACCGGTGAGAAGCCTCGTTAAGCACGA GAAGGCCGTACAAGTGCACAGAATGGGAAGGCCTTCAATTGTGGCTATCACCTC ACTCAGGCGTACAAGTGCACAGAATGGGAAGGCCTTCAATTGTGGCTATCACCTC GAAGGGCTTTCATTATGATCGAGCCTCGTGA | 6310 |
| | 4 | MGLKPRYS* | 6311 | ATGGCCTCAAGCCTCGTTATTCATAA | 6312 |
| hsa-mir-499 | 1 | MPPCLANFCLFVCLL* | 6313 | ATGCCACCATGCCTGCTGCCAGGCTGGTCTTGA | 6314 |
| | 2 | MCCPGWS* | 6315 | ATGTGTTGCCCAGGCTGGTCTTGA | 6316 |
| | 3 | MCPPGPPKVLELQT* | 6317 | ATGTGTCCGCCTGGCCTCCAAAGTGCTGGAATTACAGACATGA | 6318 |
| | 4 | MRYCA* | 6319 | ATGAGGTACTGTGCCTGA | 6320 |
| hsa-mir-500 | 1 | MSRAPASLPLLPGWAV* | 6321 | ATGAGCCGCGCGCCTCGCTCCCTTCTCCCCGGCTGGGCTGTGTGA | 6322 |
| | 2 | MKLCRLRGALTQLGVLDARADRARCPPAADTGSAAPD LGJDR* | 6323 | ATGAAGCTCTGCCGCCTACGTGGGGCTCTAACTCAACTTGGTCTCGACGCCAGA GCCGACCGAGGCGCGCTGCCACCGGCGGACACGGGCTCCGGACCT CGGCGACAGGTAA | 6324 |
| | 3 | MGLPRARRWQPGA* | 6325 | ATGGGGCTTCCCCGCGCCGGCGTTGGCAGCCGGCGCTTAG | 6326 |

Figure 1 (Continued)

| | | | | | |
|---|---|---|---|---|---|
| | 4 | MVPGLPERSFLAERRQARPAFESECLAACVPFPGLG* | 6327 | ATGGTCCCTGGGTTGCCCGAGCGAAGTTTCCTTGCGGAGCGGCGCCAAGCCCGCCCGCTTTTGAATCGGAGTGTTTAGCGCTGCGTCCTCTCCCGGCTGGGCTGTGTGA | 6328 |
| hsa-mir-503 | 1 | MSRAPASLPLPGWAV* | 6329 | ATGAGCCGCGCAGCGCTCCGTTCCTTGCCTGGGCTGGGCTGTGTGA | 6330 |
| | 2 | MKLLCRLRGALTQLGVLDARADRARCPPAADTGSAAPDLGDR* | 6331 | ATGAAGCTCTGCCGGCTACGTGGGCGCTCACTCAACTTGGTGTCTGACGCCAGAGCCGACCGAGCGCGTCGCCACCGGGCGGACACGGGCTCCGCCTCCGGACCTCGGCGACAGGTAA | 6332 |
| | 3 | MGLPRARRWQPGA* | 6333 | ATGGGCTTCCCGCGCGCCCGGCGTTGCAGCCCGGCGCTAA | 6334 |
| | 4 | MVPGLPERSFLAERRQARPAFESECLAACVPFPGLG* | 6335 | ATGGTCCCTGGGTTGCCCGAGCGAAGTTTCCTTGCGGAGCGGCGCCAAGCCCGCCCGCTTTTGAATCGGAGTGTTTAGCGCCTGCGTCCCCTTCCTGCGGACTGGGTAG | 6336 |
| hsa-mir-504 | 1 | MSRAPASLPLPGWAV* | 6337 | ATGAGCCGCGCAGCGCTCCGTTCCTTGCCTGGGCTGTGGGCTGTGA | 6338 |
| | 2 | MKLLCRLRGALTQLGVLDARADRARCPPAADTGSAAPDLGDR* | 6339 | ATGAAGCTCTGCCGGCTACGTGGGCGCTCACTCAACTTGGTGTCTGACGCCAGAGCCGACCGAGCGCGTCGCCACCGGGCGGACACGGGCTCCGCCTCCGGACCTCGGCGACAGGTAA | 6340 |
| | 3 | MGLPRARRWQPGA* | 6341 | ATGGGCTTCCCGCGCGCCCGGCGTTGCAGCCCGGCGCTAA | 6342 |
| | 4 | MVPGLPERSFLAERRQARPAFESECLAACVPFPGLG* | 6343 | ATGGTCCCTGGGTTGCCCGAGCGAAGTTTCCTTGCGGAGCGGCGCCAAGCCCGCCCGCTTTTGAATCGGAGTGTTTAGCGCCTGCGTCCCCTTCCTGCGGACTGGGTAG | 6344 |
| hsa-mir-505 | 1 | MIQMSNCLYLTLFVYLQK* | 6345 | ATGATCCAGATGTCCAATTGCCTCTACTTAACCTTATTCGTCTACCTTCAGAAGTAA | 6346 |
| | 2 | MVKL* | 6347 | ATGGTGAAGTTATAA | 6348 |
| | 3 | MVQNVRRCYTPSWGR* | 6349 | ATGGTTCAAAACGTGAGGCGCTGCTATACCCCGTCGTGGGAAGGTAG | 6350 |
| | 4 | MMLHFGTPFPCSGRM* | 6351 | ATGATGTTCATTTGGCACCCGTTCCCGTGTAGTGAGATGTAA | 6352 |
| hsa-mir-504 | 1 | MVCH* | 6353 | ATGGTCTGTCACTAA | 6354 |
| | 2 | MPINDLSILRVWA* | 6355 | ATGCCCATTAATGATCTCTCTATACTGAGAGTATGGGCTTGA | 6356 |
| | 3 | MISLY* | 6357 | ATGATCTCTATACTGA | 6358 |
| | 4 | MGLMFLAITLENTLDMP* | 6359 | ATGGGCTTGATGTTTCTGCCATTACTTGAGAATACTTTAGATATGCCTAA | 6360 |
| hsa-mir-505 | 1 | MGFSLIAE* | 6361 | ATGGGCTTCTCGTTGATCGCAGAATGA | 6362 |
| | 2 | MKFKLRNMFLKSFRF* | 6363 | ATGAAGTTCAAATTGCGTAACATTCTTCCTATTTTCTAG | 6364 |
| | 3 | MQCRSPLFL* | 6365 | ATGCAATGTCGCTCTCCCTATTTCTCTAGCACTTTGA | 6366 |
| | 4 | MSLSPISLAL* | 6367 | ATGTCTCTGTCTCCCATTTCTCTAGCACTTTGA | 6368 |
| | 1 | MSPQ* | 6369 | ATGTCTCCTCAGTAG | 6370 |
| hsa-mir-511 | 2 | MRLPLLLVFASVIPGAVLLLGKSALRQGISDLGGRNHTFLFWVTVNGFLSTSL* | 6371 | ATGAGGCTACCCCTGCTCCTGGTTTTGCCTCTGTCATTCCGGTGTGTCTCCTACTGGGTAAGTCTGCTCTGGGTACTGTGAACGGGTTCCCTGCACCACGGGCAG | 6372 |
| | 3 | MGSFQHLCEEETGFPCTTQSTAKPAAFTWRPGMGGLELECRGGCVSGLGCCPAGNPTDLQCPPDFSHRSLFLPCFLRAEISCSVVYSFWFSIHTISVSPPTNTF* | 6373 | ATGGGTTCCTTCAACATCTGTGAGGAGAAACGGGTTCCCTGCACCACGGGCAGTCCACGGCTAAGCTCGTGCCTGCTGCAGGCAATGGAGCCTGGAGTTGGAGGAGGCGGATGCGTTCAGGTGCTGCCTGCCGGGAACCCTACAGACCTCAGTTGCTCTGTGACTTCTCATGCTCGTCTTCCTGTTTCTTCGTGCAGAATTCCTGTCGTCTGTGTTTACTTCTTCAATTCACACTATTTCTGTCTCACCGGCCAACAACACCTTCTGA | 6374 |
| | 4 | MRLRSRLLPCREPYRPSVSS* | 6375 | ATGCGTCTAGGTCGCCTGCTTCCGTGCGAGCCCTACAGACCTCAGTGTCCTCCTGA | 6376 |
| | 1 | MSPQ* | 6377 | ATGTCTCCTCAGTAG | 6378 |
| | 2 | MRLPLLLVFASVIPGAVLLLGKSALRQGISDLGGRNHTFLFWVTVNGFLSTSL* | 6379 | ATGAGGCTACCCCTGCTCCTGGTTTTGCCTCTGTCATTCCGGTGTGTCTCCTACTGGGTAAGTCTGCTCTGAGCAGGGATCTCGACCTCGAACTCGTGCCGGAACCACACCTTCCCTTCTGA | 6380 |

Figure 1 (Continued)

| | | | | |
|---|---|---|---|---|
| hsa-mir-511-2 | 3 | MGSFQHLCEEETGFPCTTQSTAKPAAFTWRPCMGGLEL EEGGGCVSGLGCCPAGNPTDLQCPFDFSHRSLFLPCFLR AEISCSVVYSFWFSIHTISVSPFTNTF* | 6381 | ATGGGTTCTTCAACATCTTTGTGAGGAGAAACGGGTCCCCTGCACCACGCAG TCCACGGCTAAGCTGTCTGCCTTCAGTGGCTGCGGCCAGGCATGGGAGGCCTGGAGTTG GAGGAGGGAGGGAGGATGCGTCTCCTGACTTCCATCGCGCTCGGTTGCTGCCCTGCCCGGAACCCTAC AGACCTTCAGTTGCTCTCTGTCCTGTCCTGTGTCCTGTTTCTC GTGCAGAAATTCCTGCTCTGTGGTTTACTCTTTCTGGTTTCAATTCAGACTATTTC TGTCTCACCGGCCAACAAACACCTCTGA | 6382 |
| | 4 | MRLRSRLLPCREPYRPSVSS* | 6383 | ATGCGTCTCAGGTCTCGGTTGCTGCCCTGCCGGGAACCCTACAGACCTTCAGTGTCC TCCTGA | 6384 |
| | 1 | MSIR* | 6385 | ATGTCAATCAGATGA | 6386 |
| | 2 | MIINYVKRPATREGTPPRTHQRHHKENSFECKDCGKAF SRGYQLSIHQKIHTGEKPYECKECKKAFRWGNQLTQH QKIHTGEKPYECKDCCKAFRWGSSLVHKRIHTGEKPY ECKDCGKAFRRGDELTQHQREHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAPNCGY HLTQHERIHTGETPYKCKECGKAFIYGSSLVKHERIHTG VKPYGCTECGKSFSHGHQLTQHQKIHSGAKSYECKEC GKACNHLNHLREHQRIHNS* | 6387 | ATGATCATCAATATGTCAAAGACCTGCTACTAGAGAGGCACCCTCCTAGAACA CATCAGAGACATCAACTTAGTCAACATCAGAAAATCCATACTGGTGAGAAGTGTAAGGACTGTGGGAAGGCCTTT AGTCGTGGCTATCAACTTAGTCAACATCAGAAAATCCATACTGGTGAGAAACCTTAT GAATGTAAAGAATGTAAGAAGGCCTTCCGTTGGGGCAATCAGTTACTCAACATCAA AAAATTCATACTGGCGAGAAGCCCTACGAATGTAAAGACTGTGGGAAGGCTTTCG ATGGGCTCAAGCCTGCCGTTATTCTAAAGAGGATTCATACTGGTGAAAACCCCTAGA ATGTAAAGACTGTGGAAAGGCCTTTCGGCGTGGGTGTACATGCAAAGACTCACCAGCACCAGA GATTCCACACTGGGAGAAAGACTACGAATGCAAAGACTGTGGGAAGACCTTTAGC CGTGTGTATAAACTTATTCAGCACAAGAGAATTCATAGTGGGGAGAAGCCTTACGA GTGTAAAGACTGTGGGAAGGCCTTTATTTGTGGTTCAAGCCTCATTCAGCATAAAG AATTCACACAGGTGAGAAACCCTATGAATGTCAAGAATGTGGAAAGGCCTTTACTCG AGTCAATTACCTTACTCAGCACCAAATCCACACCGGTTCGAGAAGCCTCACCAGTG TAAGGAGTGTGGGAAGGCCTACAACATCAGAAACGCACAGTGGGGCGAAATCTACGAAGTGT TACATACCGGGCGAGAAGCCGTACAAGTGCACGAGAATGTGGGAAGGCCTTCACTG GCTATCACCTCACTCAGCACGAGAGAATCCATTATGGATGCAGAATGTGGCAAGCATGGCAGT GCCATCAGCTTCACACAACATCAGAAACGCACAGTGGGGCGAAATCTACGAAGTGT AAGGAGTGCGGGAAGGCATGTAACCATCTCCGAGAACATCCTAAGGAGCATCAGAGGAT CCACAACAGTTGA | 6388 |
| hsa-mir-512-1 | 3 | MSKDLLLEKAPLLEHIRDIRRRPLNVRTVGRPLYVAINL VNIRKSILVRNLMNVKNVRRPSVGAISLLNKKFILGRSP TNVKTVGRLFDGAQASLFIRGFHLVKNPMNVKTVERPF GVVMSSLSTRDSTLGRKITTNAKTVGRPLAVCINLFSTRE FIYGRSLTSVKTVGRLLFVVQASFSIKEFTQVRNPMNVK NVGRPLLESITLLSRRSTPVRSLTNVRSVGRPFAGVRAS LSTRGYIRARSRTSAQNVGRPSIVAITSLSTRESTQAKPRI NVRSVGRLSFFMDRAS* | 6389 | ATGTCAAAAGACCTGCTACTGGAGAAGGCACCCCTCCTAGAACACATCAGAGACATC ATAAGGAGAATTCGTTTGAATGTAAGGACTGTGGGAAGGCCTTTAGTCGTGGCTATC AACTTAGTCAACATCAGAAAATCCATACTGGTGAGAAGACCTATGAATGTAAAGAAT GTAAGAAGGCCTTCCGTTGGTGGGCAATCAGTTACTCAACATCCAAAAAATTCATACTG CTCGTTATTCATAAGAGGATTCATACTGGTGAGCTCACTCAGCACCAGAATTCATAAGACTGT GGAAAGGCCTTTCGCGTGGTGTACATGCAAAGACTCACCAGCACCAGAATTCCACACTGT GGAGAAAGACTACGAATGCAAAGACTGTGGGAAGAAGCCTTACGAGTGTAAAGACTGT TTATTCAGCACAAGAGAATTCATAGTGGGGAGAAGCCTTACGAGTGTAAAGACTGT GGGAAGGCCTTTATTTGTGGTTCAAGCCTCATTCAGGAAGGCCTCATAAAGAAATTCACACAGGT GAGAAACCCTATGAATGTCAAGAATGTGGAAGGCCTTTACTCGAGTCAATTACCTT ACTCAGCACCAAAGAATCCACACAGGCTGAGAATCTGACGAGTAAGGCCTTTCACCTC ACTCAGCACGAGAGAATCCATTATGAATCCACACAGGCTGAAACCCTGTCAATTGGGCTATCACCTC AAGCCGTTCACAAGAAGAATCCATTATGGGCTATCACCTCACAAGAAACCCGTATAAATGTAAGGAGTGTGG GAAGGCTTTCATTTATGGATCGAGCCTCGTGA | 6390 |
| | 4 | MGLKPRYS* | 6391 | ATGGGGCTCAAGCCTCGTTATTCATAA | 6392 |
| | 1 | MSIR* | 6393 | ATGTCAATCAGATGA | 6394 |

Figure 1 (Continued)

| | | | |
|---|---|---|---|
| hsa-tmr-512-2 | 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGTACTAGAGAAGGCACCCCTCCTAGAACA CATCAGAGACATCATAAGGAGAATTCCTTTGAATGTAAGGACTGTGGAAGGCCTT AGTCGTGGTATCAACTTAGTCAACATCAGAAATCCATACTGGTGAGAAACCTTAT GAATGTAAAGAATGTAAGAAGCCTTCCCGTTCGCAATGTGGCAATCAGCTTACTCAACATCAA AAAATTCATACTGGGGAGAAGCCTCGTTATTCATAAGAGAATTCATACTGGTGAAAAACCTATGA ATGGGGCTCAAGCTGTGGAAGCCTTTCCGCGTGGTATGCAATGTGGCGAGACCTCAGCACCAGA ATGTAAAGACTGTGGGAGACTGTGGGAGAAATGCAAAGACTGTGGGAAGACCTTAGC GATTCCACACTGGGGAGAAGACTACGAATGCAAAGACTGTGGGAGAAGACCTTTAGC CGTGTGTATAAACTTATTCAGCACACAAGAGAATTCATAGTGGGGAGAAGCCTTACGA CGTGTAAAGACTGTGGGAAGGCTTTTATTTGTGGTTCAAGCCTCATTCAGCATAAAG AATTCACACAGGTGAGAAACCCTATGAATGTCAAAGATGTGGGAAGGCCTTTACTCG AGTCAATTACCTTACTCAGCATCAGAGATCCACACCGGTGAGAAGCCTCACGAATG TAAGGAGTGTGGGAGCAAGGCCTTTCGCTGGGATTCGAGCTTTAAGCACGAGAGGA TACATACGGGCGAGAAGCCTACAAGTGCACAGAATGCACAGGCTTAAGCACGAGAGGA GGCTATCACCTCACTCAGCACGAGAATCCACACAGGCGAAACCCGTATAAATGT TCATACCGGGGTGAAACCCTATGGGTGCACAGAATGTGGGGAAGACTTTAGTCACG GCCATCAGCTTACACACACACACAGAAACGCACAGTGGGGCGAAATCCTACGAATGT AAGGAGTGCGGGAAGCCATGTAACCTAAACCATCTCCGAGAACATCAGAGGAT CCACAACAGTTGA | 6395 |
| | 3 | MSKDLLEKAPLLEHRIRRIPLNVRTVGRPLVVAINL VMRKSILVRNLMNVKNVRRPSVGAISLLNRKPILGRSP TNVKTVGRLFDGAQASLFIRGFILVKNPMNVKTVERPF GVVMSSLSTRDSTLGRKTTNAKTVGRPLAVCINLFSTRE PIVGRSLTSVKTVGRLLFVVQASPSIKEFTQVRNPMNYK NVGRPLLESTLLSIRRSFPVRSLTNVRSVGRPFAGVRAS LSTRGYIRARSKTSAQNVGRPSIVAIITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTTAGTCGTGGCTATC AACTTAGTCAACATCAGAAATCCATACTGGTGAGAAATCCATACTGTAAAGAAT GTAAGAAGCCTTCCGTTGGAATGTAAAGACTTACTCAGCTTACTCAACATCAAAAATTCATACTG GGGAGAAGCCCTACGAATGTAAAGACTGTGGAAAGGCTTTCGATGGGGCTCAAGC CTCGTTATTCATAAGAGGATTCATACTGGTGAAAAACCTATGAATGTAAAGACTGT GGAAAGGCCTTTCGGCCTGTGATGAGCTACTGTGGGAAGACCTTAGCGTGTATAAAC CGGGAGAAAGACTACGAATGCAAAGACTGTGGGAAGACCTTAGCGTGTATAAAC CGGGAGAAAGACTACGAATGCAAAGACTGTGGGAAGAATCCACACTGG TTATTCAGCACACAGGTTTTATTTGGTTCAAGCCTCATTCAGCATAAAAGAATTCCACACGGT GGGAAGGCCTTTATTGGATTGAAGAATGTCAAGACCTCAATCAGCATAAAAGAATTCACACAGGT GAGAAACCCTATGAAGTTCAAGAATGTGGGAAGAGCCTCGTTAAGCACGAGGATACACAGGT ACTCAGCATCAGAGATCCACACCGGTGAGAAGCCTCACGAATGTAAGGAGTGTG GAAGGCCTTTGCTGGGTTCGACCGTCGACAGAATACGGGAGAGATACACGGGGCG GAAGCCGTAAGTGCACAGAATCCACACAGGGGGAAAGGCCTTCAATTGTGGCTATCACCTC ACTCAGCACGAGAGATCCCACACAGGGGGAAAGCCCGTATATAAATTCAAGGAGTGTGG GAAGGCTTTCATTTATGGATCGAGCCCTGTGA | 6397 |
| | 4 | MGLKPRYS* | ATRGGCTCAAGCCTCGTTATTCATAA | 6399 |
| | 1 | MSIR* | ATGTCAATCAGATGA | 6401 |

| | |
|---|---|
| | 6396 |
| | 6398 |
| | 6400 |
| | 6402 |

Figure 1 (Continued)

| | | | | |
|---|---|---|---|---|
| hsa-tmr-515-1 | 2 | MHINYVKRPATREGTPPRTHQRHHKENSPECKDCGKAF SRGYQLSQEHQKIHTGEKPYEECKECKAFRWGNQLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATTCATAAGGAGAATTCCTTTGAATGTAAGGACTGTGGGAAGCCTTT AGTCGTGGCTATCAACTTAGTCAACATCAGAAAATCCATACTGGTGAAAACCTTAT GAATGTAAAGAATGTAAAGAAGGCCTTCCGTTGGGCAATCAGCTTACTCAACATCAA AAAATTCATACTGGGGAGAAGCCTTCTATTCATAAGAGATGTAAAGAACCCTATGA ATGGGGCTCAAGCTGTGAAAGCTCGTTATTCATAAGAGATTCATACTGGTGAAAAACCCTATGA ATGTAAAGACTGTGGGAAGCTGTTCGGCGTGGTGAGCTCACTCAGCACCAGA GATTCCACACTGGGGAGAAGATTACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTTATTTGTGGTTCAAGCCTCATTCAGCATAAAG AATTCACACAGGTGAAAACCCTATGAATGTCAAAGAATGTGGGAAGGCCTTTACTCG AGTCAATTACCTTACTCAGCATCAGAAGATCCACACCGGTGAGAAGCCTCACGAATG TAAGGAGTGTGGGAAGGCTTTCGCTGGGGTTCAGCCTCGTTAAGCACGAGAGGA TACATACGGGCGAGAAGCCTACAAGTGCACAGAATGCACACAGGCGAAACCCGTATAAATGT GGCTATCACCTCACTCAGCACGAGAATCCACACAGGCGAAACCCGTATAAATGT TCATATACGGGGTGAAACCCTATGGGTGCAGCAGAATGTGGGAAGACTTAGTCACG GCCATCAAGCTTACACAACACAGAAACCCAGTGGGCGAAATCTCACGAATGT AAGGAGTGCGGGAAGCATGTAACCTAAACCATCCGAGAACATCAGAGGAT CCACAACAGTTGA | 6403 | 6404 |
| | 3 | MSKDLLEKAPLLEHRDIRRIPLNVRTVGRPLVVAINL VMRKSILVRNLMNVKNVRRPSVGAISLUNIKKPILGRSP TNVKTVGRLFEDGAQASLFIRGFILVKNPMNVKTVERPF GVVMSSLSTRDSTLGRKTTNAKTVGRPLAVCINLFSTRE PTVGRSLTSVKTVGRLLFVVQASPSIKEFTQVRNPMNYK NVGRPLLESITLLSIBRRSFPVRSLTNVRSVGRPFAGVRAS LSTRGYIBARSKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGCCTTTAGTCGTGGCTATC AACTTAGTCAACATCAGAAAATCCATACTGGTGAAAATGTAAAGAAATCATACTGG GTAAGAAGGCCTTCACTACGAATGTAAAGACTGTTCAACATCAAAAATTCATACTG GGGAGAAGCCTACTAAGACTGTAAAGACTGTGGGAAGGCTTTCGATGGGCTCAAGC CTCGTTATTCATAAGAGATTCATACTGGTGAAAAACCCTATGAATGTAAAGACTGT GAAAAGGCCTTTATTCGGCGTGATGAGCTCACTCAGCACCAGAGATTCCACACTGG GGAGAAAGACTACGAATGCAAAGACTGTGGGAAGACCTTAGCCGTGTGTATAAAC TTATTCAGCACGACTACGAATGCAAAGAATTCATAGTGGGGAGAAGCCTTACGAGTCAGTGTAAAGACTGT GGGAAGGCCTTTTATTTGTGGTTCAAGCCTCGTTAAGCACGAGAGGATACATACG GGCGAGAAGCCTGCTACACAGGTCGACAGAATGTGCGGAAGCCTTCAATTGTGGCTATCGTC ACTCAGCACGAGATCAAGCCTCAGAACGAGCACTACGAATGTAAGGAGTGTGG GAAGGCTTTCATTTATGGATCGAGCCGTGA | 6405 | 6406 |
| | 4 | MGLKPRYS* | ATEGGCTCAAGCTCGTTATTCATAA | 6407 | 6408 |
| | 1 | MSIR* | ATGTCAATCAGATGA | 6409 | 6410 |

Figure 1 (Continued)

| | | | | |
|---|---|---|---|---|
| hsa-mir-515-2 | 2 | MHNYVKRPATREGTPPRTHQRHHKENSPECKDCGKAF SRGYQLSQHQKIHTGEKPYECKECKAFRWGNQLTQH QKIHTGEKPYECKDCGKAFRWGSSLVIHKRIHTGEKPY ECKDCGKAFRRGDELTQHQRFHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGHQLTQHQKTHSGAKSYECKEC GKACNHLNEHLREHQRIHNS* | ATGATCATCAATTAT... (sequence) | 6411 | 6412 |
| | 3 | MSKDLLLEKAPLLEHIRDIRRIPLNVRTVGRPLVVAINL VNIRKSILVRNLMNVKNVRRPSVGAISLLNIKKPILGRSP TNVKTVGRLLFDGAQASLFIRGFILVKNPMNVKTVERPF GVVMSSLSTRDSTLGRKTTNAKTVGRPLAVCINLFSTRE FIVGRSLTSVFKTVGRLLFVVQASPSIKEFTQVRNPMNYK NVGRPLLESITLLSIRRSTPVRSLTNVRSVGRPFAGVRAS LSTRGYIRARSRTSAQNVGRPSIVAITSLSTRESTQAKFRI NVRSVGRLSFMDRAS* | ATGTCAAAAGACCTG... (sequence) | 6413 | 6414 |
| | 4 | MGLKPRYS* | ATGGGGCTCAAGCCTCGTTATTCATAA | 6415 | 6416 |
| | 1 | MSIR* | ATGTCAATCAGATGA | 6417 | 6418 |

Figure 1 (Continued)

| | | | |
|---|---|---|---|
| hsa-mir-516a-1+C+A3210:A3213 | 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDEITQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGTACTAGAGAAGGCACCCCTCCTAGAACA CATCAGAGACATCATAAGGAGAATTCCTTTGAATGTAAGGACTGTGGGAAGCCTTT AGTCGTGGCTATCAACTTAGTCAACATCAGAAAATCCATACTGGTGAGAAACCTTAT GAATGTAAAGAGTGTAAGGAAGCCTTCCGTTGGGCAATCAGCTTACTCAACATCAA AAAATTCATACTGGGGAGAAGCCTGTATTCATAAAGACTGTAAAGACTTTTCG ATGGGGCTCAAGCTCGTTATTCATAAGAGGATTCATACTGGTGAAAAACCTATGA ATGTAAAGACTGTGGGAAGCCTTTCCGCGTGGTAGCTCACTCAGCACCAGA GATTCACACTGGGGAGAAGACTACGAATGCAAAGACTGTGGGAAGACCTTTAGC CGTGTGTATAAACTTATTCAGCACACAAGAGAATTCATAGTGGGGAGAAGCCTTACGA CGTGTAAAGACTGTGGGAAGGCTTTCTATTTGGTTCAAGCCTCATTCAGCATAAAG AATTCACACAGGTGAGAAATGCAAAACCCTATGAATGTAAGAATGTGGGAAGCCTTTACTCG AGTCAATTACCTTACTCAGCATCAGAGAAGATCCACACCGGTGAGAAGCCTCACGAATG TAAGGAGTGTGGGAAGGCTTTCGCTGGGGTTCGAGCTCGTTAAGCACGAGAGGA TACATACGGGCGAGAAGCCTACAAGTGCACAGAATGGGAAGCCTTCAATTGT GGCTATCACCTCACTCAGCACGAGAGAATCCACACAGGCGAAACCCGTATAAATGT TCATACCGGGGTGAAACCTATGGGTGTACAGAATGTGGGAAGAGCTTTAGTCACG GCCATCAAGCTTACACAACAACCTCACAAGTGGGGGCAATCTCTACGAATGT AAGGAGTGCGGGAAGCCATGTAACCTAAACCATTCCGAGAACATCAGAGGAAT CCACAACAGTTGA | 6420 |
| | 3 | MSKDLLEKAPLLEHRDIRRIPLNVRTVGRPLVVAINL VMRKSILVRNLMNVKNVRRPSVGAISLLNIKKFILGRSP TNVKTVGRLFDCAQASLFIRGFILVKNPMNVKTVERPF GVVMSSLSTRDSTLGRKTNAKTVGRPLAVCINLFSTRE PTVGRSLTSVKTVGRLLFVVQASPSIKEFTQVRNPMNYK NVGRPFLLESTTLLSIRRSFPVRSLTNVRSVGRPFAGVRAS LSTRGYIRARSKTSAQNVGRPSIVAIITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGCCTTTAGTCGTGCTATC AACTTAGTCAACATCAGAAAATCCATACTGGTGAGAAACCTTATGAATGTAAAGAAT GTAAGGAAGCCTTCCGTTGGGCAATCAGCTTACTCAACATCAAAAATTCATACTG GGGAGAAGCCCTACGAATGTAAAGACTGTGGGAAGACTTTTCGATGGGGCTCAAGC CTCGTTATTCATAAGAGGATTCATACTGGTGAAAAACCTATGAATGTAAAGACTGT GGAAAGGCCTTTCGGCGTGGTGAGCTCACTCAGCACCAGAGACTTCACACTGG GGAGAAAGACTACGAATGCAAAGACTGTGGGAAGACCTTAGCCGTGTGTATAAAC TTATTCAGCACACAAGAATTCATAGTGGGAGAAGACCTTTCAGCCTCGTGTATAAAC GGGAAGGCTTTCTATTTGGTTCAAGCCTCGTTAAGCACGAGAGGATACATACGGGT GAGAAACCCTATGAATGTCAAGAATGTGGGAAGCCTTTACTCGAGTCAATTACTTT ACTCAGCATCAGAGAATCCACACCGGTGAGAAGCCTCACGAATGTAAGGAGTGTGG GAAGGCCTTTCGCTGGGGTTCGAGCCTCGTTAAGCACGAGGATACATACGGGCG AGAAGCCGTACAAGTGCACAGAATGTGGGAAGCCTTCAATTGTGGCTATCACCTC ACTCAGCACGAGAGAATCCACACAGGCGAAACCCGTATAAATGTAAGGAGTGTGG GAAGGCTTTCATTTATGGATCGAGCCCTCGTGA | 6422 |
| | 4 | MGLKPRYS* | ATGGGGCTCAAGCCTCGTTATTCATAA | 6424 |
| | 1 | MSIR* | ATGTCAATCAGATGA | 6426 |

| | | | |
|---|---|---|---|
| hsa-mir-516a-2 | 2 | MHINYVKRPATREGTPPRTHQRHHKENSPECKDCGKAF SRGYQLSQEHQKIHTGEKPYECKECKCKAFRWGNLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCTCCTAGAACA CATCAGAGACATCATAAGGAGAATTCCTTTGAATGTAAGGACTGTGGAAGGCCTTT AGTCGTGGCTATCAACTTAGTCAACATCAGAAATTCATACTGGTGAGAAACCTTAT GAATGTAAAGAATGTAAGAAGGCCTTCCGTTGGGCAATCAGTCATCAACATCAA AAATTCATACTGGTGAAGAAGCCTTGTATTCATAAGACTGTAAAGACTGTGAAGAAGGCTTATGA ATGTAAAGACTGTGGGAAGGCCTTTCGCTGGTCAAGTCTCACTCAGCACCAGA GATTCCACACTGGGAGGAGAAAGACTACGAATGCAAAGACTGTGGGAAGACCTTAGC CGTGTGTATAAACTTATTCAGCACACAAGAGAATTCATAGTGGGGAGAAGCTTACGA GTGTAAAGACTGTGGGAAGGCTTTTATTGGTTCAAGCCTCATTCAGCATAAAG AATTCACACAGGTGACACAAACCCTATGAATGTCAAAGAATGTGGAAGGCCTTTACTCG AGTCAATTACCTTACTCAGCATCAGAGATCCACACCGGTGAGCCTCGTTAAGCACGAGGA TACATACGGGCGAGAAGGCCTACAAGTGCACAGAATGCGGAAGCCTCAATTGT GGCTATCACCTCACTCAGCACGAGAATCCACACAGGTGAAACCCGTATAGAGAAT TCATACCGGGGTGAACCCTATGGGGTACAGAATGTGGGAAGACTTTAGTCACG GCCATCAAGCTTACACAACACTCAGAAACGCACAGTGGGGCAAATCCACGAATGT AAGGAGTGCGGAAGCATGTAACCACCTAAACCATCTCGAGAACATCAGAGGAT CCACAACAGTTGA |
| | 3 | MSKIDLLEKAPLLEHRDIRRIPLNVRTVGRPLVVAINL VNIRKSILVRNLMNVKNVRRPSVGAISLLNIKKPILGRSP TNVKTVGRLFDGAQASLFIRGFILVKNPMNVKTVERPF GVVMSSLSTRDSTLGRKTTNAKTVGRPLAVCINLFSTRE PIVGRSLTSVTKVGRLLFVVQASPSIKEFTQVRNPMNYK NVGRPLLLESTTLLSIRRSFTPVRSLTNVRSVGRPFAGVRAS LSTRGYIBARSRKTSAQNVGRPSIVAITSLSTRESTQAKFRI NVRSVGRLSFMDRAS* | ATGTCAAAAGACCTGCTACTAGAGAAGGCACCCTCCTAGAACACATCAGAGACATC ATAAGGAGAATTCCTTTGAATGTAAGGACTGTGGGAAGGCCTATCAGTCGTGCTATC AACTTAGTCAACATCAGAAATCCATACTGGTGAGAAGGCCTATCAAGAATGTAAAGAAT GTAAGAAGGCCTTCCGTTACGAATGTAAAGACTGTGGGAAGGCTTTCGATGGGGCTCAAGC CTCGTTATTCATAAGAGGATTCATAGTGTGGGTGAAAAAACCCTATGAATGTAAAGACTGT GGAAAGGCCTTTCGGCGTGATGAGCTCACTCAGCACCAGAGACCTTCACACTGG GGAGAAAGACTACGAATGCAAAGACTGTGGAAGACCTTAGCCGTGTGTATAAAC TTATTCAGCACACTACAGTGGGAGAAGCTTATTCAGCAGTAAAGAATTCACACAGGT GGGAAGGCCTTTGCAGCCTCGTTAAGCACGAGGATACAGATACGGGCG GAGAAGGCCTTCGTGCGTACAGAATGTCGGAAGCCTCAATTGTGGCTATCACCTC ACTCAGCACGAGAATCCACACAGGTGGGAAACCCGTATAAATGTAAGGAGTGTGG GAAGGCTTTCATTTATGGATCGAGCCCTGTGA |
| | 4 | MGLKPRYS* | ATGGGCTCAAGCCTCGTTATTCATAA |
| | 1 | MSIR* | ATGTCAATCAGATGA |

Figure 1 (Continued)

| | | | | |
|---|---|---|---|---|
| hsa-mir-516b-1 | 2 | MHNYVKRPATREGTPPRTHQRRHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | 6435 | ATGATCATCAATTATGTCAAAAGACCTGCTACTAGAGAAGGCACCCTCCTAGAACA CATCAGAGACATCATAAGGAGAATTCCTTTGAATGTAAGGACTGTGGCTGCTATC AGTCGTGGCTATCAACTTAGTCAACATCAGAAATCCATACTGGTGAGAAACCTTAT GAATGTAAAGAATGTAAGGAGCCTTCCGTTGGGCAATGTAAAGACTGTAACATCAA AAAATTCATACTGGGGAGAAGGCCTCTATTCATAAGAGACTTCATACTGGTGAAAACCTATGA ATGGGGCTCAAGCTGTGGAAGACTCTGTGAAAGCCTTTCGCGTGGTAGAGCTCACTCAGCACCAGA ATGTAAAGACTGTGGGAGGAAGGCCTTTCGCGTGGTAGAGCTCACTCAGCACCAGA GATTCCACACTGGGGAGAAGACTACGAATGCAAAGACTGTGGGAAGACCTTTAGC CGTGTGTATAAACTTATTCAGCACACAGAAGAATTCATAGTGGGGAGAAGCTTACGA CGTGTAAAGACTGTGGGAAGGCTTTTATTGGTTCAAGCCTCATTCAGCATAAAG AATTCACACAGGTGAGAAGACCCTATGAATGTCAAGAATGTGGGAAGGCTTTACTCG AGTCAATTACCTTACTCAGCATCAGAGAATCCACACCGGTGAGAAGCCTCACGAATG TAAGGAGTGTGGGAGCGGACCTCTGTTAAGCACGAGAGGA TACATACGGGCGAGAAGGCCTACAAGTGCACAGAATGGGGAAGCCTTCAATTGT GGCTATCACCTCACTCAGCACGAGAAGAATCCACACAGGCGAAACCCGTATAAATGT TCATATCCGGGGTGAAACCCTATGGGTGTACAGAAATGTGGGAAGACTTAGTCACG GCCATCAAGCTTACACAACACAGAAAACGCAGTGGGGCAAAATCCTACGAATGT AAGGAGTGCGGGAAGCATGTAACCTAAACCATCTCCGAGAACATCAGAGGAT CCACAACAGTTGA | 6436 |
| | 3 | MSKDILLEKAPLLEHRDIRRIPLNVRTVGRPLVVAINL VNIRKSILVRNLMNVKNVRRPSVGAISLLNIKKPILGRSP TNVKTVGRLLFDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIBARSKTSAQNVGRPSIVAIITSLSTRESTQAKFRI NVRSVGRLSFMDRAS* | 6437 | ATGTCAAAAGACCTGCTACTAGAGAAGGCACCCTCCTAGAACACATCAGAGACATC ATAAGGAGAATTCCTTTGAATGTAAGGACTGTGGGAAGCCTATCAGTCGTGCTATC AACTTAGTCAACATCAGAAATCCATACTGGTGAGAAATGTAAAGAAT GTAAGAAGGCCTTCCGTACGAATCAGCTTACTCAACATCAAAAATTCATACTG GGGAGAAGCCCTACGAATGTAAAGACTGTGGGAAGGCTTTCGATGGGGCTCAAGC CTCGTTATTCGATAAGAGGATTCATACTGGTGAAAAACCTATGAATGTAAAGACTGT GAAAAGGCCTTTCGGCGTGATGTGAGCTCACTCAGCACCAGAGATTCCACACTGG GGAGAAAGACTACGAATGCAAAGACTGTGGGAAGACCTTAGCCGTGTGTATAAAC TTATTCAGCACACAGAATTCATAGTGGGAAGCTTACGAGTGTAAAGACTGT GGGAAGGCTTTTATTGGTTCAAGCCTCATTCAGCATAAAAGAATTCACACAGGT GAGAAACCCTATGAATGTCAAGAATGTGGGAAGCCTTTACTCGAGTCAATTGTGCC ACTCAGCACGAGAGGAATCCACACAGGCGAAACCCTTCAATTGTGGCTATCACCTC ACTCAGCACAAGCGTACAGAAATGTGGGAAGCCTTCAATTGTGGCTATCACCTC GAAGGCTTTCATTTATGGATCGAGCCTCGTGA | 6438 |
| | 4 | MGLKPRYS* | 6439 | ATGGGGCTCAAGCCTCGTTATTCATAA | 6440 |
| | 1 | MSIR* | 6441 | ATGTCAATCAGATGA | 6442 |

Figure 1 (Continued)

| | | | |
|---|---|---|---|
| hsa-mir-516b-2 | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRRGDEITQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGTACTAGAGAAGGCACCCCTCCTAGAACA CATCAGAGACATCATAAGGAGAATTCCTTTGAATGTAAGGACTGTGGCTGCTATC AGTCGTGGCTATCAACTTAGTCAACATCAGAAAATTCATACTGGTGAGAAACCTTAT GAATGTAAAGAATGTAAGAAGGCCTTCCGTTGGGCAATCAGCTTACTCAACATCAA AAAATTCATACTGGGGAGAAGCCTTCTATTCATAAGAGATTCATACTGGTGAAAAACCTATGA ATGGGGCTCAAGCTGTGGAAGCTCGTTATTCATAAGAGATTCATACTGGTGAAAAACCTATGA ATGTAAAGACTGTGGAAGACTGTGGGAGACCTTTCCGCGTGGTGAGCTCACTCAGCACCAGA GATTCCACACTGGGGAGAAGATCTACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTTATTGTGGTTCAAGCCTCATTCAGCATAAAG AATTCACACAGGTGAGAAACCCTATGAATGTCAAAGATGTGGGAAGGCCTTTACTCG AGTCAATTACCTTACTCAGCATCAGAGAATCCACAACCGGTGAGAAGCCTCACGAATG TAAGGAGTGTGGGCAGCTCACTCTCAGCACGAGAAGTCTGAGCCTCGTTAAGCACGAGAGA TACATACGGGCGAGAAGCCTACAAGTGCACAGAATGCACCAAGCGAAACCCGTATGGT GGCTATCACCTCACTCAGCACGAGAATCCACACAGGCGAAACCCGTATGAGAGAAT TCATACCGGGGTGAACCCTATGGGTGACAGAATGTGGGAAGACTTTAGTCACG GCCATCAAGCTTACACAACACAGAAACCAAGGGGCGAAACCCTAAACCATCTCGAGAATGT AAGGAGTGCGGGAAGCCATGTAACCTAAACCATCTCCGAGAACATCAGAGGAT CCACAACAGTTGA | 6444 |
| | 3 | MSKIDLLEKAPLLEHRDIRRRIPLNVRTVGRPLVVAINL VNIRKSILVRNLMNVKNVRRPSVGAISLUNIKKPILGRSP TNVKTVGRLFDGAQASLFIRGFILVKNPMNVKTVERPF GVVMSSLSTRDSTLGRKTTNAKTVGRPLAVCINLFSTRE PIVGRSLTSVTSVGRLLFVVQASPSIKEFTQVRNPMNYK NVGRPFLLESTLLSIRRSFPVRSLTVNVRSVGRPFAGVRAS LSTRGYIBARSRKTSAQNVGRPSIVAITSLSTRESTQAKPRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTAGTCGTGCTATC AACTTAGTCAACATCAGAAAATCATACTGGTGAGAAACCCTTATGAATGTAAGAAT GTAAGAAGGCCTTCACTAAGGAAGTGGGCAATCAGCTTACTCAACATCAAAAATTCATACTG GGGAGAAGCCCCTACGAATGTAAAGACTGTGGGAAGGCTTTCGATGGGGCTCAAGC CTCGTTATTCATAAGAGATTCATACTGGTGAAAAACCCTATGAATGTAAAGACTGT GGAAAGGCCTTTCGGCGTGGTGAGCTCACTCAGCACCAGAGATCCACACTGG GGAGAAAGACTACGAATGCAAAGACTGTGGGAAGACCTTAGCCGTGTGTATAAAC TTATTCAGCACACAAGAGAATTCATAGTGGGGAGAAGCCTTACGAGTGTAAAGGT GGGAAGGCTTTTTATTGTGTTCAAGCCTCATTCAGCATAAAAGAATTCACACAGGT GAGAAACCCTATGAATGTCAAAGATGTGGGAAGACCTTTACTGGCATAATTACCTT ACTCAGCATCAGAGAATCCACACCGGTGAGAAGCCTCACGAATGTAAGGAGTGTGG GAAGGCCTTTGCTGGGGTCGACGAAGAGGATACATACGGGGCG GAGAAGCCGTACAAGTGCACACAGGAATGTGGGAAGGCCTTCAATTGTGGCTATCACCTC ACTCAGCACGAGAATCCACACAGGCGAAACCCGTATAAGGAGTGTGGAAGGCCTTTAAG GAAGGCTTCATTTATGGATCGAGCCCTCGTGA | 6446 |
| | 4 | MGLKPRYS* | ATGGGGCTCAAGCCTCGTTATTCATAA | 6448 |
| | 1 | MSIR* | ATGTCAATCAGATGA | 6450 |

Figure 1 (Continued)

| | | | |
|---|---|---|---|
| hsa-mir-517a-1 | 2 | MHINYVKRPATREGTPPRTHQRHHKENSPECKDCGKAF SRGYQLSQEHQKIHTGEKPYEECKECKKAFRWGNQLTQH QKIHTGEKPYECKDCGKAFRWGSSLVIHKRIHTGEKPY ECKDCGKAFRRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCTCCTAGAACA CATCAGAGACATCATAAGGAGAATTCCTTTGAATGTAAGGACTGTGGGAAGCCTTT AGTCGTGGCTATCAACTTAGTCAACATCAGAAATTCCATACTGGTGAGAAACCTTAT GAATGTAAAGAGCTGTGGAAGGCCTTCCGTTGGGCAATCAGCTTACTCAACATCAA AAAATTCATACTGGGGAGAAGCCTACGAATGTAAAGACTGTAAAGACCTTTTCG ATGGGGCTCAAGCTCGTTATTCATAAGAGAATTCATACTGGTGAAAAACCCTATGA ATGTAAAGACTGTGGAAAGGCCTTTCGCGTTGGTAGAGCTCACTCAGCACCAGA GATTCCACACTGGGGAGAAGACTACGAATGCAAAGACTGTGGGAAGACCTTTAGC CGTGTGTATAAACTTATTCAGCACACAAGAGAATTCATAGTGGGGAGAAGCCTTACGA GTCTAAAGACTGTGGAAGGCTTTATTTGTGGTTCAAGCCTCATTCAGCATAAAG AATTCACACAGGTGAGAACCCTATGAATGTCAAAGATGTCACAGAAGCCTTTACTCG AGTCAATTACCTTACTCAGCATCAGAGAATCCACACCGGTGAGAAGCCTCACGAATG TAAGGAGTGTGGGCGGAGAAGCCTACAAGTGCACAGAATGCACACCCCTTCAATTGT TACATACGGGCGAGAAGCCTACAACAGGTGAAACCCGTATAAGAGAGAT GGCTATCACCTCACTCAGCACGAGAAATCCACACAGGGAAACCCTCGTTAAGTCACG AAGGAGTGTGGGAAGCCTTTCATTTATGGATCGAGCCTGTACAGAATGTGGGAAGAAT GCCATCAAGCTTACAACACACAAGACACAGTGGGCGGGAGAAATCTCCGAGAATGT AAGGAGTGCGGAAGCCATGTAACCACCTAAACCATCCTCGAGAACATCAGAGGAT CCACAACAGTTGA | 6451 / 6452 |
| | 3 | MSKIDLLEKAPLLEHRDIRRFPLNVRTVGRPLVVAINL VMIRKSLVRNLMNVKNVRRPSVGAISLLNIKKFILGRSP TNVKTVGRLFEDGAQASLFIRGFILVKNPMNVKTVERPF GVVMSSLSTRDSTLGRKTVNAKTYGRPLAVCINLFSTRE PTVGRSLTSVKTVGRLLFVVQASPSIKEFTQVRNPMNVK NVGRPLLESITLLSIRRSFPVRSLTNVRSVGRPFAGVRAS LSTRGYIRARSRKTSAQNVGRPSIVAITSLSTRESTQAKFRI NVRSVGRLSFMDRAS* | ATGTCAAAAGACCTGCTACTAGAGAAGGCACCCTCCTAGAACACATCAGAGACATC ATAAGGAGAATTCCTTTGAATGTAAGGACTGTGGGAAGCCTTAGTCGTGGCTATC AACTTAGTCAACATCAGAAAATCCATACTGGTGAGAAACCTTATGAATGTAAAGAAT GTAAGAAGGCCTTCAACATCAGCTTACTCAACATCAAAAATTCATACTG GGGAGAAGCCCTACGAATGTAAAGACTGTGGGAAGGCTTTCGATGGGGCTCAAGC CTCGTTATTCATAAGAGAATTCATACTGGTGAAAAACCCTATGAATGTAAAGACTGT GGAAAGGCCTTTCGGCCTGATGAGCTCACTCAGCACCAGAGATTCCACACTGG GGAGAAAGACTACGAATGCAAAGACTGTGGGAAGACCTTAGCCGTGTGTATAAAC TTATTCAGCACACTACTGGTCTGCGGGAAGAATTCAGCATGTAAAGAAGGCTTACGAGTGT AAGAAGATTCAAGCATCAGGTGAAAGCCTTACTGAATGTAAGATCAAAACTTACACCTG ACTCAGCACGAGATCCACACACTCAGAAGCTACGAGAGGATCACACACGGGGCG GAAGGCCCTTCACTGACGTACGGTAAGATGCCACAGAAGTGGGAAGGCCTTCAAGAGGT ACTCAGCAGGACTACAAGGTGCACAGAATCCACACAGGCGGAAACCCGTATCACCTC GAAGGCTTTCATTTATGGATCGAGCCGTGA | 6453 / 6454 |
| | 4 | MGLKPRYS* | ATGGGCTCAAGCCTCGTTATTCATAA | 6455 / 6456 |
| | 1 | MSIR* | ATGTCAATCAGATGA | 6457 / 6458 |

Figure 1 (Continued)

| | | | |
|---|---|---|---|
| hsa-mir-517a-2 | 2 | MHNYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGTACTAGAGAAGGCACCCTCCTAGAACA CATCAGAGACATCATAAGGAGAATTCCTTTGAATGTAAGGACTGTGGAAGGCCTTT AGTCGTGGCTATCAACTTAGTCAACATCAGAAAATCCATACTGGTGAGAAACCTTAT GAATGTAAAGAATGTAAGAAGGCCTTCCGTTGGCAATCAGCTTACTCAACATCAA AAAATTCATACTGGGGAGAAGCCTACGAATGTAAAGACTGTGGGGAAGGCTTTCG ATGGGGCTCAAGCTGTGATTCATAAAGAGAATTCATACTGGTGAAAAACCTATGA ATGTAAAGACTGTGGAAGGCCTTTCCGCGTGGTAAGCTCACTCAGCACCAGA GATTCCACACTGGGGAGAAGATACGAATGCAAAGACTGTGGGAAGACCTTAGC CGTGTGTATAAACTTATTCAGCACACAAGAGAATTCATAGTGGGGAGAAGCCTTACGA GTCTAAAGACTGTGGAAGGCTTTTATTGGTTCAAGCCTCATTCAGCATAAAG AATTCACACAGGTGAGAAGACCCTATGAATGTCAAAGATGTGGAAGGCCTTACTCG AGTCAATTACCTTACTCAGCATCAGAGAATCCACACCGGTGAGAAGCCTCACGAATG TAAGGAGTGTGGGAAAGGCCTTTCGCTGGGGTTCAGCCTCGTTAAGCACGAGAGGA TACATACGGGCGAGAAGCCTACAAGTGCACAGAATGCAAAGACCCTATGAATGT GCTATCACCTCACTCAGCACGAGAAATCCACACAGGGGAAACCCGTATGAGAGAAT TCATACCGGGGTGAAACCCTATGGGTGCACAGAATGTGGGAAGACCTTAGTCACG GCCATCAAGCTTACACAACATCAGAAAACGCACAGTGGGGCGAAAATCCTACGAATGT AAGGAGTGCGGGAAGGCATGTAACCTAAACCATCTCCGAGAACATCAGAGGAT CCACAACAGTTGA | 6459 6460 |
| | 3 | MSKDILLEKAPLLEHRDIRRRIPLNVRTVGRPLVVAINL VMRKSILVRNLMNVKNVRRPSVGAISLLNIKKPILGRSP TNVKTVGRLFDGAQASLFIRGFILVKNPMNVKTVERPF GVVMSSLSTRDSTLGRKTNAKTVGRPLAVCINLFSTRE PLVGRSLTSVKTVGRLLFVVQASPSIKEFTQVRNPMNYK NVGRPLLESTTLLSIRRSFPVRSLTNVRSVGRPFAGVRAS LSTRGYIBARSRKTSAQNVGRPSIVAITSLSTRESTQAKFRI NVRSVGRLSFMDRAS* | ATGTCAAAAGACCTGCTACTAGAGAAGGCACCCTCCTAGAACACATCAGAGACATC ATAAGGAGAATTCCTTTGAATGTAAGGACTGTGGGAAGGCCTTTAGTCGTGCTATC AACTTAGTCAACATCAGAAAATCCATACTGGTGAGAAACCTTATGAATGTAAAGAAT GTAAGAAGGCCTTCACTCAGCTTACTCAACATCAAAAAATTCATACTG GGGAGAAGCCCTACGAATGTAAAGACTGTGGGAAGGCTTTTCGATGGGGCTCAAGC CTCGTTATTCATAAAGAGGATTCATACTGGTGAAAAACCTATGAATGTAAAGACTGT GGAAAGGCCTTTCGGCGTGGTAAGCTCAACTCAGCACCAGAGATTCCACACTGG GGAGAAAGACTACGAATGCAAAGACTGTGGGAAGAACCTTAGCCGTGTAAGGACTGT TTATTCAGCACTACGAATGTAAGTGGGGAAGATTCATACTGGTGAAAGCCTGTATAAAC GGGAAGGCCTTTATTGGTTCAAGCCTCGTTAAGCACGAGAAGGATACACAGGT GAGAAACCCTATGAATGTCAAGATGTGGAAGGCCTTACTCGAGTCAATTACCTT ACTCAGCAGATCAGAGAATCCACACCGGTGAGAAGCCTCACGAATGTAAGGAGTGTG GAAGGCCTTTCGCTGGGGTTCAGCCTCGTTAAGCACGAGAGGATACATACGGGCG GAGAAGCCGTACAAGTGCACAGAATGTGGGAAGGCCTTCAATTGTGGCTATCACCTC ACTCAGCACGAGAAGATCCACACAGGGGAAACCCGTATGAATGTAAGGAGTGTGG GAAGGCTTTCATTTATGGATCGAGCCGTGA | 6461 6462 |
| | 4 | MGLKPRYS* | ATEGGCTCAAGCTCGTTATTCATAA | 6463 6464 |
| | 1 | MSIR* | ATGTCAATCAGATGA | 6465 6466 |

Figure 1 (Continued)

| | | | | |
|---|---|---|---|---|
| hsa-mir-517c | 2 | MHINYVKRPATREGTPPRTHQRHHKENSPECKDCGKAF SRGYQLSQHQKIHTGEKPYECKECKKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAACA CATCAGAGACATCATAAGGAGAATTCCTTTGAATGTAAGGACCCCTCCTAGAACA AGTCGTGGCTATCAACTTAGTCAACATCAGAAATTCCATACTGGTGAGAAACCTTAT GAATGTAAAGAATGTAAGAAGGCCTTCCGTTGGGCAATCAGCTTACTCAACATCAA AAAATTCATACTGGGGAGAAGCCTCATAAAGACTGTAAAGACTTTTCG ATGGGCTCAAGCTCGTTATTCATAAGAGAATTCATACTGGTGAAAAACCCTATGA ATGTAAAGACTGTGGAAGAATGCAAAGACCCCTGATGAGCTCACTCAGCACCAGA GATTCCACACTGGGGAGAAGACTACGAATGCAAAGACTGTGGGAAGACCTTAGC CGTGTGTATAAAACTTATTCAGCACACAAGAGAATTCATAGTGGGAGAAGCCTTACGA GTGTAAAGACTGTGGAAGGCTTTTATTGGTTCAAGCCTCATTCAGCATAAAG AATTCACACAGGTGAGAATGCAAAACCCTATGAATGTCAAAGATGTGGAAGGCCTTTACTCG AGTCAATTACCTTACTCAGCATCAGAGAATGTCACACCGGGTGAGCCTCGTTAAGCACGAGGA TACATACGGGCGAGAAGGCCTACAACAGCAGCCTTCGAGCCCTCTGTTAAGCACGAGGA GGCTATCACCTCACTCAGCACGAGAATCCACACAGGAGAACCCGTATAATGT TCATACCGGGGTGAAACCTATGGGTGTACAGAAATGTGGGAAGACTTTAGTCACG GCCATCAAGCTTACACAACAACCGCACAGTGGGCGAAATCCGAAGAATGT AAGGAGTGCGGGAAGCATGTAACCATCTAAACCATCCGAGAACATCAGAGGAT CCACAACAGTTGA | 6467 6468 |
| | 3 | MSKIDLLEKAPLLEHRIDRRIPLNVRTVGRPLVVAINL VNIRKSILVRNLMNVKNVRRPSVGAISLLNIKKPILGRSP TNVKTVGRLIEDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLLESITLLSIRRSFTPVRSLTNVRSVGRPFAGVRAS LSTRGYIBARSRKTSAQNVGRPSIVAITSLSTRESTQAKFRI NVRSVGRLSFMDRAS* | ATGTCAAAAGACCTGCTACTAGAGAAGGCACCCCTCCTAGAACATCAGAGACATC ATAAGGAGAATTCCTTTGAATGTAAGGACTGTGGGAAGGCCTTAGTCGTGCTATC AACTTAGTCAACATCAGAAATTCCATACTGGTGAGAAGAATGTAAAGAAT GTAAGAAGGCCTTCCGTTACTCAGCTTACTCAACATCAAAAATTCATAACTG GGGAGAAGAAGCCCTACGAATGTAAGACTGTGGGAAGGCCTTCGATGGGGCTCAAGC CTCGTTATTCATAAGAGATTCATACTGGTGAAAAACCCTATGAATGTAAAGACTGT GGAAAAGGCCTTTATTCGGCCGTGATGAGCTCACTCAGCACCAGAGATTCCACACTGG GGAGAAAGACTACGAATGCAAAGACTGTGGGAAGAACCTTAGCCGTGTATAAAAC TTATTCAGCACACTACGAATGTCAAGTGGGAGAAGCCTTACGAGTGTAAAGACTGT GGAAGGCTTTATTGTGTTCAAGCCTCATTCAGCATAAAGAATTCACACAGGT GAGAAACCCTATGAATGTCAAGAATGTGGGAAGGCCTTACTGAGTCAATTACCTT ACTCAGCAGCACGAGAATCCACACCGGTGAGAAGCCTCAAGCACGAGGATGTGG GAAGGCCTTTCGCTGGGGTTCGAGCCTCGTTAAGCACGAGAAGGATACATACGGGCG ACTCAGCAAGCGTACAAGTCACACAGGGCGAAACCCTCAATTGTGGCTATCACCTC GAAGGCTTTCATTATGGATCGAGCCTCGTGA | 6469 6470 |
| | 4 | MGLKPRYS* | ATEGGGCTCAAGCTCGTTATTCATAA | 6471 6472 |
| | 1 | MSIR* | ATGTCAATCAGATGA | 6473 6474 |

Figure 1 (Continued)

| | | | |
|---|---|---|---|
| hsa-mir-518a-1 | 2 | MHINYVKRPATREGTPPRTHQRRHKENSPECKDCGKAF SRGYQLSQEHQKIHTGEKPYECKECKAFRWGNQLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGTACTAGAGAAGGCACCCTCCTAGAACA CATCAGAGACATCATAAGGAGAATTCCTTTGAATGTAAGGACTGTGGAAGGCCTTT AGTCGTGGCTATCAACTTAGTCAACATCAGAAAATCCATACTGGTGAGAAACCTTAT GAATGTAAAGAATGTAAGGACGCCTTCCGTTGGGCAATCAGCTTACTCAACATCAA AAAATTCATACTGGGGAGAAGCCTTACGAAGATGTAAAGACTGTGGGAAGGCTTTCG ATGGGGCTCAAGCTCGTTATTCATAAGAGGATTCATACTGGTGAAAAACCTATGA ATGTAAAGACTGTGGGAAGGCCTTTCGCGTGGTCAATCAGCTCACTCAGCACCAGA GATTCCACACTGGGGAGAAGATTACGACACAAGAGAATGCAAAGACTGTGGGAAGACCTTTAGC CGTGTGTATAAACTTATTCAGCACGACAAGAGAATTCATAGTGGGGAGAAGCCTTACGA GTGTAAAGACTGTGGGAAGGCTTTTATTGGTTCAAGCCTCATTCAGCACATAAAG AATTCACACAGGTGAGAAACCCTATGAATGTCAAGAATGTGGGAAGGCCTTTACTCG AGTCAATTACCTTACTCAGCATCAGAGATCCACACCGGTGAGAAGCCTCACGAATG TAAGGAGTGTGGGCGAGAAGCCTTTCGCTGGGGTTCGAGCCTCGTTAAGCACGAGGA TACATACGGGCGAGAAGCCTACAAGTGCACAGAATGGGGAAGCCTTAAGCACGAGGA GGCTATCACCTCACTCAGCACGAGAAGATCCACACAGGTGAAACCCGTATAAATGT TCATACCGGGGTGAAACCCTATGGTGTACAGAATGTGGGAAGACTTTAGTCACG GCCATCAAGCTTACACAACACAGAAACGACAAGTGGGGCGAAATCCTACGAATGT AAGGAGTGCGGGAAGCCATGTAACCACCTAAACCATCTCCGAGAACATCAGAGGAT CCACAACAGTTGA | 6475 6476 |
| | 3 | MSKDILLEKAPLLEHRDIRRIPLNVRTVGRPLVVAINL VMRKSILVRNLMNVKNVRRPSVGAISLLNIKKPILGRSP TNVKTVGRLFDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIBARSRKTSAQNVGRPSIVAIITSLSTRESTQAKFRI NVRSVGRLSFMDRAS* | ATGTCAAAAGACCTGCTACTAGAGAAGGCACCCTCCTAGAACAGATCAGAGACATC ATAAGGAGAATTCCTTTGAATGTAAGGACTGTGGGAAGGCCTTTAGTCGTGCTATC AACTTAGTCAACATCAGAAAATCCATACTGGTGAGAAACCTTATGAATGTAAAGAAT GTAAGAAGGCCTTCATCAGCTTACTCAACATCAAAAATTCATACTG GGGAGAAGAAGCCCTACGAATGTAAAGACTGTGGGAAGGCTTTCGATGGGGCTCAAGC CTCGTTATTCATAAGAGGATTCATACTGGTGAAAAACCTATGAATGTAAAGACTGT GGAAAAGGCCTTTCGGCGTGATGTGAGCTCACTCAGCACCAGAGATTCCACACTGG GGAGAAAGACTACGAATGCAAAGACTGTGGGAAGAACCTTAGCCGTGTGTATAAAC TTATTCAGCACGACAAGAGAATTCAATAGTGGGAGAAGCCTTCAGCATAAAAGGTT GGGAAGGCCTTTTATTGGTTCAAGCCTCGTTAAGCACGAGGAAGATCCACACGGT GAGAAACCTATGAATGTCAAGAATGTGGGAAGGCCTCGTTAAGCACGAGGATACATACGGGCG ACTCAGCATCAGAGATCCACCGGTGAGAAGCCTCACGAATGTAAGGAGTGTGG GAAGGCCTTTCGCTGGGGTTCGAGCCTCGTTAAGCACGAGGATACATACGGGCG GAGAAGCCGTACAAGTGCACAGAATGTGGGAAGCCTTCAATTGTGGCTATCACTC ACTCAGCACGAGAAGATCCACACAGGGCGAAACCCGTATAAATGTAAGGAGTGTGG GAAGGCTTTCATTTATGGATCGAGCCGTGA | 6477 6478 |
| | 4 | MGLKPRYS* | ATGGGGCTCAAGCCTCGTTATTCATAA | 6479 6480 |
| 1 | | MSIR* | ATGTCAATCAGATGA | 6481 6482 |

Figure 1 (Continued)

| | | | |
|---|---|---|---|
| hsa-mir-518a-2 | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGTACTAGAGAAGGCACCCCTCCTAGAACA CATCAGAGACATCATAAGGAGAATTCCTTTGAATGTAAGGACTGTGGGAAGGCCTTT AGTCGTGGCTATCAACTTAGTCAACATAGTCAGAAAATCCATACTGGTGAGAAACCTTAT GAATGTAAAGAATGTAAGAAGCCTTCCGTTGGCAATCAGCTTACTCAACATCAA AAAATTCATACTGGGGAGAAGCCTCGTTATTCATAAGAGACTTCATACTGGTGAAAAACCTATGA ATGTAAAGACTGTGGGAAGGCCTTTCGCGTGGTAGAGCTCACTCAGCACCAGA GATTCCACACTGGGAGAAGACTACGAATGCAAAGACTGTGGGAAGACCTTAGC CGTGTGTATAAACTTATTCAGCACACAAGAGAATTCATAGTGGGGAGAAGCCTTACGA GTGTAAAGACTGTGGGAAGGCTTTTATTGGTTCAAGCCTCATTCAGCACATAAAG AATTCACACAGGTGAGAAGCCTATGAATGTCAAAGAATGTGGGAAGGCCTTACTCG AGTCAATTACCTTACTCAGCATCAGAGATCCACACCGGTGAGAAGCCTCACGAATG TAAGGAGTGTGGGAAGGCTTTCGCTGGGGTTCAGCCTCGTTAAGCACGAGAGGA TACATACGGGCGAGAAGCCTACAAGTGCACAGAATGTCACAGGCCTACAAGAGTGT GGCTATCACCTCACTCAGCACGAGAAATCCACACAGGCGAAACCCGTATAAATGT AAGGAGTGTGGGAAGCCTTTCATTTATGGATCGAGCCTCGTGAAACATGAGAAT TCATACCGGGGTGAAACCTCTAGGGTGTACAGAATGTGGGAAGAGCTTTAGTCACG GCCATCAAGCTTACACAACACACAGAAAACGCACAGTGGGGCGAAATCCTACGAATGT AAGGAGTGCGGGAAGCCATGTAACCTAAACCATTCCGAGAACATCAGAGGAT CCACAACAGTTGA | 6483 |
| | 3 | MSKIDLLEKAPLLEHRDIRRRIPLNVRTVGRPLVVAINL VNIRKSILVRNLMNVKNVRRPSVGAISLLNIKKPILGRSP TNVKTVGRLFDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIBARSRKTSAQNVGRPSIVAIITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTTAGTCGTGCTATC AACTTAGTCAACATCAGAAAATCCATACTGGTGAGAAACCTATGAATGTAAAGAAT GTAAGAAGGCCTTCAGTTACTCATCAGCTTACTCAACATCAAAAAATTCATACTG GGGAGAAGCCCTACGAATGTAAAGACTGTGGGAAGGCTTTTCGATGGGGCTCAAGC CTCGTTATTCATAAGAGGATTCATACTGGTGAAAAACCTATGAATGTAAAGACTGT GGAAAAGGCCTTTCGGCCTGTGATGAGCTCACTCAGCACCAGAGATTTCCACACTGG GGAGAAAGACTACGAATGCAAAGACTGTGGGAAGACCTTAGCCGTGTGTATAAAC TTATTCAGCACAGCTTTATTGGTTCAAGCCTCATTCAGCATAAAAGAATTCACACGGT GGGAAGGCCTTTTCGAGCCTGTTCAAGCCTCGTTAAGCACGAGAGGATACATACGGGCG AGAAACCCTATGAATGTCAACAGGCGGAAACCCTCAATTGTGGCTATCACTC ACTCAGCACGAGAAATCCACACAGGCGAAACCCGTATAAATGTAAGGAGTGTGG GAAGGCTTTCATTTATGGATCGAGCCTCGTGA | 6485 |
| | 4 | MGLKPRYS* | ATGGGCTCAAGCCTCGTTATTCATAA | 6487 |
| | 1 | MSIR* | ATGTCAATCAGATGA | 6489 |

| | |
|---|---|
| | 6484 |
| | 6486 |
| | 6488 |
| | 6490 |

Figure 1 (Continued)

| | | | |
|---|---|---|---|
| hsa-mir-518b | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCCTCCTAGAACA CATCAGAGACATTAGTAAGGAGAATTCCTTTGAATGTAAGGACTGTGGAAGGCCTTT AGTCGTGGCTATCAACTTAGTCAACATCAGAAAATCCATACTGGTGAGAAACCTTAT GAATGTAAAGAATGTAAGAAGCCTTCCGTTGGGCAATCAGCTTACTCAACATCAA AAAATTCATACTGGGGAGAAGCCTCGTTATTCATAAGAGATGTAAAGACTGTGGG ATGGGGCTCAAGCTCGTTATTCATAAGAGATTCATACTGGTGAAAAACCTATGA ATGTAAAGACTGTGGAAGGCCTTTCGCGTGGTCAATCAGCTCACTCAGCACCAGA GATTCCACACTGGGGAGAAGACTACGAATGCAAAGACTGTGGGAAGACCTTTAGC CGTGTGTATAAACTTATTCAGCACACAGAGAATTCATAGTAGTGGGGAGAAGCCTTACGA GTGTAAAGACTGTGGGAAGGCTTTTATTTGTGTTCAAGCCTCATTCAGCATAAAG AATTCACACAGGTGAGAACCCTATGAATGTCAAGGATGTGGGAAGGCCTTTACTCG AGTCAATTACCTTACTCAGCATCAGAGATGTCACACCGGTGAGAAGCCTCACGAATG TAAGGAGTGTGGGCGAGAAGCCTACAAGTGCACAGAATGCACAGAGGAATGCACGAGAGGA TACATACGGGCGAGAAGCCTACAAGTGCACAGAATGCACAAGGCGAAACCCGTATAAATGT GGCTATCACCTCACTCAGCACGAGAATCCACACAGGCGAAACCCGTATAAATGT TCATATCCGGGGGTGAAACCTATGGGTGCACAGAATGTGAGGCTTAGTCACG GCCATCAAGCTTACACAACATCCAAGAAACGCACAGTGGGGGCGAAATCTACGAATGT AAGGAGTGCGGGAAGCCATGTAACCTAAACCATCCGAGAACATCAGAGGAT CCAACAGTTGA | 6492 |
| | 3 | MSKIDLLEKAPLLEHRIRRIPLNVRTVGRPLVVAINL VMRKSILVRNLMNVKNVRRPSVGAISLLNIKKPILGRSP TNVKTVGRLFDGAQASLFIRGFILVKNPMNVKTVERPF GVVMSSLSTRDSTLGRKTNAKTVGRPLAVCINLFSTRE PTVGRSLTSVKTVGRLLFVVQASPSIKEFTQVRNPMNYK NVGRPLLLESTTLLSIRRSFPVRSLTNVRSVGRPFAGVRAS LSTRGYIRARSKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTTAGTCGTGCTATC AACTTAGTCAACATCAGAAAATCCATACTGGTGAGAAACCTTATGAATGTAAAGAAT GTAAGAAGCCTTCCGTTACTCAAGGCTTACTCAACATCAAAAAATTCATACTG GGGAGAAGCCCTACGAATGTAAAGACTGTGGGAAGGCTTTCGATGGGGCTCAAGC CTCGTTATTCATAAGAGATTCATACTGGTGAAAAACCTATGAATGTAAAGACTGT GAAAGGCCTTTCGCCGTGTGATGAGCTCACTCAGCACCAGATTCCACACTGG GGGAAAAGACTACGAATGCAAAGACTGTGGGAAGACCTTAGCCGTGTGTATAAAC TTATTCAGCACACAGAGAATTCATAGTGGGAAGAACCTTACGAATGTAAAGACCTTTATAAAC GGGAAGGCTTTTATTTGTGGTTCAAGCCTCGTTAAGCCCTACGAGATACGGGCG GAGAAGCCCTATGAATGTCAAGAATGTGGGAAGACGCTCATTGCATCACACGTG ACTCAGCAGCGTACAAGTGCACAGGCGAAGCCTCACAGGCCTTCAATTAGCATGT GAAGGCCGTACAAGTGCACACAGGGCGAAACCCGTATAAATGGTGCATCCTC ACTCAGCAGCAGAGAATTCATAGTGGGAAGCCTGCTTACTCGAGTGAATGTAAGGAGTGTGG GAAGGCTTTCATTATGGATCAGATGA | 6494 |
| | 4 | MGLKPRYS* | ATGGGGCTCAAGCCTCGTTATTCATAA | 6495 | 6496 |
| | 1 | MSIR* | ATGTCAATCAGATGA | 6497 | 6498 |

Figure 1 (Continued)

| | | | |
|---|---|---|---|
| hsa-mir-518c | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGCTATC AGTCGTGGCTATCAACTTAGTCAACATCAGAAAATTCCATACTGGTGAGAAACCTTAT GAATGTAAAGAATGTAAGAAGCCTTCCGTTCGGCAATCAGCTTACTCAACATCAA AAAATTCATACTGGGGAGAAGCCTCGTTATTCATAAGAGATGTAAAGACTTTTCG ATGGGGCTCAAGCTGTGGAGCTCGTTATTCATAAAGAGATTCATACTGGTGAAAAACCTATGA ATGTAAAGACTGTGGAAGGATTCGGCGTGGTAGAGCTCACTCAGCACCAGA GATTCCACACTGGGGAGAAGATACGAATGCAAAGACTGTGGGAAGACCTTTAGC CGTGTGTATAAACTTATTCAGCACAGAAGAATTCATAGTGGGAGAAGCCTTACGA GTGTAAAGACTGTGGGAAGGCTTTTATTTGTGGTTCAAGCCTCATTCAGCATAAAG AATTCACACAGGTGAGAAACCCTATGAATGTCAAAGATGTGGAAGGCTTTACTCG AGTCAATTACCTTACTCAGCATCAGAAGATCCACACCGGTGAGAAGCCTCACGAATG TAAGGAGTGTGGGCGCGAGAAGCCTTCGAGCCTCGTTAAGCACGAGAGGA TACATACGGGCGAGAAGCCGTACAAGTGCACAGAATGTGGGAAGCCTTCAATTGT GGCTATCACCTTACTCAGCACGAGAGAATCCACACAGGTGAAACCCGTATGAGAGAAT TCATATCCGGGGTGAAACCCTATGGGTGCACAGAATGTGGGAAGACTTTAGTCACG GCCATCAAGCTTACACAACACAGTGAGAAACCGACAGTGGGCGAACATCTACGAATGT AAGGAGTGCGGGAAGCCATGTAACCACCTAAACCATTCCGAGAACATCAGAGGAT CCACAACAGTTGA | 6500 |
| | 3 | MSKDILLEKAPLLEHRDIRRIPLNVRTVGRPLVVAINL VNIRKSILVRNLMNVKNVRRPSVGAISLLNIKKPILGRSP TNVKTVGRLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFTPVRSLTNVRSVGRPFAGVRAS LSTRGYIRARSKTSAQNVGRPSIVAITSLSTRESTQAKFRI NVRSVGRLSFMDRAS* | ATGTCAAAAGACCTGCTACTAGAGAAGGCACCCTCCTAGAACACATCAGAGACATC ATAAGGAGAATTCCTTTGAATGTAAGGACTGTGGGAAGCCTATCAGTCGTGCTATC AACTTAGTCAACATCAGAAAATCCATACTGGTGAGAAACCTTATGAATGTAAAGAAT GTAAGAAGGCCTTCCGTACGAATGTAAAGACTGTGGGAATGAAAAACCTATGAATGTAAAGACTGT GGGAGAAGAAGCCCTACGAATGTAAAGACTGTGGGAAGGCTTTCGATGGGGCTCAAGC CTCGTTATTCATAAGAGATTCATACTGGTGAAAAACCCTATGAATGTAAAGACTGT GGAAAGGCCTTTCGGCGTGATGAAGCTCACTCAGCACCAGAGATTCCACACTGG GGAGAAAGACTACGAATGCAAAGACTGTGGGAAGACCTTAGCGTGTGTATAAAC TTATTCAGCACAGAAGAATTCATAGTGGGAGAAGCCTTACGAGTGTAAAGACT GGGAAGGCTTTTATTTGTGGTTCAAGCCTCATTCAGCATAAAGAATTCACACAGGT GAGAAACCCTATGAATGTCAAGAATGTCAAGAAGGCCTTTACTCGAGTCAATTACCT TACTCAGCACGAGAAGATCCACACCGGTGAGAAGCCTCACGAATGTAAGGAGTGTGG GAAGGCCTTTCGCTGGGGTTCGAGCCTCGTTAAGCACGAGAGGATACATACGGGCG AGAAGCCGTACAAGTGCACAGAATGTGGGAAGCCTTCAATTGTGGCTATCACCTC ACTCAGCACGAGAAGATCCACACAGGTGGGAAACCCGTATATAAATGTAAGGAGTGTGG GAAGGCTTTCATTTATGGATCGAGCCCGTGA | 6502 |
| | 4 | MGLKPRYS* | ATGGGCTCAAGCCTCGTTATTCATAA | 6503 | 6504 |
| 1 | MSIR* | ATGTCAATCAGATGA | 6505 | 6506 |

Figure 1 (Continued)

| | | | | |
|---|---|---|---|---|
| hsa-mir-518d | 2 | MHINYVKRPATREGTPPRTHQRHHKENSPECKDCGKAF SRGYQLSQEHQKIHTGEKPYECKECKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | 6507 | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATGTCCATACTGGTGAGAAACCTTAT GAATGTAAAGAATGTAAGGCCTTCCGTTGGCAATCAGCTTACTGAACATCAA AAAATTCATACTGGGGAGAAGCCTACGAATGTAAAGACTGTGGGAAGGCTTTCG ATGGGGCTCAAGCTCGTTATTCATAAGAGAATTCATACTGGTGAAAAACCTATGA ATGTAAAGACTGTGGGAAGGCCTTTCGGCGTGGTAGCTCACTCAGCACCAGA GATTCCACACTGGGAGAAGATACGAATGCAAAGACTGTGGGAAGACCTTTAGC CGTGTGTATAAACTTATTCAGCACAGAGAATTCATAGTGGGGAGAAGCCTTACGA GTGTAAAGACTGTGGGAAGGCTTTTATTTGTGTTCAAGCCTCATTCAGCATAAAG AATTCACACAGGTGGACAAACCCTATGAATGTCAAAGATGTGGGAAGGCCTTACTCG AGTCAATTACCTTACTCAGCATCAGAGAATCCACACCGGTGAGAAGCCTCACGAATG TAAGGAGTGTGGGAAGGCCTTTCGCTGGGGTTCGAGCCTCGTTAAGCACGAGAGA TACATACGGGCGAGAAGCCTACAAGTGCACAGAATGCAAGAAATCCTCAATTGT GGCTATCACCTCACTCAGCACGAGAATCCACACAGGAGAAACCCGTATAAATGT TCATACCGGGGTGAACCCTATGGGTGTACAGAATGTGGGAAGACTTTAGTCACG GCCATCAAGCTTACACAACACTCAGAAACGCACAGTGGGGCGAAATCTACGAATGT AAGGAGTGCGGGAAGCCATGTAACCACCTAAACCATCTCGAGAACATCAGAGGAT CCACAACAGTTGA |
| | 3 | MSKIDLLEKAPLLEHRIRRIPLNVRTVGRPLVVAINL VMRKSILVRNLMNVKNVRRPSVGAISLLNIKKPILGRSP TNVKTVGRLLFDGAQASLFIRGFILVKNPMNVKTVERPF GVVMSSLSTRDSTLGRKTNAKTVGRPLAVCINLFSTRE PTVGRSLTSVKTVGRLLFVVQASPSIKEFTQVRNPMNYK NVGRPLLESITLLSIBRRSFPVRSLTNVRSVGRPFAGVRAS LSTRGYIRARSKTSAQNVGRPSIVAITSLSTRESTQAKFRI NVRSVGRLSFMDRAS* | 6509 | ATGTCAAAAGACCTGCTACTAGAGGACACCCTCCTAGAACACATCAGAGACATC ATAAGGAGAATTCCTTTGAATGTAAGGACTGTGGGAAGGCCTTTAGTCGTGCTATC AACTTAGTCAACATCAGAAATCTGAATGTGAGAAAATCCATACTGGTGAGAAATGTAAAGAAT GTAAGAAGGCCTTCACTGAAGCCCTACGAATGTAAAGACTGTTCGATGGGGCTCAAGC CTCGTTATTCATAAGAGAATTCATAGACTGTGGTGAAAAACCTATGAATGTAAAGACTGT GGAAAGGCCTTTCGGCCTGTGATGAGCTCACTCAGCACCAGAGATTCCACACTGG GGAGAAAGACTACGAATGCAAAGACTGTGGGAAGACCTTAGCCGTGTATAAAC TTATTCAGCACAGAGAATTCATAGTGGGAGAAGCCTTACGAGTGTAAAGACTGT GGGAAGGCCTTTATTTGTGGTTCAAGAATGTCAAGAATGTGGGAAGCCTCGAGTCAAGGT GAGAACCCTATGAATGTCACAAGATGCACAGGGGAAGCCTTTACTCGCATAAAAGGTT ACTCAGCATCAGAGAATCCACACCGGTGAGAAGCCTCACGAATGTAAGGAGTGTG GAAGGCCTTTCGCTGGGGTTCGAGCCTCGTTAAGCACGAGGATACATACGGGCG GAGAAGCCGTACAAGTGCACAGAATCCACACAGGCGGAAACCCGTATATCACCTC ACTCAGCACGAGAATCCACACAGGCGGAAACCCGTATAAATGTTCGATCAATGTTCAC GAAGGCTTTCATTTATGGATCGAGCCCGTGA |
| | 4 | MGLKPRYS* | 6511 | ATGGGGCTCAAGCCTCGTTATTCATAA |
| | 1 | MSIR* | 6513 | ATGTCAATCAGATGA |

Figure 1 (Continued)

| | | | |
|---|---|---|---|
| hsa-mir-518e | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRHQLTQHQKTHSGAKSYECKEC GKACNHLNHLREHQRIHNS* | 6515 | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGGAAGGCCTTT AGTCGTGGCTATCAACTTAGTCAACATCAGAAATTCCATACTGGTGAGAAACCTTAT GAATGTAAAGAATGTAAGAAGGCCTTCCGTTGGGCAATCAGCTTACTCAACATCAA AAAATTCATACTGGGGAGAAGCCTACTAAAGACTGTAAAGACTGTGGGAAGGCTTTTCG ATGGGCTCAAGCTCGTTATTCATAAGAGAATTCATACTGGTGAAAAACCTATGA ATGTAAAGACTGTGGGAAGGCCTTTCGCGTGGTAAGCTCACTCAGCACCAGA GATTCCACACTGGGGAGAAGACTACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTTATTTGTGGTTCAAGCCTCATTCAGCATAAAG AATTCACACAGGTGAGAAATGCAAACCCTATGAATGTCAAAGAATGTGGGAAGGCCTTTACTCG AGTCAATTACCTTACTCAGCATCAGAGAATGCACAGAAATGGGGAAGCCTCACGAATG TAAGGAGTGTGGGAGCCTACAAGGCCTTTCGAGCTGTTCAGCGTTTAAGCACGAGAGA TACATACGGGCGAGAAGCCTACAAGTGCACAGAATGGCAGGGAAGCCTTCAATTGT GGCTATCACCTCACTCAGCACGAGAATCCACACAGGTGAGAACCCGTATAAATGT AAGGAGTGTGGGAAGCTTTCATTTATGGATCGAGCCTCGTGAACATGAGAGAT TCATACCGGGGTGACAACCCTATGGGTGTACAGAAATGTGGGAAGAGCTTTAGTCACG GCCATCAAGCTTACACAACATCAGAAAACCGACAGTGGGGCGAAATCTACGAATGT AAGGAGTGCGGGAAGCCATGTAACCACCTAAACCAITCCGAGAACATCAGAGGAAT CCACAACAGTTGA |
| | 3 | MSKIDLLEKAPLLEHRDIRRRIPLNVRTVGRPLVVAINL VMRKSILVRNLMNVKNVRRPSVGAISLLNIKKFILGRSP TNVKTVGRLFDGAQASLFIRGFILVKNPMNVKTVERPF GVVMSSLSTRDSTLGRKTNAKTVGRPLAVCINLFSTRE PIVGRSLTSVTSVKTVGRLLFVVQASPSIKEFTQVRNPMNYK NVGRPLLESITLLSIRRSFPVRSLTNVRSVGRPFAGVRAS LSTRGYIRARSRKTSAQNVGRPSIVAIITSLSTRESTQAKFRI NVRSVGRLSFMDRAS* | 6517 | ATGTCAAAAGACCTGCTACTAGAGGACACCCCTCCTAGAACACATCAGAGACATC ATAAGGAGAATTCCTTTGAATGTAAGGACTGTGGGAAGGCCTTTAGTCGTGGCTATC AACTTAGTCAACATCAGAAATTCATACTGGTGAGAAGCCTTATGAATGTAAAGAAT GTAAGAAGGCCTTCACTCAGAATCAGCTTACTCAACATCAAAAAATTCATACTG GGGAGAAGCCCTACTAAAGACTGTAAAGATGTGGGAAGGCTTTTCGATGGGCTCAAGC CTCGTTATTCATAAGAGAATTCATACTGGTGAAAAAACCTATGAATGTAAAGACTGT GGGAAAGGCCTTTCGCCGTTACGAATGCAAAGACTGTGGGAAGACCTTTAGCCGTGTGTATAAAC TTATTCAGCACACTACGAATGCAAAGACTGTGGGAAGACCTTACGAGTGTAAAGACTGT GGGAAGGCTTTATTTGTGGTTCAAGCATCAGCATAAAGAATTCACACAGGT GAGAAACCCTATGAATGTCAAGAATGTGGGAAGCCTCTGATCGTTAAGGAGTGTGG GAAGGCCTTCACGGTACGAGAATCACACAGGTGAGAAGCCTCGTTAAGCACGAGGATACATGGCG ACTCAGCAGCGTACAAGTGCACAGAATGTGGGAAGGCCTTCAATTGTGGCTATCCTC ACTCAGCACGAGAATCCACACAGGTGGGAAACCCGTATAAATGTAAGGAGTGTGG GAAGGCTTTCATTTATGGATCGAGCCTCGTGA | 6518 |
| | 4 | MGLKPRYS* | 6519 | ATGGGCTCAAGCCTCGTTATTCATAA | 6520 |
| | 1 | MSIR* | 6521 | ATGTCAATCAGATGA | 6522 |

Figure 1 (Continued)

| | | | |
|---|---|---|---|
| hsa-mir-518f | 2 | MHNYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGCTGTATC AGTCGTGGCTATCAACTTAGTCAACATCAGAAATCCATACTGGTGAGAAACCTTAT GAATGTAAAGAATGTAAGAAGGCCTTCCGTTGGGCAATCAGCTTACTCAACATCAA AAAATTCATACTGGGGAGAAGCCTTCTATTCATAAGAGAATTCATACTGGTGAAAAACCTATGA ATGTGGGCTCAAGCTCGTTATTCATAAGAGAATTCATACTGGTGAAAAACCTATGA ATGTAAAGACTGTGGAAAGGCCTTTCCGCGTGGTCAGTGAGCTCACTCAGCACCAGA GATTCCACACTGGGGAGAAGACTACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTTATTTGTGTTCAAGCCTCATTCAGCATAAAG AATTCACACAGGTGAGAAATGCAAAACCCTATGAATGTCAAAGAGTGTGGAAGGCCTTTACTCG AGTCAATTACCTTACTCAGCATCAGAGAATGTCACACCGGTGAGAAGCCTCACGAATG TAAGGAGTGTGGGAGAAGGCCTTTCGCTGGGGTTCGAGCCTTCAAGCACGAGAGGA TACATACGGGCGAGAAGCCGTACAAGTGCACAGAATGTGGGAAGGCTTCAATTGT GGCTATCACCTCACTCAGCACGAGAAGCCACACAGGCGAAACCCGTATAAATGT TCATATCCGGGGGTGAAACCTATAGGGTGTACAGAAGTGTGGGAAGGCTTTAGTCACG GCCATCAAGCTTACACAACATCCAGAAACGCACAGTGGGGCGAAATCTACGAATGT AAGGAGTGCGGGAAGCCATGTAACCTAAACCATCTCCGAGAACATCAGAGGAT CCACAACAGTTGA | 6524 |
| | 3 | MSKDILLEKAPLLEHRDIRRIPLNVRTVGRPLVVAINL VMRKSILVRNLMNVKNVRRPSVGAISLLNIKKFILGRSP TNVKTVGRLFEDGAQASLFIRGFILVKNPMNVKTVERPF GVVMSSLSTRDSTLGRKTTNAKTVGRPLAVCINLFSTRE PTVGRSLTSVTSKTVGRLLFVVQASPSIKEFTQVRNPMNYK NVGRPFLLESITLLSIRRSFPVRSLTNVRSVGRPFAGVRAS LSTRGYIRARSRKTSAQNVGRPSIVAIITSLSTRESTQAKFRJ NVRSVGRLSFMDRAS* | ATGTCAAAAGACCTGCTACTAGAGAAGGCACCCTCCTAGAACACATCAGAGACATC ATAAGGAGAATTCCTTTGAATGTAAGGACTGTGGGAAGCCATTTAGTCGTGCTATC AACTTAGTCAACATCAGAAATCCATACTGGTGAGAAGCCTTATGAATGTAAAGAAT GTAAGAAGGCCTTCCGTTACTCAGCTTACTCAACATCAAAAATTCATACTG GGGAGAAGCCCTACGAATGTAAAGACTGTGGGAAGGCTTTCGATGGGGCTCAAGC CTCGTTATTCATAAGAGGATTCATACTGGTGAAAAACCTATGAATGTAAAGACTGT GGAAAAGGCCTTTACGCCTTTCGGCGTGATGAGCTCACTCAGCACCAGAGATTCCACACTGG GGAGAAGACTACGAATGCAAAGACTGTGGGAAGACCTTTAGCCGTGTGTATAAAC TTATTCAGCACACAAGAGAATTCATAGTGGGGAGAAGCCTTACGAGTGTAAAGCT GGGAAGGCCTTTATTTGTGGTTCAAGCCTCGTTAAGCCTCGTTAAGCCTCTTGAAGGAGGCTTGATATT ACTCAGCATCAGAGAATCCACACCGGTGAGAAGCCTCAGCATAAAGAATTCACACGGT GAAGGCCTTTCGCTGGGGTTCGAGCCTGTTAAGCACGAGAGGATACATACGGGCG ACAAGCCGTACAAGTGCACAGAATGTGGGAAGGCCTTCAATTGTGGCTATCACCTC ACTCAGCACGAGAAGCCACACAGGCGAAACCCGTATAAATGTAAGGAGTGTGG GAAGGCTTTCATTTATGGATCGAGCCGTCGTGA | 6526 |
| | 4 | MGLKPRYS* | ATGGGCTCAAGCCTCGTTATTCATAA | 6527 |
| | 1 | MSIR* | ATGTCAATCAGATGA | 6529 |
| | | | 6528 |
| | | | 6530 |

Figure 1 (Continued)

| | | | |
|---|---|---|---|
| hsa-mir-519a-1 | 2 | MHNYVKRPATREGTPPRTHQRHHKENSPECKDCGKAF SRGYQLSQEHQKIHTGEKPYECKECKKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGTACTAGAGAAGGCACCCTCCTAGAACA CATCAGAGACATCATAAGGAGAATTCCTTTGAATGTAAGGACTGTGGCTGTATC AGTCGTGGCTATCAACTTAGTCAACATCAGAAAATCCATACTGGTGAGAAACCTTAT GAATGTAAAGAATGTAAGAAGGCCTTCCGTTGGGCAATCAGCTTACTCAACATCAA AAATTCATACTGGGGAGAAGCCTGTATTCATAAGAGAATTCATACTGGTGAAAACCTATGA ATGTAAAGACTGTGGGAGACTGTGTGGCCGTGGCAATCAGCTCACTCAGCACCAGA GATTCCACACTGGGGAGAAGATACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTCATTTGTGGTTCAAGCCTCATTCAGCATAAAG AATTCACACAGGTGAGAAACCCTATGAATGTCAAAGAATGTGGGAAGGCCTTTACTCG AGTCAATTACCTTACTCAGCATCAGAGAATCCACACGGTGAGAAGCCTCACGAATG TAAGGAGTGTGGGAGCTGTGGGAGAAGCCGTACAAGTGCACAGAATGCGGGAAGGCCTCGTTAAGCACGAGAGGA TACATACGGGCGAGAAGCCGTACAAGTGCACAGAATGGGGAAGGCCTCGTTAAGCACGAGAGGA GGCTATCACCTCACTCAGCACGAGAAGCCACACAGGTGAAACCGTATGAGAGAAT TCATACCGGGGTGAAACCTATGGGTGTACAGAATGTGGGAAGGCTTAGTCACG GCCATCAGCTTACACAACACACAGAAAACCAGTGGGGCGAAATCCTACGAATGT AAGGAGTGCGGGAAGCATGTAACCACCTAAACCATTCCGAGAACATCAGAGGAT CCACAACAGTTGA | 6532 |
| | | | 6531 |
| | 3 | MSKDILLEKAPLLEHRDIRRIPLNVRTVGRPLVVAINL VMRKSILVRNLMNVKNVRRPSVGAISLLNIKKPILGRSP TNVKTVGRLFDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIRARSRKTSAQNVGRPSIVAITSLSTRESTQAKFRI NVRSVGRLSFMDRAS* | ATGTCAAAAGACCTGCTACTAGAGAAGGCACCCTCCTAGAACACATCAGAGACATC ATAAGGAGAATTCCTTTGAATGTAAGGACTGTGGGAAGGCCTTAGTCGTGGCTATC AACTTAGTCAACATCAGAAAATCCATACTGGTGAGAATGTAAGAACTTATAAAGAAT GTAAGAAGGCCTTCCGTTACTCAGCTTACTCAACATCAAAAATTCATACTG GGGAGAAGCCGCCTACGAATGTAAAGACTGTGGGAAGGCTTTCGATGGGGCTCAAGC CTCGTTATTCATAAGAGGATTCATACTGGTGAAAAACCTATGAATGTAAAGACTGT GGAAAGGCCTTTCGGCCTGTGATGAGCTACTCAGCACCAGAGACCTTCACACTGG GGAGAAAGACTACGAATGCAAAGACTGTGGGAAGACCTTAGCCGTGTGTATAAAC TTATTCAGCACACAAGAGAATTCATAGTGGGGAGAAGCCTTACGAGTGTAAAGACT GGGAAGGCCTTTATTTTGTGGTTCAAGCCTCATTCAGCATAAAGAATTCACACAGGT GAGAAACCCTATGAATGTCAAGAATGTGGGAAGGCCTTTACTCGAGTCAATTACCT ACTCAGCATCAGAGAATCCACACGGTGAGAAGCCTCACGAATGTAAGGAGTGTG GAAGGCCTTTCGCTGGGGTTCGAGCCTCGTTAAGCACGAGAGGATACATACGGGCG ACTCAGCGAGGTACAAGCTCACACAGGGCGAAACCGTCAATTGTGGCTATCACCTC GAAGGCTTTCATTTATGGATCGAGCCCTCGTGA | 6534 |
| | | | 6533 |
| | 4 | MGLKPRYS* | ATgGGCTCAAGCCTCGTTATTCATAA | 6535 |
| | | | 6536 |
| | 1 | MSIR* | ATGTCAATCAGATGA | 6537 |
| | | | 6538 |

Figure 1 (Continued)

| | | | |
|---|---|---|---|
| hsa-mir-519a-2 | 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGGAAGCCTTT AGTCGTGGCTATCAACTTAGTCAACATCAGAAAATCCATACTGGTGAGAAACCTTAT GAATGTAAAGAATGTAAGAAGCCTTCCGTTGGGCAATCAGCTTACTCAACATCAA AAAATTCATACTGGGGAGAAGCCTCGTTATTCATAAGAGATGTAAAGACTGTGGGA ATGGGCTCAAGCACTGTGGAGCTCGTTATTCATAAGAGATTCATACTGGTGAAAAACCCTATGA ATGTAAAGACTGTGGGAGAAGCCTTTCGCGTGGTAGCTCACTCAGCACCAGA GATTCCACACTGTGGGAGGAAAGATACGAATGCAAAGACTGTGGGAAGACCTTAGC CGTGTGTATAAACTTATTCAGCACACAAGAGAATTCATAGTGGGGAGAAGCCTTACGA GTCTAAAGACTGTGGGAAGGCTTTTATTTGTGGTTCAAGCCTCATTCAGCATAAAG AATTCACACAGGTGAGAAGACCCTATGAATGTCAAAGATGTGGGAAGCCTTTACTCG AGTCAATTACCTTACTCAGCATCAGAGATGTCACACCGGTGAGAAGCCTCACGAATG TAAGGAGTGTGGGAGCGGAGAAGCCTTCGCTGGGGTTCGAGCCTCGTTAAGCACGAGGA TACATACGGGCGAGAAGCCTACAAGTGCACAGAATGCAAAATCCACACAGGCGAAAACCCGTATAAATGT GGCTATCACCTCACTCAGCACGAGAGAATCCACACAGGCGAAAACCCGTATGAGAGAAT TCATATACCGGGGTGAACCTATGGGTGTACAGAATGTGGGAAGACTTAAGTCACG GCCATCAAGCTTACACAACACGAGAAACGCACAGTGGGGCGAAATCCTACGAATGT AAGGAGTGCGGGAAGCATGTAACCACCTAAACCATCTCCGAGAACATCAGAGGAT CCACAACAGTTGA | 6539 6540 |
| | 3 | MSKDLLLEKAPLLEHRDIRRIPLNVRTVGRPLVVAINL VNRKSILVRNLMNVKNVRRPSVGAISLLNIKKPILGRSP TNVKTVGRLFEDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIBARSRKTSAQNVGRPSIVAIITSLSTRESTQAKFRI NVRSVGRLSFMDRAS* | ATGTCAAAAGACCTGCTACTAGAGGACCATCGAGAAGGCACCGCTGGGAAGCCTCTAGAACACATCAGAGACATCAGAGACATC ATAAGGAGAATTCCTTTGAATGTAAGGACTGTGGGAAGCCTTTAGTCGTGCTATC AACTTAGTCAACATCAGAAAATCCATACTGGTGAGAAACCCTTATGAATGTAAAGAAT GTAAGAAGCCTTCCGTTGGGCAATCAGCTTACTCAACATCAAAAAATTCATACTG GGGAGAAGCCTCGTTATTCATAAGAGACTGTAAAGGCTTTCGATGGGGCTCAAGC CTCGTTATTCATAAGAGACTGTAAAGACTGGAAAAACCCTATGAATGTAAAGACTGT GGAAAAGGCCTTTATTCGGCGTGATGAGCTCACTCAGCACCAGAGAGATTCCACACTGG GGAGAAAGACTACGAATGCAAAGACTGTGGGAAGAACCTTAGCCGTGTGTATAAAC TTATTCAGCACACAAGAGAATTCATAGTGGGAGAAGCCTTCAGCTGATAAAGAAGG GGGAAGGCCTTTCTGGGTTCAAGCCTCGTTAAGCACGAGGAGAGATACATACGGGGCG GAGAAGCCTATGAATGTCAAGGCCTTACGAGATGGGGAAGCCTTTACTCGAGTCAATTACCT ACTCAGCACGAGAGAATCCACACAGGCGAAGCCTTAAGCACGAGGAGATACATACGGGGCG GAAGGCCTTTCGCTGGGGTCAAGCACCGGGTTGAGCCTCGTTAAGCACGAGGATATACGGGCG GAAGGCCGTACAAGTGCACAGAATGTGGGAAGCCTTCAATTGTGGCTATCACCTC ACTCAGCACGAGAGAATCCACACAGGCGAAACCCCGTATAAATGTAAGGAGTGTGG GAAGGCTTTCATTTATGGATCGAGCCCGTGA | 6541 6542 |
| | 4 | MGLKPRYS* | ATEKGGCTCAAGCCTCGTTATTCATAA | 6543 6544 |
| | 1 | MSIR* | ATGTCAATCAGATGA | 6545 6546 |

Figure 1 (Continued)

| | | | |
|---|---|---|---|
| hsa-mir-519b | 2 | MHINYVKRPATREGTPPRTHQRHHKENSPECKDCGKAF SRGYQLSQHQKIHTGEKPYECKECKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAAATCCATACTGGTGAGAAACCTAT GAATGTAAAGAATGTAAAGAAGGCCTTCCGTTGGGCAATCAGCTTACTCAACATCAA AAAATTCATACTGGGGAGAAGCCTTCGTTATTCATAAGAGATCTATACTGGTGAAAAACCTATGA ATGGGGCTCAAGCTGTGGAAGCTCGTTATTCATAAGAGATTCATACTGGTGAAAAACCTATGA ATGTAAAGACTGTGGAAGGACTTTCCGCCGTGGTGATGAGCTCACTCAGCACCAGA GATTCCACACTGGGGAGAAGACTACGAATGCAAAGACTGTGGGAAGACCTTAGC CGTGTGTATAAACTTATTCAGCACACAAGAGAATTCATAGTGGGGAGAAGCCTTACGA GTGTAAAGACTGTGGGAAGGCTTTTATTTGTGGTTCAAGCCTCATTCAGCATAAAG AATTCACACAGGTGAGAAATGCAAACCCTATGAATGTCAAAGAATGTGGGAAGGCCTTTACTCG AGTCAATTACCTTACTCAGCATCAGAGATCTACACGGTGAGAAGCCTCACGAATG TAAGGAGTGTGGGCGGAGAAGCCTACAAGTGCACAGAATGCGGGGAAGCCTTCAATTGT TACATACGGGCGAGAAGCCTACAAGTGCACAGAATGCACACCCCGCGTATAAATGT GGCTATCACCTTACTCAGCACGAGAATCCACACAGGCGAAACCCGTATAAATGT TCATACCGGGGTGAAACCCTATGGGTACAGAATGTGGGAAGGCTTTAGTCACG GCCATCAAGCTTACACAACACAGAAAACCACAGTGGGGCGAAATCTACGAATGT AAGGAGTGCGGGAAGCCATGTAACCATCCACCTAAACCATCCGAGAACATCAGAGGAAT CCAACAGTTGA | 6548 |
| | 3 | MSKDLLEKAPLLEHRIDRRFLPNLVRTVGRPLVVAINL VNRKSLVRNLMNVKNVRRPSVGAISLLNIKKFILGRSP TNVKTVGRLFEDGAQASLFIRGFILVKNPMNVKTVERPF GVVMSSLSTRDSTLGRKTTNAKTVGRPLAVCINLFSTRE PIVGRSLTSVTVGRLLFVVQASPSIKEFTQVRNPMNYK NVGRPLLESITLLSIRRSFPVRSLTNVRSVGRPFAGVRAS LSTRGYIRARSKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTTAGTCGTGGCTATC AACTTAGTCAACATCAGAAAATCCATACTGGTGAGAAGCCTTATGAATGTAAAGAAT GTAAGAAGGCCTTCACTCAGCTTACTCAACATCAAAAAATTCATACTG GGGAGAAGCCTTATTCATAAGAGACTGTGGAAGGCTTTCGATGGGGCTCAAGC CTCGTTATTCATAAGAGATTCATACTGGTGAAAAACCCTATGAATGTAAAGACTGT GTAAAGAAGACTACGAATGCAAAGACGTGGAAGACGCTTACGAGGATTCCACACTGG GGAAAAGACTACGAATGCAAAGACGTGGGAAGACCTTTAGCCGTGTGTATAAAC TTATTCAGCACAGATACGAATGCAAAGACGTGGGAAGACCTTACGAGTGTATAAAC GGGAAGGCCTTTACTCGAGTCAATCAGCCTTCAGCATAAAGAATTCACACAGGT GAGAAACCCTATGAATGTCAAGATTCAAGCATAAAGAATTCACACAGGTGTGTGG ACTCAGCAGCAGAGATCCACACCGGTGAGAAGCCTCAGAATGTAAGGAGTGTGG GAAGGCCCTTCGCTGGGGTTCGAGCCTCGTTAAGCACGAGGATACATACGGGCG GAAGCCGTACAAGTGCACAGAATGTGGGAAGCCTTCAATTGTGGCTATCACCTC ACTCAGCAGCAGAGAATCCACACAGGCGAAACCCGTATAAATGTAAGGAGTGTGG GAAGCCCTTCATTTATGGATCGAGCCTCGTGA | 6550 |
| | 4 | MGLKPRYS* | ATGGGCTCAAGCCTCGTTATTCATAA | 6551 |
| | 1 | MSIR* | ATGTCAATCAGATGA | 6553 |

| | | | | |
|---|---|---|---|---|
| hsa-mir-519c | 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | 6555 | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAAATCCATACTGGTGAGAAACCTTAT GAATGTAAAGAATGTAAGAAGGCCTTCCGTTGGGCAATCAGCTTACTCAACATCAA AAAATTCATACTGGGGAGAAGCCTACTAGAAGACTGTAAAGACTTTTCG ATGGGCTCAAGCTGTGGAAGCTCGTTATTCATAAGAGATTCATACTGGTGAAAAACCTATGA ATGTAAAGACTGTGGAAGCTTTCGGCGTGGTAACGAATCAGCTCACTCAGCACCAGA GATTCCACACTGGGGAGAAGACTACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTTATTTGGTTCAAGCCTCATTCAGCATAAAG AATTCACACAGGTGAGAAACCCTATGAATGTCAAAGATGTGGGAAGGCCTTTACTCG AGTCAATTACCTTACTCAGCACTACAGAGATCCACACCGGTGAGAAGCCTCACGAATG TAAGGAGTGTGGGAGCCGAGAAGCCTACAAGTGCACAGAATGCAGGGAAGCCTTCAATTGT TACATACGGGCGAGAAGCCCTACAAGTGCACAGAATGCACACGGTGAAACCCTCAATTGT GGCTATCACCTACTCAGCACGAGAATCCACACAGGCGAAACCCGTATAAATGT TCATACCGGGGTGAAACCCTATGGGTGTACAGAATGTGGGAAGAGCTTAGTCACG GCCATCAAGCTTACACAAACAACCACAGTGGGGCGAAATCCGAGAATGT AAGGAGTGCGGGAAGCCATGTAACCACCTAAACCATCCGAGAACATCAGAGGAT CCACAACAGTTGA | 6556 |
| | 3 | MSKDLLEKAPLLEHRDIRRRIPLNVRTVGRPLVVAINL VNRKSILVRNLMNVKNVRRPSVGAISLLNIKKPILGRSP TNVKTVGRLFDGAQASLFIRGFILVKNPMNVKTVERPF GVVMSSLSTRDSTLGRKTTNAKTVGRPLAVCINLFSTRE PTVGRSLTSVKTVGRLLFVVQASPSIKEFTQVRNPMNYK NVGRPLLESITLLSIRRSFPVRSLTNVRSVGRPFAGVRAS LSTRGYIBARSKTSAQNVGRPSIVAITSLSTRESTQAKFRI NVRSVGRLSFMDRAS* | 6557 | ATGTCAAAAGACCTGCTACTAGAGAAGGCACCCCTCCTAGAACACATCAGAGACATC ATAAGGAGAATTCCTTTGAATGTAAGGACTGTGGGAAGCCTTAGTCGTGGCTATC AACTTAGTCAACATCAGAAAATCCATACTGGTGAGAAACCTTATGAATGTAAAGAAT GTAAGAAGGCCTTCAATCAGCTTACTCAACATCAAAAAATTCATACTG GGGAGAAGCCTACTAGAAGACTGTGGGAAGGCTTTCGATGGGGCTCAAGC CTCGTTATTCATAAGAGATTCATACTGGTGAAAAACCTATGAATGTAAAGACTGT GGAAAGGCCTTTCGGCGTGATGAGCTCACTCAGCACCAGAGATTCCACACTGG GGAGAAAGACTACGAATGCAAAGACTGTGGGAAGACCTTAGCCGTGTGTATAAAC TTATTCAGCACACAAGAGAATTCATAGTGGGAGAAGCCTACGAGTGTAAAGACTGT GGGAAGGCTTTTATTTGGTTCAAGCCTCATTCAGCATAAAGAATTCACACACGGT GAGAAACCCTATGAATGTCAAGAATGTGGGAAGCCTTTACTCGAGTCAATTACCTTAC TCAGCACGAGAATCCACACCGGTGAGAAGCCTCACGAATGTAAGGAGTGTGGG ACTCAGCAGCGTGGAGCCTGAGCCTGTTAAGCACGAGGATACATACGGGCG GAAGCGTACAAGTGCACAGAATGTGGGAAGCCTTCAATTGTGGCTATCACCTC GAAGGCTTTCATTTATGGATCGAGCCCGTGA | 6558 |
| | 4 | MGLKPRYS* | 6559 | ATGGGGCTCAAGCCTCGTTATTCATAA | 6560 |
| | 1 | MSIR* | 6561 | ATGTCAATCAGATGA | 6562 |

Figure 1 (Continued)

| | | | |
|---|---|---|---|
| hsa-mir-519d | 2 | MHINYVKRPATREGTPPRTHQRHHKENSPECKDCGKAF SRGYQLSQEHQKIHTGEKPYECKECKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATTCCATACTGGTGAGAAACCTTAT GAATGTAAAGAATGTAAGGAAGCCTTCCGTTGGGCAATCAGCTTACTCAACATCAA AAAATTCATACTGGGGAGAAGCCTGTATTCATAAAGAGATCATACTGGTGAAAAACCTATGA ATGGGGCTCAAGCACTGTGTGAAAGACTTCGGCGTGGTAGAGCTCACTCAGCACCAGA ATGTAAAGACTGTGGGAGAAGCCTTTCGGCCGTGGTCAACTCAGCACCAGCAGA GATTCCACACTGGGGAGAAAGATACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTTATTTGTGGTTCAAGCCTCATTCAGCATAAAG AATTCACACAGGTGAGAAGCCCTATGAATGTCAAAGATGTGGGAAGGCTTTACTCG AGTCAATTACCTTACTCAGCATCAGAGATGTCACACCGGTGAGAAGCCTCACGAATG TAAGGAGTGTGGGGGACCTCACTCAGCACCGAGAAGCCGTACACAAGCGGAAATGCACACAGGAGAATGCACACAGGAGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGGAAAATGCCACAAGCGG CCACAACAGTTGA | 6564 |
| | | MSKDLLEKAPLLEHRDRRRIPLNVRTVGRPLVVAINL VNRKSILVRNLMNVKNVRRPSVGAISLLNIKKPILGRSP TNVKTVGRLFEDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESTTLLSIRRSFPVRSLTNVRSVGRPFAGVRAS LSTRGYIBARSKTSAQNVGRPSIVAITSLSTRESTQAKFRI NVRSVGRLSFMDRAS* | ATGTCAAAAGACCTGCTACTAGAGGATAAGGCACCCCTCCTAGAACATCAGAGACATC ATAAGGAGAATTCCTTTGAATGTAAGGACTGTGGGAAGGCCTTTAGTCGTGGCTATC AACTTAGTCAACATCAGAAATTCATACTGGTGAGAAACCTTATGAATGTAAAGAAT GTAAGAAGGCCTTCCGTACGAATGTAAAGACTGTGGGAAGGCTTTTCGATGGGGCTCAAGC CTCGTTATTCATAAGAGGATTCATACTGGTGAAAAACCTATGAATGTAAAGACTGT GGAAAGGCCTTTCGGCCGTGGTGGATGAGCTCACTCAGCACCAGCACGATTCCACACTGG GGAGAAAGACTACGAATGCAAAGACTGTGGGAAGACCTTAGCCGTGTGTATAAAC TTATTCAGCACACAAGAGAATTCATAGTGGGAGAAGCCTTACGAGTGTAAAGACT GGGAAGGCTTTTATTGTGGTTCAAGCCTCATTCAGCATAAAGAATTCACACAGGT GAGAAGCCGTACAAGTGCACAGAATGTGGGAAGGCCTTCAATTGTGGCTATCACGTT ACTCAGCACGAGAGAATCCACACAGGCGAAAAACCCGTATAAATGTAAGGAGTGTGG GAAGGCTTTCATTTATGGATCGAGCCGTGA | 6566 |
| | 4 | MGLKPRYS* | ATEKGGCTCAAGCCTCGTTATTCATAA | 6568 |
| | 1 | MSIR* | ATGTCAATCAGATGA | 6570 |

Figure 1 (Continued)

| | | | |
|---|---|---|---|
| hsa-mir-519e | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGCTGTATC AGTCGTGGCTATCAACTTAGTCAACATCAGAAATCCATACTGGTGAGAAACCTTAT GAATGTAAAGAATGTAAGGAAGCCTTCCGTTGGGCAATCAGCTTACTCAACATCAA AAAATTCATACTGGGGAGAAGCCTCGTTATTCATAAGGAATTCATACTGGTGAAAAACCTATGA ATGGGGCTCAAGCACTGTGGAAGACTGTGGAGCTCACTCAGCACCAGA ATGTAAAGACTGTGGAGAAGGCCTTTCGCGTCGTCCGTTGATGAGCTCACTCAGCACCAGA GATTCCACACTGGGGAGAAGACTACGAATGCAAAGACTGTGGAAGACCTTTAGC CGTGTGTATAAACTTATTCAGCACACAAGAGAATTCATAGTGGGGAGAAGCCTTACGA CGTGTAAAGACTGTGGAGAAGGCTTTTATTTGGTTCAAGCCTCATTCAGCATAAAG AATTCACACAGGTGAGAAACCCTATGAATGTCAAAGAATGTGGAAGGCTTTACTCG AGTCAATTACCTTACTCAGCATCAGAGATGTCACACCGGTGAGAAGCCTCACGAATG TAAGGAGTGTGGGCGACGAAGCCTACACGAGAGAATCCACACAGGTGAGAGGA TACATACGGGCGAGAAGCCGACAAGTGCACAGAATGGCACAGCCTTCAATTGT GGCTATCACCTCACTCAGCACGAGAATCCACACAGGCGAAACCCGTATGAGAGAAT TCATATACGGGGTGAAACCCTATGGGTGCAGAATGTGAGCCTCGTGAAACATGAGCTTAGTCACG GCCATCAAGCTTACACAACACCTAGAGAACCCAGAGTGGGGCGAAAGTTGGGGGCAATGT AAGGAGTGCGGGAAGCATGTAACCTAAACCATCCGAGAACATCAGAGGAT CCACAACAGTTGA | 6572 |
| | | | 6571 |
| | 3 | MSKIDLLEKAPLLEHRIDRRIPLNVRTVGRPLVVAINL VNIRKSLVRNLMNVKNVRRPSVGAISLLNIKKPILGRSP TNVKTVGRLFEDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPFLLESTLLSIRRSFPVRSLTNVRSVGRPFAGVRAS LSTRGYIBARSKTSAQNVGRPSIVAIITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGCCTGGCTATCAGTCGTGCTATC AACTTAGTCAACATCAGAAATCCATACTGGTGAGAAACCTTATGAATGTAAAGAAT GTAAGAAGGCCTTCCGTAGCAATCAGCTTACTCAACATCAAAAAATTCATACTG GGAGAGAAGCCTACGAATGTAAAGAACTGTAAGGAAGGCTTTCGATGGGCTCAAGC CTCGTTATTCATAAGGAGAATTCATACTGGTGAAAAACCTATGAATGTAAAGACTGT GAAAAGGCCTTTCGGCCTGGTGATGAGCTCACTCAGCACCAGAGATTCCACACTGG GAGAAAGACTACGAATGCAAAGACTGTGGAAGACCTTAGCGCTGTGTATAAAC TTATTCAGCACACAAGAATTCATAGTGGGGAGAAGACCTTACGAATGTAAAAGAT GGGAAGGCTTTTATTTGGTTCAAGCCTCGGTTCAAGAATGTGGGAAGGCTTACTCG GAGAAACCCATGAATGTAAGTCAAGAATCCACACAGGTGGGAGAAGCCGTTAAGC ACTCAGCATCAGAGAATCCACACAGGTGAGAAGCCTCACGAATGTAAGGAGTGTGG GAAGGCCTTTCGCTGGGTTCGAGCCTCGGTTAAGCACGAGGATACATACGGGCG AGAAGCCGTACAAGTGCACAGAATGGCGGAACCCGGGAAGCCACGTTAGGTCGCGC CTCAGCACGACGAGAATCCACACAGGCGGAATAAGAGCCTCAATTGTGGCTATCACCTC AAGGCTTCATTATGGATCGAGCCGCGTGA | 6574 |
| | | | 6573 |
| | 4 | MGLKPRYS* | ATGGGGCTCAAGCCTCGTTATTCATAA | 6575 |
| | 1 | MSIR* | ATGTCAATCAGATGA | 6577 |
| | | | 6576 |
| | | | 6578 |

Figure 1 (Continued)

| | | | | |
|---|---|---|---|---|
| hsa-mir-520a | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYECKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGCTGCTTT AGTCGTGGCTATCAACTTAGTCAACATCAGAAATCCATACTGGTGAGAAACCTAT GAATGTAAAGAATGTAAGAAGCCTTCCGTTGGCAATGACTCAGCTTACTCAACATCAA AAAATTCATACTGGGGAGAAGCCTCGTTATTCATAAGAGATCTATACTGGTGAAAAACCTATGA ATGGGGCTCAAGCACTGTGGAGAGCTGTGGGAGAATGACTATACTGGTGATGAGCTCACTCAGCACCAGA GATTCCACACTGGGGAGAAAGACTACGAATGCAAAGACTGTGGGAAGACCTTTAGC CGTGTGTATAAACTTATTCAGCACACAAGAGAATTCATAGTGGGGAGAAGCCTTACGA CGTGTAAAGACTGTGGGAAGGCTTTTATTTGTGGTTCAAGCCTCATTCAGCATAAAG AATTCACACAGGTGAAGAAACCCTATGAATGTCAAGATGTGGGAAGGCCTTTACTCG AGTCAATTACCTTACTCAGCATCAGAGATCCACACCGGTGAGAAGCCTCACGAATG TAAGGAGTGTGGGAGAAGCCTACAAGTGCACAGAATGCGAAGCCTCGTTAAGCACGAGAGGA TACATACGGGCGAGAAGCCGTATCAGAGAATGTGGGAAGCCTTCAATTGT GGCTATCACCTCACTCAGCACGAGAATCCACACAGGGGAAACCCGTATAAATGT TCATATCCGGGGTGAAACCTATGGGTGTACAGAATGTGGGAAGACTTTAGTCACG GCCATCAAGCTTACACAACACATCAGAAACGACAGTGGGCGAAATCTACGAATGT AAGGAGTGCGGGAAGCCATGTAACCATCCTAAACCATCTCCGAGAACATCAGAGGAT CCACAACAGTTGA | 6579 |
| | 3 | MSKDILLEKAPLLEHRIDRRRIPLNVRTVGRPLVVAINL VNRKSILVRNLMNVKNVRRPSVGAISLLNIKKPILGRSP TNVKTVGRLFEDGAQASLFIRGFILVKNPMNVKTVERPF GVVMSSLSTRDSTLGRKTTNAKTVGRPLAVCINLFSTRE PIVGRSLTSVKTVGRLLFVVQASPSIKEFTQVRNPMNYK NVGRPLLLESITLLSIRRSFPVRSLTNVRSVGRPFAGVRAS LSTRGYIRARSRKTSAQNVGRPSIVAIITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGCCATCTAGTCGTGCTATC AACTTAGTCAACATCAGAAATCCATACTGGTGAGAAGCCTATCAAAAATTCATACTG GTAAGAAGGCCTTCCGTTGAATCAGCTTACTCAACATCAAAAAATTCATACTG GGGAGAAGCCCTACGAATGTAAAGACTGTGGGAAGCCTTTCGATGGGGCTCAAGC CTCGTTATTCATAGAGGATTCATACTGGTGAAAAACCTATGAATGTAAAGACTGT GGAAAAGCCCTTTCGGCCGTGATGAGCTCACTCAGCACCAGAGATTCCACACTGG GGAGAAAGACTACGAATGCAAAGACTGTGGGAAGACCTTAGCCGTGTGTATAAAC TTATTCAGCACTACAGTAGTGGGGAGAAGCCTACGAGTGCACACAGGT GGGAAGGCCTTTATTGAATGTCAAGAAATGTGGGAAGACTAAAGAATTCACACAGGT GAGAACCCTATGAATGTAAAGAATGTGGGAAGCCTTACCTGAGTGAATTACCTT ACTCAGCATCAGAGATCCACACGGTGAGAAGCCTCACGAATGTAAGGAGTGTGG GAAGGCCTTTGCTGGGGTTCGAGCCTCGTTAAGCACGAGGATACATACGGGCG GAGAAGCGTACAAGTGCACAGAATGTGGGAAGCCTTCAATTGTGGCTATCACCTC ACTCAGCACAGGAATCCACACAGGGGAAACCCGTATAAATGTAAGGAGTGTGG GAAGGCTTTCATTTATGGATCGAGCCCTCGTGA | 6581 |
| | 4 | MGLKPRYS* | ATGGGGCTCAAGCCTCGTTATTCATAA | 6583 |
| | 1 | MSIR* | ATGTCAATCAGATGA | 6585 |

| | |
|---|---|
| | 6580 |
| | 6582 |
| | 6584 |
| | 6586 |

Figure 1 (Continued)

| | | | |
|---|---|---|---|
| hsa-mir-520e-1 | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGCTATCAACTTAGTCAACATCAGAAATCCATACTGGTGAGAAACCTTAT GAATGTAAAGAACTGTAAGAAGGCCTTCCGTTGGGCAATCAGCTTACTCAACATCAA AAAATTCATACTGGGGAGAAGCCTACGAATGTAAAGACTGTGAAAAACCTATGA ATGTGAAAGACTGTGGGAGGACTCGTATTCATAAGAGAATTCATACTGGTGAAAAACCTATGA ATGTAAAGACTGTGGGAGAAGGCCTTCGCGTGGTAAGAGCTCACTCAGCACCAGA GATTCCACACTGGGGAGAAGATACGAATGCAAAGACTGTGGGAAGACCTTAGC CGTGTGTATAAACTTATTCAGCACACAAGAGAATTCATAGTGGGGAGAAGCCTTACGA GTGTAAAGACTGTGGGAAGGCTTTCATTTGGTTCAAGCCTCATTCAGCATAAAG AATTCACACAGGTGAGAAATGCAAAACCCTATGAATGTCAAAGATGTGGGAAGGCCTTACTCG AGTCAATTACCTTACTCAGCATCAGAGAATGTCACACCGGTGAGAAGCCTCACGAATG TAAGGAGTGTGGGAGGACTCTTTGAGCGTTCAAGCACAGAGATGTCAAGCACGAGGA TACATACGGGCGAGAAGCCTACAAGAGAATGCACAGAGTGGGAAGCCTGTCGCAAACCCGTATAAATGT GCTATCACCTCACTCAGCACGAGAGAATCCACACAGGCGAAACCCGTATGAGAGAAT TCATACCGGGTGAAACCTATGGGTGCACAGAATGTGAGGGAAGAGCTTAGTCACG GCCATCAAGCTTACACAACACTCAGAAAACGCAAGTGGGGCGAAATCCACGAATGT AAGGAGTGCGGGAAGCGCATGTAACCACCTAAACCATCTCGAGAACATCAGAGGAT CCACAACAGTTGA | 6588 |
| | 3 | MSKDLLEKAPLLEHRDIRRIPLNVRTVGRPLVVAINL VMRKSILVRNLMNVKNVRRPSVGAISLLNIKKPILGRSP TNVKTVGRLFDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIRARSKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTTAGTCGTGCTATC AACTTAGTCAACATCAGAAATCCATACTGGTGAGAAACCTTATGAATGTAAAGAAT GTAAGAAGGCCTTCAACATCAGCTTACTCAACATCAAAAATTCATACTG GGGAGAAGCCCTACGAATGTAAAGACTGTTTCGATGGGGCTCAAGC CTGTTATTCATAAGAGGATTCATACTGGTGAAAAAACCTATGAATGTAAAGACTGT GAAAAGGCCTTTCGGCCTGTGATGAGCTCACTCAGCACCAGAGATTCCACACTGG GGAGAAAGACTACGAATGCAAAGACTGTGGGAAGACCTTAGCCGTGTGTATAAAC TTATTCAGCACAGACCTTTATTTGGTTCAAGCCTCATTCAGCATAAAGAATTCACACAGGT GGGAAGGCCTTTACTAATGCAAGGTACAAGGATATACACGGGCG GAGAAACCCTATGAATGTCAAGATGTGGGAAGCCTTCACTGAGGAAATACATAGGGAAGAGTAAGAGTGTGGCG ACTCAGCACGAGAGAATCCAGCACAGGCGGAAACCCTCAATTACTCGAGTGAATGTAAGGAGTGTGG GAAGGCCTTTCATTTATGGATCGAGCCGCGTGA | 6590 |
| | 4 | MGLKPRYS* | ATGGGCTCAAGCCTCGTTATTCATAA | 6591 |
| | 1 | MSIR* | ATGTCAATCAGATGA | 6593 |

| | |
|---|---|
| | 6592 |
| | 6594 |

Figure 1 (Continued)

| | | | |
|---|---|---|---|
| hsa-mir-520e-2 | 2 | MHINYVKRPATREGTPPRTHQRHHKENSFECKDCGKAF SRGYQLSQHQKIHTGEKPYECKECKKAFRWGNQLTQH QKIHTGEKPYECKDCGKAFRWGSSLVIHKRIHTGEKPY ECKDCGKAFRRGDEITQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGHQLTQHQKTHSGAKSYECKEC GKACNHLNHLREHQRIHNS* | ATGATCATCAATTATTGTCAAAGACCTGCTACTAGAGAAGGCACCCTCCTAGAACA CATCAGAGACATCATAAGGAGAATTCCTTTGAATGTAAGGACTGTGGAAGGCTTT AGTCGTGGCTATCAACTTAGTCAACATCAGAAATGCATACTGTGAGAAACCTTAT GAATGTAAAGAGAATGTAAGAAGGCCTTCCGTTGGGCAATGCAAAAGCTCGGTTACTCAACATCAA AAAATTCATACTGGGGAGAAGCCTCGTTATTCATAAAGAAGCTTAAAGACTGTGGGAAGGCTTTCG ATGGGGCTCAAGCTCGTTATTCATAAGAGAATTCATACTGGTGAAAAACCTATGA ATGTAAAGACTGTGGGAGAAGCTCGCTGATGAGCTCACTCAGCACCAGA GATTCACACTGGGAGGAAGATACGAATGCAAAGACTGTGGGAAGACCTTAGC CGTGTGTATAAACTTATTCAGCACAAGAGAATTCATAGTGGGGAGAAGCCTTACGA CGTGTAAAGACTGTGGGAAGGCTTTTATTGTGTTCAAGCCTCATTCAGCATAAAG AATTCACACAGGTGAGAAACCCTATGAATGTAAGATGTGGGAAGGCCTTTACTCG AGTCAATTACCTTACTCAGCCATCAGAGATCCACACCGGTGAGAAGCCTCACGAATG TAAGGAGTGTGGGAAGGCTCTTTCGCTGGGGTTCAGCCTCGTTAAGCACGAGGA TACATACGGGCGAGAAGCCGTACAAGTGCACAGAATGCAAGCCTTTACTCG GGCTATCACCTCACTCAGCACGAGCAATCCACACAGGCGAAACCCGTATAAATGT TCATACCGGGGTGAAACCCTATGGGTGTACAGAATCGAGCCTCGTGAAACATGAGAGAAT GCCATCAGCTTCACACAAACCTAGAAAACGACAGTGGGCGAAATCCTCGAATGT AAGGAGTGCGGGAAGCCATGTAACCACCTAAACCATCCCGAGAACATCAGAGGAT CCACAACAGTTGA | 6596 |
| | 3 | MSKDLLLEKAPLLEHRDIRRIPLNVRTVGRPLVVAINL VNIRKSILVRNLMNVKNVRRPSVGAISLLNIKKFILGRSP TNVKTVGRLFDGAQASLFIRGFILVKNPMNVKTVERPF GVVMSSLSTRDSTLGRKTTNAKTVGRPLAVCINLFSTRE FIVGR8LTSVKTVGRLLFVVQASFSIKEFTQVRNPMNYK NVGRPLLESTTLLSIBRRSFPVRSLTNVRSVGRPFAGVRAS LSTRGYIBARSKTSAQNVGRPSIVAITSLSTRESTQAKFRI NVRSVGRLSFMDRAS* | ATGTCAAAAGACCTGCTACTAGAGAAGGCACCCTCCTAGAACACATCAGAGACATC ATAAGGAGAATTCCTTTGAATGTAAGGACTGTGGGAAGGCCTTAGTCGTGGCTATC AACTTAGTCAACATCAGAAATGCATACTGTGAGAAACCTATGGTGTGCTATCA GTAAGAAGGCCTTCCGTTGGGCAATCTACTCAACATCAAAAATTCATACTG GGGAGAAGCCCTACGAATGTAAAGACTGTGGGAAGCTTTTCGATGGGGCTCAAGC CTCGTTATTCATAAGAGAATTCATACTGGTGAAAAACCTATGAATGTAAAGACTGT GGGAAGGCCTTTCGGCCTTGTGATGAGCTCACTCAGCACCAGAGATTCCACACTGG GGAAGAAGACTACGAATGCAAAGACTGTGGGAAGACCTTTAGCCGTGTGTATAAAC TTATTCAGCACAAGAGAATTCATAGTGGGGAGAAGCCTTACGAGTGTAAAGACTGT GGGAAGGCTTTTATTGTGGTTCAAGCCTCATTCAGCATAAAGGAATTCACACGGT GAGAAACCCTATGAATGTAAGATGTGGGAAGGCCTCGTTAAGCACGAGGATACATACGGGCG AGAAGCCGTACAAGTGCACAGAATGTGGGAAGGCCTTCACTCGAGTCAATTACCTT ACTCAGCACAGAGATCAGAGATCCACACCGGTGAGAAGCCTCACGAATGTAAGGAGTGTGGG GAAGGCCTTTCGCTGGGGTTCGAGCCTCGTTAAGCACGAGGATACATACGGGCG GAAGCCGTACAAGGTGCACAGAATGTGCACAGGCGAAACCCTCAATTGTGGCTATCACCTC ACTCAGCACGAGAATCAGAGGCGAAACCCGTATAAATGTAAGGAGTGTGG GAAGGCTTTCATTTATGGATCGAGCCCTGTGA | 6598 |
| | 4 | MGLKPRYS* | ATGGGGCTCAAGCCTCGTTATTCATAA | 6599 |
| | 1 | MSIR* | ATGTCAATCAGATGA | 6601 |

| | | | |
|---|---|---|---|
| hsa-mir-520d | 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATCCATACTGGTGAGAAACCTTAT GAATGTAAAGAATGTAAGAAGGCCTTCCGTTGGGCAATCAGCTTACTCAACATCAA AAAATTCATACTGGGGAGAAGCCTTCATAAAGACTGTAAAGACTTCATACTGAGCT ATGGGGCTCAAGCTGTGGAAGCTCGTTATTCATAAGAGGATTCATACTGGTGAAAAACCTATGA ATGTAAAGACTGTGGAAGGCCTTTCGCGTGGTGATGAGCTCACTCAGCACCAGA GATTCCACACTGGGGAGAAGACTACGAATGCAAAGACTGTGGGAAGACCTTTAGC CGTGTGTATAAACTTATTCAGCACACAAGAGAATTCATAGTGGGGAGAAGCCTTACGA CGTGTAAAGACTGTGGGAAGGCTTTATTGGTTCAAGCTCATTCAGCATAAAG AATTCACACAGGTGAGAAACCCTATGAAATGTCAAGAATGTGGGAAGGCTTTACTCG AGTCAATTACCTTACTCAGCATATCAGAGATCCACACCGGTGAGAAGCCTCACGATG TAAGGAGTGTGGGAAGGCTTTCGAGCTGGTTCAGCATGCACAGAATGCCACAAGTG TACATACGGGCGAGAAGCCGTACAAGTGCACAGAATGCACACAGGCTTAAGCACGAGAGA GGCTATCACCTCACTCAGCACGAGAAGAATCCACACAGGGAAACCCGTATAAATGT TCATATACCGGGGTGAAACCCTATGGGTGACAGAATGTGAGCCTCGTGAAACATGAGCTTAGTCACG GCCATCAAGCTTACACAAACACAGAAAACGCACAGTGGGGCAAATCCTACGAATGT AAGGAGTGCGGGAAGCATGTAACCTAAACCATTCCGAGAACATCAGAGGAT CCACAACAGTTGA | 6604 |
| | 3 | MSKDLLEKAPLLEHRDIRRIPLNVRTVGRPLVVAINL VMRKSILVRNLMNVKNVRRPSVGAISLLNIKKFILGRSP TNVKTVGRLFDGAQASLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIRARSKTSAQNVGRPSIVAIITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGCCTTAGTCGTGGCTATC AACTTAGTCAACATCAGAAATCCATACTGGTGAGAAACCTTATGAATGTAAAGAAT GTAAGAAGGCCTTCCGTTACTCAGCTTACTCAACATCAAAAATTCATACTG GGGAGAAGCCTTCATAAAGACTGTAAAGACTTCATACTGAGCTGTTTCGATGGGGCTCAAGC CTGTATTCGATGAGGATTCATACTGGTGATGAGCTCAGCACCAGAGATTCCACACTGG GGAAAGGCCTTTCGGCCTGGTGAATGCAAAGACTACGAGCTGTGTATAAAC TTATTCAGCACACAAGAGACTTTAGCCGTGTAAAGACTGTGGAAGATTCCACACTGG GGAAAAGACTACGAATGCAAGAACCTTATCAGTGGGGAGAAGACCTTACGAGTGTAAAAGACTGT TTATTCGACGATTCAGACTTTTGGGTTCAAGCTCATTCAGCATAAAGAATTCACACAGGT GGGAAGGCCTTTACTCGAGCCTCGTTAAGCACGAGAGGATACATACGGGCG AGAAACCCTATGAATGTCAAGAATGCGGAAATTCGAGTGAATGTAAGGAGTGTGG ACTCAGCATCAGAGATCCACACCGGTGAGAAGCCTCACGAATGTAAGGAGTGTGG GAAGGCCTTTCGCTGGGTTCGAGCTCGTTAAGCACGAGGATACATACGGGCG AGAGCCGTACAAGTGCACACAGGCGGAAACCCGTATCAATTGTGGCTATCACCTC ACTCAGCACGAGAAGAATCCACACAGGCGAAACCCGTATAAATGTAAGGAGTGTGG GAAGGCTTTCATTTATGGATCGAGCCGTGA | 6606 |
| | 4 | MGLKPRYS* | ATGGGCTCAAGCCTCGTTATTCATAA | 6607 |
| | 1 | MSIR* | ATGTCAATCAGATGA | 6609 |

Figure 1 (Continued)

| | | | |
|---|---|---|---|
| hsa-mir-520e | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRRGDEITQHQRPHTGEKDYECKDCGKTF SRVYKLIQHKRIHSGEKPYECKDCCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGCTATC AGTCGTGGCTATCAACTTAGTCAACATCAGAAAATCCATACTGGTGAAAACCTTAT GAATGTAAAGAATGTAAGAAGGCCTTCCGTTGGGCAATCAGATCAGCTTACTCAACATCAA AAAATTCATACTGGGGAGAAGCCTCGTTATTCATAAGAGACTGTAAAGACTTCATGTGAAAAACCTATGA ATGTGAAGACTGTGGAGGACGCCTTTCGCCGTGGTAGATCAGCTCACTCAGCACCAGA GATTCCACACTGTGGGAGAAGATACGAATGCAAAGACTGTGGGAAGACCTTAGC CGTGTGTATAAACTTATTCAGCACACAAGAGAATTCATAGTGGGGAGAAGCCTTACGA GTGTAAAGACTGTGGGAAGGCTTTTATTGGTTCAAGCCTCATTCAGCATAAAG AATTCACACAGGTGAGAAACCCTATGAATGTCAAAGATGTGGAAGGCTTTACTCG AGTCAATTACCTTACTCAGCATCAGAGATGTCACACCGGTGAGAAGCCTCACGAATG TAAGGAGTGTGGGCGAGAAGCCTACAAGTGCACAGAATGCGGGAAGGCCTTCAATTGT TACATACGGGCGAGAAGCCGTACAAAGTGCACAGAGAAATCCACACAGGTGAAACCCGTATAAATGT GGCTATCACCTCACTCAGCACGAGAATCCACACAGGCGAAACCCTCCAATTGT TCATATCCGGGGTGAAACCTATGGGTACAGAATGTGAGCCTCGTGAAACATGAGAAT GCCATCAAGCTTACACAACAGCCTACAGAAAACGCACAGTGGGGCGAAATCTACGAATGT AAGGAGTGCGGGAAGCCATGTAACCTAAACCATCCGAGAACATCAGAGGAT CCACAACAGTTGA | 6612 |
| | 3 | MSKIDLLEKAPLLEHRDIRRIPLNVRTVGRPLVVAINL VNIRKSILVRNLMNVKNVRRPSVGAISLLNIKKPILGRSP TNVKTVGRLFEDGAQASLFIRGFILVKNPMNVKTVERPF GVVMSSLSTRDSTLGRKTTNAKTVGRPLAVCINLFSTRE PIVGRSLTSVKTVGRLLFVVQASPSIKEFTQVRNPMNYK NVGRPFLLESTLLSIRRSFPVRSLTNVRSVGRPFAGVRAS LSTRGYIBRARSRKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGCCATTAGTCGTGCTATC AACTTAGTCAACATCAGAAAATCCATACTGGTGAGAAATCATACTTATGAATGTAAAGAAT GTAAGAAGGCCTTCCGTTACTCAGCTTACTCAACATCAAAAAATTCATACTG GGGAGAAGCCCTACGAATGTAAAGACTGTGGGAAGGCTTTCGATGGGGCTCAAGC CTCGTTATTCATAAGAGACTGATTCATACTGGTGAAAACCCTATGAATGTAAAGACTGT AAGAAGGCCCTTCATCAGCCTTCGCCGTGATGAGCTCACTCAGCACCAGAGATTCCACACTGG GGAAAAGACTACGAATGCAAAGACTGTGGGAAGAACCTTACGAGTGTAAAGACTGTGTATAAAC TTATTCAGCACACAGAATTCATAGTGGGGAGAAGCCTTACGAGTGTAAAGACTGT GGGAAGGCTTTTATTGGTTCAAGCCTCATTCAGCATAAAAGAATTCACACAGGT GAGAAACCCTATGAATGTCACAGAATGTGGGAAGGCCTTAAGCACGAGGAGATACACGGGCG GAAGCCGTACAAGTGCACAGAATCCACACAGGCGAAACCCTCCAATTGTGGCTATCACCTC ACTCAGCACGAGAATCCACAGCAATGCGGGAAGCCCTCAGTGAAATGAAGGAGTGTGG GAAGGCTTTCATTTATGGATCGAGCCGTCGTGA | 6614 |
| | 4 | MGLKPRYS* | ATEGGCTCAAGCTCGTTATTCATAA | 6615 |
| | 1 | MSIR* | ATGTCAATCAGATGA | 6617 |
| | | | 6616 |
| | | | 6618 |

Figure 1 (Continued)

| | | | | |
|---|---|---|---|---|
| hsa-mir-526f | 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATCCATACTGGTGAGAAACCTTAT GAATGTAAAGAATGTAAGAAGCCTTCCGTTCGGCAATGCAGTCACTCAACATCAA AAAATTCATACTGGGGAGAAGCCTCGTTATTCATAAGAGATGTAAAGACTTATACTGGTGAAAAACCTATGA ATGTAAAGACTGTGGAAGGCCTTTCCGCGTGGTAAGCTCACTCAGCACCAGA GATTCCACACTGGGGAGAAGACTACGAATGCAAAGACTGTGGAAGACCTTTAGC CGTGTGTATAAACTTATTCAGCACGACAAGAGAATTCATAGTGGGGAGAAGCCTTACGA CGTGTAAAGACTGTGGAAGGCTTTTATTTGTGGTTCAAGCCTCATTCAGCATAAAG AATTCACACAGGTGAGAATGCAAAACCCTATGAATGTCAAGAATGTGGGAAGGCCTTTACTCG AGTCAATTACCTTACTCAGCATCAGAGAGATCCACACCGGTGAGAAGCCTCACGAATG TAAGGAGTGTGGGAGGGCCTCTTCGCTGGGGTTCAGCCTTGTTAAGCACGAGAGGA TACATACGGGGCGAGAAGCCGTACAAGTGCACAGAGAGATCCACAGAATGCGAAACCCGTATCACGAAAT GGCTATCACCTCACTCAGCACGAGAATGCAAAAGCGAAACCGTATGAGAGAT TCATACCGGGGTGAAACCTCTAGGTGTACAGAAAATGTGGGAAGACTTTAGTCACG GCCATCAAGCTTACACACACATCAGAAACGCACAGTGGGGGAGAAATCTACGAATGT AAGGAGTGCGGGAAGCCATGTAACCTAAAACCATTCCGAGAACATCAGAGGAT CCACAACAGTTGA | 6620 | 6619 |
| | 3 | MSKDILLEKAPLLEHRDIRRIPLNVRTVGRPLVVAINL VNIRKSILVRNLMNVKNVRRPSVGAISLLNIKKPILGRSP TNVKTVGRLFDGAQASLFIRGFILVKNPMNVKTVERPF GVVMSSLSTRDSTLGRKTNAKTVGRPLAVCINLFSTRE PIVGRSLTSVSVKTVGRLLFVVQASPSIKEFTQVRNPMNYK NVGRPLLESITLLSIRRSFPVRSLTNVRSVGRPFAGVRAS LSTRGYIRARSKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTCAGTCGTGCTATC AACTTAGTCAACATCAGAAATCCATACTGGTGAGAAACCCTATGAATGTAAAGAAT GTAAGAAGCCTTCCGTCGAATGCAATCAGCTTACTCAACATCAAAAATTCATACTG GGGAGAAGCCTCGTTATTCATAAGAGACTGTGGGAAGGCTTTCGATGGGGCTCAAGC CTCGTTATTCGAATGAGGATTCATACTGGTGAAAAACCCTATGAATGTAAAGACTGT GGAAAGGCCTTTCGGCGTGATGAGCTACTCAGCACTGGGAAGACTTCACACTGG GGAGAAAGACTACGAATGCAAAGACTGTGGAAGACCTTAGCCGTGTGTATAAAC TTATTCAGCACGACAAGAGAATTCATAGTGGGAGAAGCCTTACGAGTGTAAAGACT GGGAAGGCTTTTATTTGTGGTTCAAGCCTCATTCAGCATAAAGAATTCACACAGGT GAGAATGCAAACCTATGAATGTCAAGAATGTGGGAAGGCCTTACGCTAAAAGAATTCACACAGGT ACTCAGCACGAGAGATCCACACCGGTGAGAAGCCTCACGAATGTAAGGAGTGTGG GAAGGCCTTTGCTGGGTTCGAGCCTCGTTAAGCACGAGAGGATACATACGGGCG GAGAAGCCGTACAAGTGCACAGAATGGGGAAGGCCTTCAATTGTGGCTATCACCTC ACTCAGCACGAGAGAATCCACACAGGCGGAAACCCGTATAAAATGTAAGGAGTGTGG GAAGGCTTTCATTTATGGATCGAGCCGTGA | 6622 | 6621 |
| | 4 | MGLKPRYS* | ATtGGGCTCAAGCCTCGTTATTCATAA | 6624 | 6623 |
| | 1 | MSIR* | ATGTCAATCAGATGA | 6626 | 6625 |

Figure 1 (Continued)

| | | | |
|---|---|---|---|
| hsa-mir-520g | 2 | MHINYVKRPATREGTPPRTHQRHHKENSPECKDCGKAF SRGYQLSQHQKIHTGEKPYECKECKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | 6627 | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAAATCCATACTGGTGAGAAACCTAT GAATGTAAAGAGTGTAAGGAAGGCCTTCCGTTGGGCAATGCAGTCACTCAACATCAA AAAATTCATACTGGGGAGAAGCCTACGAATGTAAAGACTGTAAAGACTGTGGGAAGGCTTTCG ATGGGGCTCAAGCTCGTTATTCATAAGAGAATTCATACTGGTGAAAAACCTATGA ATGTAAAGACTGTGGGAAGGCCTTTCGCGTGGTAGCTCACTCAGCACCAGA GATTCCACACTGGGGAGAAGACTACGAATGCAAAGACTGTGGGAAGACCTTAGC CGTGTGTATAAACTTATTCAGCACACAGAAGAATTCATAGTGGGGAGAAGCCTTACGA CGTGTAAAGACTGTGGAGAAGGCTTTTATTGTGGTTCAAGCCTCATTCAGCATAAAG AATTCACACAGGTGAGAAGACCCTATGAATGTCAAAGATGTGGGAAGGCCTTACTCG AGTCAATTACCTTACTCAGCATCAGAGATCCACACCGGTGAGCCTCGTTAAGCACGAAGGA TAAGGAGTGTGGGCGAGAAGCCTACAAGTGCACAGAATGTGGGAAGGCTTCAATTGT TACATACGGGCGAGAAGCCCTATGAATGTGAGCCTGTGAAACCTGTATAAATGT GGCTATCACCTTCAGCACGAGAATCCACACAGGCGAAACCCTATGAGAGAAT TCATACCGGGGGTGAAACCCTATGGGTGTACAGAATGTGGGAAGAGCTTTAGTCACG GCCATCAAGCTTACACAACACAGTGGGGGAGAAATCCCGAGATCTCACGAATGT AAGGAGTGCGGGAAGGCATGTAACCACCTAAAACCATTCCGAGAACATCAGAGGAT CCACAACAGTTGA | 6628 |
| | 3 | MSKDLLEKAPLLEHRDIRRIPLNVRTVGRPLVVAINL VMRKSILVRNLMNVKNVRRPSVGAISLLNIKKPILGRSP TNVKTVGRLLFDGAQASLFIRGFILVKNPMNVKTVERPF GVVMSSLSTRDSTLGRKTTNAKTVGRPLAVCINLFSTRE PTVGRSLTSVKTVGRLLFVVQASPSIKEFTQVRNPMNYK NVGRPFLLESTTLLSIRRSFPVRSLTNVRSVGRPFAGVRAS LSTRGYIBARSRKTSAQNVGRPSIVAITSLSTRESTQAKPRI NVRSVGRLSFMDRAS* | 6629 | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTTAGTCGTGCTATC AACTTAGTCAACATCAGAAAATCCATACTGGTGAGAAACCTATGAATGTAAAGAAT GTAAGAAGGCCTTCAAGAGCCCCTACGAATGTAAAGACTGTTACTCAACATCAAAAATTCATACTG GGGAGAAGAAGCCCCTACGAATGTAAAGACTGTGGGAAGCTTTTCGATGGGGCTCAAGC CTCGTTATTCATAAGAGATTCATACTGGTGAAAACCCTATGAATGTAAAGACTGT GGAAAGGCCTTTCGGCCTGTGATGAGCTCACTCAGCACCAGAGACTTCACACTGG GGAGAAAGACTACGAATGCAAAGACTGTGGGAAGACCTTAGCCGTGTGTATAAAC TTATTCAGCACACAGAATTCATAGTGGGGAGAAGCCTTACGAGTGTAAAGACTGT GGGAAGGCTTTTATTGTGGTTCAAGCCTCATTCAGCATAAAGAATTCACACAGGT GAGAAACCCTATGAATGTCAAGAATGTGGGAAGGCCTTCACTCGAGTCAATTACCTT ACTCAGCACGAGAATCCACACAGGCGAAACCCTATGAATGTAAGGAGTGTGGG GAAGGCCTTCATTTATGGATGCGAGCCCGTGA | 6630 |
| | 4 | MGLKPRYS* | 6631 | ATGGGCTCAAGCCTCGTTATTCATAA | 6632 |
| | 1 | MSIR* | 6633 | ATGTCAATCAGATGA | 6634 |

Figure 1 (Continued)

| | | | |
|---|---|---|---|
| 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAAATCCATACTGGTGAGAAACCTTAT GAATGTAAAGAATGTAAGAAGGCCTTCCGTTGGCAATCAGCTTACTCACCATCAA AAAATTCATACTGGGGAGAAGCCTACGAATGTAAAGACTGTGGGAAGGCTTTTCG ATGGGGCTCAAGCTCGTTATTCATAAGAGAATTCATACTGGTGAAAAACCTATGA ATGTAAAGACTGTGGGAAGGCCTTTCGCTGGCGTTGGAGCTCACTCAGCACCAGA GATTCACACTGGGGAGAAGACTTACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTTATTTGTGTTCAAGCCTCATTCAGCATAAAG AATTCACACAGGTGAGAAAACCCTATGAATGTCAAAAGATGTGGGAAGGCCTTTACTCG AGTCAATTACCTTACTCAGCATCAGAGAATCCACACCGGTGAGAAGCCTCACGAATG TAAGGAGTGTGGGAAGGCTTTCGAGCCTCGTTAAGCACGAGAGGA TACATACGGGCGAGAAGCCTACAAGTGCACAGAATGCACACAGCCTTCAATTGT GGCTATCACCTCACTCAGCACGAGAATCCACACAGGCGAAACCCGTATAAATGT TCATACCGGGGTGAAACCTCTATGGGTGCACAGAATGTGGAAGACTTTAGTCACG GCCATCAAGCTTACACAACACACAGAAACCACAGTGGGGCGAAATCCTACGAATGT AAGGAGTGCGGGAAGCCATGTAACCTAAACCATCCGAGAACATCAGAGGAT CCACAACAGTTGA | 6636 |
| hsa-mir-520h | 6635 | | |
| 3 | MSKDLLEKAPLLEHRDIRRIPLNVRTVGRPLVVAINL VNIRKSLVRNLMNVKNVRRPSVGAISLLNIKKPILGRSP TNVKTVGRLFLFDGAQASLFIRGFILVKNPMNVKTVERPF GVVMSSLSTRDSTLGRKTNAKTYGRPLAVCINLFSTRE PIVGRSLTSVKTVGRLLFVVQASPSIKEFTQVRNPMNYK NVGRPFLLESITLLSIRRSFPVRSLTNVRSVGRPFAGVRAS LSTRGYIRARSKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTTAGTCGTGGCTATC AACTTAGTCAACATCAGAAAATCCATACTGGTGAGAAACCTTATGAATGTAAAGAAT GTAAGAAGGCCTTCAACATCCATCAGCTTACTCACCATCAAAAAATTCATACTG GGGAGAAGCCCCTACGAATGTAAAGACTGTGGAAGGCTTTTCGATGGGGCTCAAGC CTCGTTATTCATAAGAGAATTCATACTGGTGAAAAACCTATGAATGTAAAGACTGT GGAAAGGCCTTTCGGCGTGATGAGCTCACTCAGCACCAGAGATTCACACTGG GGAGAAAGACTACGAATGCAAAGACTGTGGGAAGACCTTAGCCGTGCAGTGTAAAC TTATTCAGCACACAAGAATTCATAGTGGGGAGAAGCCTTACGAGTGTAAAGACTGT GGGAAGGCTTTATTTGTGTTCAAGCCTCGTTAAGCACGAGAGGATACATACGGGCG GAGAAGCCGTACAAGTGCACAGAATGTGGGAAGCCTCAATTCACACGGT GAGAAACCCTATGAATGTCAAGAATGTGGGAAGGCCTTACTCGAGTCAATTACCTTA ACTCAGCAGCCAGAGATCCACACCGGTGAGAAGCCTCACGAATGTAAGGAGTGTGG GAAGGCCTTCCTGGGGTGCAGCCTCGTTAAGCACGAGAGGATACACAGGCG GAGAAGCCGTACAAGTCCACAGAATGTGGGAAGCCTTCAATTGTGGCTATCACCTC ACTCAGCAGCCAAGTCCACACAGGCGAAACCCGTATAAATGTAAGGAGTGTGG GAAGGCTTTCATTTATGGATCGAGCCGTGA | 6638 |
| 4 | MGLKPRYS* | ATEGGGCTCAAGCTCGTTATTCATAA | 6640 |
| hsa-mir-521-J | 1 | MSIR* | ATGTCAATCAGATGA | 6642 |

Figure 1 (Continued)

| | | | | |
|---|---|---|---|---|
| hsa-mir-521-1 | 2 | MHNYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | 6643 | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAAATCCATACTGGTGAGAAACCTTAT GAATGTAAAGAATGTAAGAAGGCCTTCCGTTGGGCAATCAGCTTACTCAACATCAA AAAATTCATACTGGGGAGAAGCCTTCTATTCATAAGAGACTTCATACTGGTGAAAAACCTATGA ATGTAAAGACTGTGGAAGCTCGTGTGAAGGCCTTTCGCGTGGTGAGCTCACTCAGCACCAGA GATTCCACACTGGGGAGAAGACTACGAATGCAAAGACTGTGGGAAGACCTTTAGC CGTGTGTATAAACTTATTCAGCACACAAGAGAATTCATAGTGGGGAGAAGCCTTACGA CGTGTAAAGATGTGGGAAGGCTTTTATTGTGGTTCAAGCCTCATTCAGCATAAAG AATTCACACAGGTGAAGAAACCCTATGAATGTCAAAGATGTGGGAAGGCCTTACTCG AGTCAATTACCTTACTCAGCATCAGAGATGTCACACCGGTGAGAAGCCTCACGAATG TAAGGAGTGTGGGAAGGCCTTTCGCTGGGGTTCAGCCTCGTTAAGCACGAGAGA TACATACGGGCGAGAAGCCTACAAGTGCACAGAATGCACACGGTAAGCCTCAATTGT GGCTATCACCTCACTCAGCACGAGAAATCCACACAGGGAAACCCTATAAATGT TCATATCCGGGGTGAAACCTCTATGGGTGTACAGAATGTGGGAAGACTTTAGTCACG GCCATCAAGCTTACACAACACATGAATGCAAAAGGAGAATCCGATATGGGGGCGAAATCCTACGAATGT AAGGAGTGCGGGAAGCCATGTAACCTAACCATTCCGAGAACATCAGAGGAT CCAACAGTTGA |
| | 3 | MSKDLLLEKAPLLEHRDIRRIPLNVRTVGRPLVVAINL VMRKSILVRNLMNVKNVRRPSVGAISLUNIKKPILGRSP TNVKTVGRLFDGAQASLFIRGFILVKNPMNVKTVERPF GVVMSSLSTRDSTLGRKTTNAKTVGRPLAVCINLFSTRE PIVGRSLTSVTSVKTVGRLLFVVQASPSIKEFTQVRNPMNYK NVGRPLLESITLLSIRRSFPVRSLTNVRSVGRPFAGVRAS LSTRGYIBARSRKTSAQNVGRPSIVAITSLSTRESTQAKFRI NVRSVGRLSFMDRAS* | 6645 | ATGTCAAAAGACCTGCTACTAGAGGACACCCTCCTAGAACACATCAGAGACATC ATAAGGAGAATTCCTTTGAATGTAAGGACTGTGGGAAGGCCTTTAGTCGTGCTATC AACTTAGTCAACATCAGAAATCCATACTGGTGAGAAATGTAAGAAT GTAAGAAGGCCTTCCGTTACTCAGCTTACTCAACATCAAAAATTCATACTG GGGAGAAGCCCTACGAATGTAAAGACTGTGGGAAGGCTTTCGATGGGGCTCAAGC CTCGTTATTCATAGAGGATTCATACTGGTGAAAAACCCTATGAATGTAAAGACTGT GGAAAGGCCTTTCGGCCTGTGATGAGCTCACTCAGCACCAGAGATTCCACACTGG GGAGAAAGACTACGAATGCAAAGACTGTGGAAGACCTTAGCCGTGTGTATATAAAC TTATTCAGCACACAAGAGAATTCATAGTGGGAGAAGCCTTTACGACGTGTAAAGAT GGGAAGGCCTTTTATTGAATTCAAGAATGTCAAGAAAGGCTGTTAAGCACGAGGATACACAGGT GAGAAGCCGTACGAAGAATCCACACAGGGGAAACCTGTTAAGCACGAGGATACACAGGGCG ACTCAGCACGAGAGATCAGAAGCCTCAGCATCAGCATAAAGGCCTTACTCGAGTCAATTACCTT ACTCAGCAGCAAGATGCACAGAATGTGGGAAGGCCTTCAATTGTGGCTATCACCTC GAAGGCTTTCATTTATGGATCGAGCCCGTGA |
| | 4 | MGLKPRYS* | 6647 | ATGGGCTCAAGCCTCGTTATTCATAA |
| | 1 | MSIR* | 6649 | ATGTCAATCAGATGA |

Figure 1 (Continued)

| | | | |
|---|---|---|---|
| hsa-tmr-521-2 | 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVIHKRIHTGEKPY ECKDCGKAFRKGDEITQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATCCATACTGGTGAGAAACCTTAT GAATGTAAAGAATGTAAGAAGGCCTTCCGTTGGGCAATCAGCTTACTCAACATCAA AAAATTCATACTGGGGAGAAGCCTTCTATTCATAAAGAACTGTAAAGACTTTTCG ATGGGGCTCAAGCTGTGGAAGCTCGTTATTCATAAGAGACTCATACTGGTGAAAACCCTATGA ATGTAAAGACTGTGGAAGGACCCTTTCCGCGTGGTGATGAGCTCACTCAGCACCAGA GATTCCACACTGGGGAGAAGACTACGAATGCAAAGACTGTGGGAAGACCTTTAGC CGTGTGTATAAACTTATTCAGCACACAAGAGAATTCATAGTGGGAGAAGCCTTACGA CGTGTAAAGACTGTGGGAAGGCTTTTATTGGTTCAAGCCTCATTCAGCATAAAG AATTCACACAGGTGAGAAACCCTATGAATGTCAAAGATGTGGGAAGGCTTTACTCG AGTCAATTACCTTACTCAGCATCAGAGATCCACACCGGTGAGCTCTGTTAAGCACGAGGA TACATACGGGCGAGAAGCCTACAAGTGCACAGAATGCACCCGGTGAGAAGCCTTCAAGATGT GGCTATCACCTCACTCAGCACGAGAATCCACACAGGCTGAAAACCCGTATAAATGT TCATATACCGGGGTGAAACCTATGGGTGTACAGAATGTGGGAAGACTTTAGTCACG GCCATCAAGCTTACACAACACTCAGAAACGCACAGTGGGGCAAAATCCTACGAATGT AAGGAGTGCGGGAAGCCATGTAACCTAAACCATCTCCGAGAACATCAGAGGAT CCACAACAGTTGA | 6651 |
| | 3 | MSKIDLLEKAPLLEHRDIRRRIPLNVRTVGRPLVVAINL VMRKSILVRNLMNVKNVRRPSVGAISLLNIKKPILGRSP TNVKTVGRLFDGAQASLFIRGFILVKNPMNVKTVERPF GVVMSSLSTRDSTLGRKTTNAKTVGRPLAVCINLFSTRE PIVGRSLTSVKTVGRLLFVVQASPSIKEFTQVRNPMNVK NVGRPFLLESTTLLSIRRSFPVRSLTNVRSVGRPFAGVRAS LSTRGYIBARSEKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTTAGTCGTGCTATC AACTTAGTCAACATCAGAAATCCATACTGGTGAGAAACCTTATGAATGTAAAGAAT GTAAGAAGGCCTTCCGTTACTCAGCTTACTCAACATCAAAAAATTCATACTG GGGAGAAGCCCTACGAATGTAAAGACTGTGGGAAGGCTTTCGATGGGCTCAAGC CTCGTTATTCGATAAGAGACTCATACTGGTGAAAAACCCTATGAATGTAAAGACTGT GGAAAAGGCCTTTCGGCCTGGTGATGAGCTCACTCAGCACCAGAGATTCCACACTGG GGAGAAAGACTACGAATGCAAAGACTGTGGGAAGACCTTAGCCGTGTGTATAAAC TTATTCAGCACACTGGGAAGGCTTTTATTGGTTCAAGCCTCAATCAGCATAAAGAATTCACACAGGT GGGAAGGCCTTTCGAGCCTCGTTAAGCACCAGAATGTGGGAAGGCCTTTACTCG AGAAAACCCTATGAATGTCAAGAATGTGGGAAGGCCTTTACTCGAGTCAATTACCTT ACTCAGCAGCAGAGATCCACAGCGGTGAGAAGCCTCACGAATGTAAGGAGTGTGG GAAGGCCTTTGCTGGGGTTGAGCCTCGTTAAGCACGAGGATACATACGGGCG GAGAAGCCGTACAAGTGCACAGAATGTGGGAAGGCCTTCAATTGTGGCTATCACCTC ACTCAGCAGCGTAAGAGAATCCACACAGGGCGAAACCCGTATAAATGTAAGGAGTGTGG GAAGGCTTTCATTTATGGATCGAGCCGCTGTGA | 6653 |
| | 4 | MGLKPRYS* | ATGGGGCTCAAGCCTCGTTATTCATAA | 6655 |
| | 1 | MSIR* | ATGTCAATCAGATGA | 6657 |
| | | | 6656 |
| | | | 6658 |

| | |
|---|---|
| | 6652 |
| | 6654 |

Figure 1 (Continued)

| | | | | |
|---|---|---|---|---|
| hsa-mir-522 | 2 | MHINYVKRPATREGTPPRTHQRHHKENSPECKDCGKAF SRGYQLSQEHQKIHTGEKPYECKECKCKAFRWGNQLTQH QKIHTGEKPYECKDCGKAFRWGSSLVHKRIHTGEKPY ECKDCGKAFRKGDEITQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGCTATC AGTCGTGGCTATCAACTTAGTCAACATCAGAAATCCATACTGGTGAAAACCTTAT GAATGTAAAGAATGTAAGAAGGCCTTCCGTTGGCGAATGTAAACATCAACATCAA AAAATTCATACTGGGGAGAAGCCTTACTAAAGACTGTAAAGACTGTGGGAAGGCTTTCG ATGGGGCTCAAGCTGTGGAATCCGTTATTCATAAGAGATTCATACTGGTGAAAAACCTATGA ATGTAAAGACTGTGGGAAGGCCTTTCGCGCCGTGGTAGAGCTCACTCAGCACCAGA GATTCCACACTGGGGAGAAGACTACGAATGCAAAGACTGTGGGAAGACCTTTAGC CGTGTGTATAAACTTATTCAGCACACAGAGAATTCATAGTGGGAGAAGCCTTACGA GTGTAAAGACTGTGGGAAGGCTTTATTGGTTCAAGCCTCATTCAGCATAAAG AATTCACACAGGTGAAGAAACCCTATGAATGTCAAAGATGTGGGAAGGCTTTACTCG AGTCAATTACCTTACTCAGCATCAGAGATCCACACCGGTGAGCCTCGTTAAGCACGAGGA TACATACGGGCGAGAAGCCTACAAGTGCACAGAATGGGAAGCCTTCAATTGT GGCTATCACCTCACTCAGCACGAGAATCCACACAGGCGAAACCCGTATAAATGT AAGGAGTGTGGGAAGCTTTCATTTATGGATCGAGCCTGTGAAACATGAGAAT TCATACCGGGGTGAACCTATGGGTGCTACAGAATGTGGGAAGAGCTTAGTCACG GCCATCAAGCTTACACAACACTCAGAAACGCACAGTGGGGCGAAATCTACGAATGT AAGGAGTGCGGGAAGCATGTAACCACCTAAACCATCTCCGAGAACATCAGAGGAT CCACAACAGTTGA | 6659 | 6660 |
| | 3 | MSKIDLLEKAPLLEHRIDRRIPLNVRTVGRPLVVAINL VMRKSILVRNLMNVKNVRRPSVGAISLLNIKKPILGRSP TNVKTVGRLLFDGAQASLFIRGFILVKNPMNVKTVERPF GVVMSSLSTRDSTLGRKTTNAKTVGRPLAVCINLFSTRE PLVGRSLTSVKTVGRLLFVVQASPSIKEFTQVRNPMNYK NVGRPLLESLTLLSIBRRSFPVRSLTNVRSVGRPFAGVRAS LSTRGYIBARSRKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTAGTCGTGCTATC AACTTAGTCAACATCAGAAATCCATACTGGTGAAGTTCATAACTGTAAAGAAT GTAAGAAGGCCTTACTAAGACTTACTCAACATCAAAAATTCATACTG GGGAGAAGCCCTACGAATGTAAAGACTGTGGGAAGGCTTTCGATGGGGCTCAAGC CTCGTTATTCATAAGAGATTCATACTGGTGAAAAAACCTATGAATGTAAAGACTGT CTGTTATTCAGCACTACGAATGCAAAGACTGTGGGAAGACCTTAGCCGTGTGTATAAAC TTATTCAGCACACAGAGAATCATAGTGGGAGAAGCCTTACGAGTGTAAAGACT GGGAAGGCTTTATTGGTTCAAGCCTCATTCAGCATAAAAGAATTCACACAGGT GAGAAACCCTATGAATGTCAAAGATGTGGGAAGGCCTTTACTCGAGTCAATTACCTT ACTCAGCATCAGAGATCCACACCGGTGAGCCTCGTTAAGCACGAGGATACATACGGGCG AGAAGCCGTACAAGTGCACAGAATGTGGGAAGGCCTTCAATTGTGGCTATCACCTC ACTCAGCACGAGAATCCACACAGGCGAAACCCGTATAAATGTAAGGAGTGTGG GAAGGCTTTCATTTATGGATCGAGCCTCGTGA | 6661 | 6662 |
| | 4 | MGLKPRYS* | ATEGGCTCAAGCTCGTTATTCATAA | 6663 | 6664 |
| | 1 | MSIR* | ATGTCAATCAGATGA | 6665 | 6666 |

Figure 1 (Continued)

| | | | | |
|---|---|---|---|---|
| hsa-mir-523 | 2 | MHINYVKRPATREGTPPRTHQRHHKENSPECKDCGKAF SRGYQLSQEHQKIHTGEKPYECKECKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATCCATACTGGTGAGAAACCTTAT GAATGTAAAGAATGTAAGGCCTTCCGTTGGGCAATCAGCTTACTCAACATCAA AAAATTCATACTGGGGAGAAGCCTCTATTCATAAGAGACTCATACTGGTGAAAAACCTATGA ATGTGAAAGACTGTGGAAGCCTTTCGCTGTGATGAGCTCACTCAGCACCAGA GATTCCACACTGGGGAGAAGACTACGAATGCAAAGACTGTGGGAAGACCTTAGC CGTGTGTATAAACTTATTCAGCACACAGAGAATTCATAGTGGGGAGAAGCCTTACGA GTGTAAAGACTGTGGGAAGGCTTTTATTGGTTCAGCCTCATTCAGCATAAAG AATTCACACAGGTGAGAAACCCTATGAATGTCAAAGATGTGGAAGGCTTTACTCG AGTCAATTACCTTACTCAGCATCAGAGATGTCACACCGGTGAGAAGCCTCACGAATG TAAGGAGTGTGGGCGAGAAGCCTACAAGTGCACAGAATGCACAGGAGAATCCACAGA GCCTATCACCTCACTCAGCACGAGAATCCACACAGGCGAAACCCGTATAAATGT TCATATACGGGGTGAAACCCTATGGGTGTACAGAATGTGGGAAGACTTTAGTCACG GCCATCAAGCTTACACAACATCAGAAACGCACAGTGGGGCGAAATCTACGAATGT AAGGAGTGCGGGAAGCATGTAACCATCCGAGAACATCAGGAGAAT CCACAACAGTTGA | 6667 | 6668 |
| | 3 | MSKIDLLEKAPLLEHRDIRRIPLNVRTVGRPLVVAINL VMRKSILVRNLMNVKNVRRPSVGAISLLNIKKPILGRSP TNVKTVGRLFEDGAQASLFIRGFILVKNPMNVKTVERPF GVVMSSLSTRDSTLGRKTTNAKTVGRPLAVCINLFSTRE PIVGRSLTSVKTVGRLLFVVQASPSIKEFTQVRNPMNYK NVGRPLLESTLLSIRRSFPVRSLTNVRSVGRPFAGVRAS LSTRGYIRARSKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTAGTCGTGGCTATC AACTTAGTCAACATCAGAAATCCATACTGGTGAGAAGCCTCATACTCATAAAAATTCATACTG GTAAGAAGGCCTTCCGTACGAATGTAAAGACTGTGGGAAGGCTTTTCGATGGGCTCAAGC CTCGTTATTCGATCATACTGGTGAAAAAACCCTATGAATGTAAAGACTGT GGAAAGGCCTTTCGGCCTGTGATGAGCTCACTCAGCACCAGAGATTCCACACTGG GGAGAAAGACTACGAATGCAAAGACTGTGGAAGACCTTAGCCGTGTAGTGTAAACC TTATTCAGCACACAGAGAATTCATAGTGGGAGAAGCCTTACGAGTGTAAAAGACT GGGAAGGCCTTTTGTGGTTCAAGCCTCGTTAAGCACGAGAGGATACATACGGGCG GAGAAACCCTATGAATGTCAAGAATGTGGGAAGGCCTTCAATTGTGGCTATCACTC ACTCAGCAGGCGTACAAGTCACACAGGGCGAAACCTTACTCGAGTCAATTACCTTACC TTACTCAGCAGGAGATGCAGCAAGTCACACACGGTGAGAAGCCTCACGAATGTAAGGAGTGTG GAAGGCTTTCATTTATGGATCGAGCCGTGA | 6669 | 6670 |
| | 4 | MGLKPRYS* | ATGGGGCTCAAGCCTCGTTATTCATAA | 6671 | 6672 |
| | 1 | MSIR* | ATGTCAATCAGATGA | 6673 | 6674 |

Figure 1 (Continued)

| | | | |
|---|---|---|---|
| hsa-mir-524 | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRKGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATCCATACTGGTGAGAAACCTTAT GAATGTAAAGACTGTGGGAGAAGCCTTCCGTTGGGCAATCAGCTTACTCAACATCAA AAATTCATACTGGGGAGAAGCCTCGTTATTCATAAGAGATTCATACTGGTGAAAAACCCTATGA ATGTGAAGACTGTGGGAGAAGCCTTTCGCGCTGGTGATGAGCTCACTCAGCACCAGA GATTCCACACTGGGGAGAAGACTTACGAATGCAAAGACTGTGGGAAGACCTTTAGC CGTGTGTATAAACTTATTCAGCACACAAGAGAATTCATAGTGGGGAGAAGCCTTACGA GTGTAAAGACTGTGGGAAGGCTTTTATTTGTGGTTCAAGCCTCATTCAGCATAAAG AATTCACACAGGTGAGAAGCCCTATGAATGTCAAAGATGTGGGAAGGCCTTTACTCG AGTCAATTACCTTACTCAGCATCAGAGAATCCACACCGGTGAGAAGCCTCACGAATG TAAGGAGTGTGGGGAGCCTTTCGCTGGGGTTCGAGCCTCGTTAAGCACGAGAGGA TACATACGGGCGAGAAGCCGTACAAGTGCACAGAATGTGGGAAGGCCTTCAATTGT GGCTATCACCTCACTCAGCACGAGAAGATCCACACAGGCGAAACCCGTATAGAGAT TCATACCGGGGTGAAACCCTATGGGTGCACAGAATGTGGGAAGGCTTTAGTCACG GCCATCAGCTTACACACAGCTTACAGAAAACGACAGTGGGGCGAAATCCTACGAATGT AAGGAGTGCGGGAAGCCATGTAACCACCTAAACCATCCGAGAACATCAGAGGAT CCACAACAGTTGA |
| | 3 | MSKIDLLEKAPLLEHRDHRRIPLNVRTVGRPLVVAINL VMRKSILVRNLMNVKNVRRPSVGAISLLNIKKPILGRSP TNVKTVGRLFDGAQASLFIRGFILVKNPMNVKTYERPF GVVMSSLSTRDSTLGRKTTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIBARSRKTSAQNVGRPSIVAITSLSTRESTQAKFRI NVRSVGRLSFMDRAS* | ATGTCAAAAGACCTGCTACTAGAGAAGGCACCCCTCCTAGAACACATCAGAGACATC ATAAGGAGAATTCCTTTGAATGTAAGGACTGTGGGAAGGCCTTAGTCGTGGCTATC AACTTAGTCAACATCAGAAATCCATACTGGTGAGAAGCCTTATGAATGTAAAGAAT GTAAGAAGGCCTTCCGTACGAATGTAAAGACTGTGGGAAGGCTTTCGATGGGGCTCAAGC CTCGTTATTCATAAGAGATTCATACTGGTGAAAAACCCTATGAATGTAAAGACTGT GGAAAGGCCTTTCGGCGTGATGAGCTCACTCAGCACCAGAGATTCCACACTGG GGAGAAAGACTACGAATGCAAAGACTGTGGGAAGACCTTTAGCCGTGTATAAAC TTATTCAGCACACACAAGAGAATTCATAGTGGGAAGACCTTCAGCATAAAGAATTCACACACAGGT GGGAAGCCTTTTGGTTCAAGCCTCGTTAAGCACGAGAGGATACATACGGGCG GAGAAGCCGTACAAGTGGGAAATGCACAGGCGAAACCCGTATAGAGATTCATACCGG GGTGAAACCCTATGGGTGCACAGAATGTGGGAAGGCCTTCAATTGTGGCTATCACCTC ACTCAGCACGAGAAGATCCACACAGGCGAAACCCGTATAGAGATTCATACTGGGGTGAAAC TGAAGGCTTTCATTTATGGATCGAGCCGTGA |
| | 4 | MGLKPRYS* | ATGGGGCTCAAGCCTCGTTATTCATAA |
| | 1 | MSIR* | ATGTCAATCAGATGA |

| | | | | |
|---|---|---|---|---|
| hsa-mir-525 | 2 | MHINYVKRPATREGTPPRTHQRRHIKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRRGDEITQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | 6683 | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGGAAGCCTTT AGTCGTGGCTATCAACTTAGTCAACATCAGAAAATCCATACTGGTGAGAACCTTAT GAATGTAAAGAATGTAAGAAGGCCTTCCGTTGGGCAATCAGCTTACTCAACATCAA AAAATTCATACTGGGGAGAAGCCTACGAATGTAAAGACTGTAAAAACCTATCG ATGGGGCTCAAGCTCGTTATTCATAAGAGAATTCATACTGGTGAAAAACCCTATGA ATGTAAAGACTGTGGGAAGCCTTTCCGCGTGGTGAGCTCACTCAGCACCAGA GATTCCACACTGGGGAGAAGACTACGAATGCAAAGACTGTGGGAAGACCCTTAGC CGTGTGTATAAACTTATTCAGCACACAGAAGAGAATTCATAGTGGGGAGAAGCCTTACGA GTGTAAAGACTGTGGGAAGGCTTTTATTTGTGGTTCAAGCCTCATTCAGCATAAAG AATTCACACAGGTGAGAAACCCTATGAATGTCAAGAATGTGGGAAGGCCTTTACTCG AGTCAATTACCTTACTCAGCATCAGAGAATCCACACCGGTGAGAAGCCTCACGAATG TAAGGAGTGTGGGAAGGCTCTTTCGAGCCTTCAGTTAAGCACGAGAGGA TACATACGGGCGAGAAGCCGTACAAGTGCACAGAATGGGAAGCCTTCAATTGT GGCTATCACCTCACTCAGCACGAGAATCCACACAGGCGAAACCCGTATAAATGT AAGGAGTGTGGGAAGGCTTTCATTTATGGATCGAGCCTGTACAGAATGTGGGAAGCTTAGTCACG GCCATCAAGCTTACACAACACAGAAAACGCACAGTGGGGCGAAATCCTAGTCAATGT AAGGAGTGCGGGAAGGCATGTAACCATCCGAGAACATCAGAGGAT CCACAACAGTTGA |
| | 3 | MSKIDLLLEKAPLLEHRDIRRRIPLNVRTVGRPLVVAINL VMRKSILVRNLMNVKNVRRPSVGAISLLNIKKFILGRSP TNVKTVGRLLFDGAQASLFIRGFILVKNPMNVKTVERPF GVVMSSLSTRDSTLGRKTNAKTVGRPLAVCINLFSTRE PIVGRSLTSVTKVTGRLLFVVQASPSIKEFTQVRNPMNYK NVGRPLLLESITLLSIRRSFPVRSLTNVRSVGRPFAGVRAS LSTRGYIRARSRKTSAQNVGRPSIVAIITSLSTRESTQAKFRI NVRSVGRLSFMDRAS* | 6685 | ATGTCAAAAGACCTGCTACTAGAGAAGGCACCCCTCCTAGAACACATCAGAGACATC ATAAGGAGAATTCCTTTGAATGTAAGGACTGTGGGAAGCCTGGTTGAGTCGTGCTATC AACTTAGTCAACATCAGAAAATCCATACTGGTGAGAACTTATGAATGTAAAGAAT GTAAGAAGGCCTTCACTAACATCAGCTTACTCAACATCAAAAATTCATACTG GGGAGAAGCCCTACGAATGTAAAGACTGTGGGAAGCTTTTCGATGGGGCTCAAGC CTCGTTATTCATAAGAGAATTCATACTGGTGAGCTCACTGAGCTCACTCAGCACACTGT GAAAAGGCCTTTCGGCGTGATGCCTTTTCGAGGAGAGCCTTCACCAGGA GGGAAAAGACTACGAATGCAAAGACTGTGGGAAGACCTTAGCCGTGCGTGTATAAAC TTATTCAGCACAGACTTTTTGTGGTTCAAGCCTCATTCAGCATAAAAGAATTCACAC AGGTGAGAGGCCTTTTCGGCCTCGGTTCAAGAATGTGGGAAGGCCTCCACCAGGT GAGAAACCTTATGAATGTCAAGAATGCGGGAAGGCCTTTACTCGAGTCAATTACCTTACTT ACTCAGCAGCGTAGAAGATCCACACGTGAGAAGCCTCACGAATGTAAGGAGTGTGG GAAGGCCTTTGGCCTCTGGCGTTCGAGCCTCGTTAAGCACGAGAAGATACATACGGGCG GAGAAGCCGTACAAGATGCGCGGAATTGGGAAGCCTTCAATTGTGGCTATCACCTC ACTCAGCACGAGAATCCACACAGGCGGAAACCGTATAAATGTAAGGAGTGTGG GAAGGCTTTCATTATATGGATCGAGCCGTGA |
| | 4 | MGLKPRYS* | 6687 | ATGGGCTCAAGCCTCGTTATTCATAA |
| | 1 | MSIR* | 6689 | ATGTCAATCAGATGA |

Figure 1 (Continued)

| | | | | |
|---|---|---|---|---|
| hsa-mir-526a-1 | 2 | MHINYVKRPATREGTPPRTHQRHHKENSPECKDCGKAF SRGYQLSQEHQKIHTGEKPYECKECKAFRWGNQLTQH QKIHTGEKPYECKDCGKAFRWGSSLVIHKRIHTGEKPY ECKDCGKAFRRGDELTQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATCCATACTGGTGAAAACCTTAT GAATGTAAAGAATGTAAGGAGCCTTCCGTTGGGCAATCAGCTTACTCAACATCAA AAAATTCATACTGGGGAGAAGCCTACGAATGTAAAGACTGTAAAGACTTTTCG ATGGGGCTCAAGCTCGTTATTCATAAGAGAATTCATACTGGTGAAAACCTATGA ATGTAAAGACTGTGGAAGGCCTTTCCGCGTGGTAGCTCACTCAGCACCAGA GATTCCACACTGGGGAGAAGACTACGAATGCAAAGACTGTGGGAAGACCTTAGC CGTGTGTATAAACTTATTCAGCACACAAGAGAATTCATAGTGGGGAGAAGCCTTACGA GTGTAAAGACTGTGGGAGGCTTTTATTTGGTTCAAGCCTCATTCAGCATAAAG AATTCACACAGGTGAGAAAACCCTATGAATGTCAAAGATGTGGAAGGCCTTTACTCG AGTCAATTACCTTACTCAGCATCAGAGAATCCACACGGTGAGAAGCCTCACGAATG TAAGGAGTGTGGGAAGGCTCTTTCGCTGGGGTTCAGCCTCGTTAAGCACGAGAGA TACATACGGGCGAGAAGCCTACAAGTGCACAGAATGCACACAGGTGGGAAGCCTTTACTGT GGCTATCACCTTCACTCAGCACGAGAATCCACACAGGTCGAAACCCGTATAAATGT CATATACCGGGGTGAAACCTATAGGGTGTACAGAATGTGGGAAGAGCTTTAGTCACG GCCATCAAGCTTACACAACACTAGCAGAAAACGCACAGTGGGGCGAAATCCACGAATGT AAGGAGTGCGGGAAGCCATGTAACCACCTAAACCATCCGAGAACATCAGAGGAT CCACAACAGTTGA | 6691 | 6692 |
| | 3 | MSKDLLEKAPLLEHRDIRRIPLNVRTVGRPLVVAINL VNIRKSILVRNLMNVKNVRRPSVGAISLLNIKKPILGRSP TNVKTVGRLLFDGAQASLFIRGFILVKNPMNVKTVERPF GVVMSSLSTRDSTLGRKTTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIBARSRKTSAQNVGRPSIVAIITSLSTRESTQAKFRI NVRSVGRLSFMDRAS* | ATGTCAAAAGACCTGCTACTAGAGAACCACCCTCCTAGAACACATCAGAGACATC ATAAGGAGAATTCCTTTGAATGTAAGGACTGTGGGAAGCCCTTAGTCGTGCTATC AACTTAGTCAACATCAGAAATCCATACTGGTGAGAAACCTTATGAATGTAAAGAAT GTAAGAAGGCCTTCAATCAGCTTACTCAACATCAAAAATTCATACTG GGGAGAAGCCTACGAATGTAAAGACTGTGGGAAGGCTTTCGATGGGGCTCAAGC CTCGTTATTCATAAGAGGATTCATACTGGTGAAAAACCTATGAATGTAAAGACTGT GGAAAGGCCTTCAGCCTTTCGGCGTGGTAGCTCACTCAGCACCAGAGATTCCACACTGG GGAGAAAGACTACGAATGCAAAGACTGTGGGAAGAGACCTTAGCCGTGTGTATAAAC TTATTCAGCACACAAGAGAATTCATAGTGGGAGAAGCCTTACGAGTGTAAAGAC GGGAAGGCTTTTATTTGGTTCAAGCCTCGTTAAGCATGGGGAGAAGCCTTCACACGGT GAGAAACCCTATGAATGTCAAGAATGTGGGAAGAGCCTTTACTCGAGTCAATTACCTT ACTCAGCAGGATCAGAGAATCCACGGTGAGAAGCCTCACGAATGTAAGGAGTGTGG GAAGGCCTTTCGCTGGGTTCGAGCCTCGTTAAGCACGAGGAGGATACATACGGGCG GAGAAGCCGTACAAGTGCACAGAATCCACACAGGCGGAAACCGCTTCAATTGTGGCTATCACCTC ACTCAGCACGACAAGCCACCTAAACCACACAGGGCGAAACCCGTATAAATGTAAGGAGTGTGG GAAGGCTTTCATTTATGGATCGAGCCGTGA | 6693 | 6694 |
| | 4 | MGLKPRYS* | ATEkGGCTCAAGCTCGTTATTCATAA | 6695 | 6696 |
| | 1 | MSIR* | ATGTCAATCAGATGA | 6697 | 6698 |

Figure 1 (Continued)

| | | | |
|---|---|---|---|
| hsa-mir-526a-2 | 2 | MHINYVKRPATREGTPPRTHQRHHKENSPECKDCGKAF SRGYQLSQHQKIHTGEKPYECKECKAFRWGNQLTQH QKIHTGEKPYECKDCGKAFRWGSSLVIHKRIHTGEKPY ECKDCGKAFRKGDEI TQHQRPHTGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | ATGATCATCAATTATGTCAAAAGACCTGCTACTAGAGAAGGCACCCCTCCTAGAACA CATCAGAGACATCATAAGGAGAATTCCTTTGAATGTAAGGACTGTGGCTGTGCTATC AGTCGTGGCTATCAACTTAGTCAACATCAGAAAGCCTCATACTGGTGAGAAACCTTAT GAATGTAAAGAATGTAAGGCCTTCCGTTGGGCAATCAGCTTACTCAACATCAA AAAATTCATACTGGGGAGAAGCCTACTAGAAGACTGTAAAGACTTCATACTG ATGGGCTCAAGCACTGTGGAAGCTCGTTATTCATAAGAGAATTCATACTGGTGAAAAACCTATGA ATGTAAAGACTGTGGAAGACATGCCTTTCGCCGTGGTAAGTGCCACTCAGCACCAGA GATTCCACACTGGGGAGAAGACTACGAATGCAAAGACTGTGGGAAGACCTTTAGC CGTGTGTATAAACTTATTCAGCACACAGAGAATTCATAGTGGGGAGAAGCCTTACGA GTGTAAAGACTGTGGGAAGGCTTTTATTTGTGTTCAAGCCTCATTCAGCATAAAG AATTCACACAGGTGAGAAACCCTATGAATGTCAAGAATGTGGGAAGGCTTTTACTCG AGTCAATTACCTTACTCAGCATCAGAGAATCCACACCGGTGAGAAGCCTCACGAATG TAAGGAGTGTGGGCGAGAAGCCTACAAGTGCACAGAATGCACAGAATGGTGGGGAAGCCTCGTTAAGCACGAGAGGA TACATACGGGCGAGAAGCCTACAAGTGCACAGAATGCACAGAGCGAAACCCGTATAAATGT GGCTATCACCTCACTCAGCACGAGAATCCACACAGGAGAAACCCTCTAACATGAGAGAT CATATCAGCTTACACAACACAGAATGTGGGGAGAAGTGTTAGTCACG GCCATCAAGCTTACACAACACAGAATGTGGGGAAGAATCCTAAGAATGT AAGGAGTGCGGGAAGCCATGTAACCACCTAAACCATCCGAGAACATCAGAGGAT CCACAACAGTTGA | 6699 6700 |
| | 3 | MSKDILLEKAPLLEHRDIRRIPLNVRTVGRPLVVAINL VNIRKSILVRNLMNVKNVRRPSVGAISLLNIKKPILGRSP TNVKTVGRLFIRGFILVKNPMNVKTVERPF GVVMSSLSTRDSTLGRKTNAKTVGRPLAVCINLFSTRE PIVGRSLTSVKTVGRLLFVVQASPSIKEFTQVRNPMNYK NVGRPLLESITLLSIRRSFPVRSLTNVRSVGRPFAGVRAS LSTRGYIRARSKTSAQNVGRPSIVAIITSLSTRESTQAKFRI NVRSVGRLSFMDRAS* | ATGTCAAAAGACCTGCTACTAGAGGCACCCCTCCTAGAACACATCAGAGACATC ATAAGGAGAATTCCTTTGAATGTAAGGACTGTGGCGAAGCCTTTAGTCGTGCTATC AACTTAGTCAACATCAGAAAATCCATACTGGTGAGAAACCTTATGAATGTAAAGAAT GTAAGAAGGCCTTCCGTTACTCAGCTTACTCAACATCAAAAATTCATACTG GGGAGAAGCCCTACTAGAAGACTGTGGGAAGGCTTTCGATGGGGCTCAAGC CTCGTTATTCATAAGAGAATTCATACTGGTGAAAAACCCTATGAATGTAAAGACTGT GGAAAAGCCTTTCATCAGCCTTTGATGAGCTACACTAGTGGGGAGAAGACTTACGA GGAGAAAGACTACGAATGCAAAGACTGTGGGAAGACCTTTAGCCGTGTGTATAAAC TTATTCAGCACACAGAGAATTGTGGTTTCAAGCCTCATTCAGCATAAAGAAGGCCTTT GGGAAGGCCTTTACTCGAGTCAATTACCTTACTCAGCATCAGAGAATCCACACCGGT GAGAAGCCTCAGGATCAGAGAGGTCGACGAATCCACCCGGTGAGCCTCGTTAAGCA CGAGGAGGCTTTTCGCTGGGTTCGACGAATGTGGGGAGAAGCCTACGAGGAGGATACATACGGGCG AGAAGCCGTACAAGTGCACAGAATGTGGGAAGGCCTTCAATTGTGGCTATCACCTC ACTCAGCACGAGAATCCACACAGGGCGAAACCCGTATAAATGTAAGGAGTGTGG GAAGGCTTTCATTTATGGATCGAGCCCTCGTGA | 6701 6702 |
| | 4 | MGLKPRYS* | ATGGGCTCAAGCCTCGTTATTCATAA | 6703 6704 |
| | 1 | MSIR* | ATGTCAATCAGATGA | 6705 6706 |

Figure 1 (Continued)

| | | | | |
|---|---|---|---|---|
| hsa-mir-526b | 2 | MHINYVKRPATREGTPPRTHQRHHKENSPECKDCGKAF SRGYQLSQHQKIHTGEKPYECKECKCKAFRWGNQLTQH QKIHTGEKPYECKDCGKAFRWGSSLVIHKRIHTGEKPY ECKDCGKAFRRGDELTQHQRPHTCGEKDYECKDCGKTF SRVYKLIQHKRIHSGEKPYECKDCGKAFICGSSLIQHKRI HTGEKPYECQECGKAFTRVNYLTQHQKIHTGEKPHECK ECGKAFRWGSSLVKHERIHTGEKPYKCTECGKAFNCGY HLTQHERIHTGETPYKCKECGKAFIYGSSLVKHERIHTG VKPYGCTECGKSFSHGRQLTQHQKTHSGAKSYECKEC GKACNHLNHLREHQRIHNS* | 6707 | ATGATCATCAATTATGTCAAAAGACTGCTACTAGAGAAGGCACCCCTCCTAGAACA CATCAGAGACATCATAAGGAGAATTCCTTTGAATGTAAGGACTGTGGAAGGCCTTT AGTCGTGGCTATCAACTTAGTCAACATCAGAAATCCATACTGGTGAGAAACCTTAT GAATGTAAAGAATGTAAGAAGCCTTCCGTTGGCAATCAGCTTACTCAACATCAA AAAATTCATACTGGGGAGAAGCCTCGTTATTCATAAGAGAATTCATACTGGTGAGAAAACCTATGA ATGGGGCTCAAGCTGTGGAAGACTGTGGGAAGGCCTTTCCGTGATGAGCTCACTCAGCACCAGA ATGTAAAGACTGTGGGGAGAAGACTTACGAATGCAAAGACTGTGGGAAGACCTTTAGC GATTCCACACTGGGAGAAGATACGCACACAAGAGAATTCAGCACCATAGTGGGGAGAAGCTTACGA CGTGTGTATAAACTTATTCAGCACCAAGAGAATTCATAGTGGGGAGAAGAAGCTTACGA GTGTAAAGACTGTGGGAAGGCTTTTATTTGGTTCAAGCCTCATTCAGCATAAAG AATTCACACAGGTGAGAAGAACCCTATGAATGTCAAAGAATGTGGAAGGCTTTACTCG AGTCAATTACCTTACTCAGCATCAGAGAATCCACACCGGTGAGCCTCGTTAAGCACGAGGA TAAGGAGTGTGGGACGGCGAGAAGCCTACAAGTGCACAGATGGGAAGCCTCAATTGT TACATACGGGCGAGAAGCCTACAAGTGCACAGATGGGAAGCCTTCAATTGT GGCTATCACCTCACTCAGCACGAGAATCCACACAGGCGAAACCCGTATAATGT TCATATCCGGGGTGAAACCTATGGGTGACAGAATGTGGGAAGAGCTTAGTCACG GCCATCAAGCTTACACACAACCACTCAGAAACCACAAGGTGGGGGGAAATCTACGAATGT AAGGAGTGCGGGAAGCATGTAACCACCTAAACCATCTCCGAGAACATCAGAGGAT CCACAACAGTTGA |
| | 3 | MSKDILLEKAPLLEHRDIRRRIPLNVRTVGRPLVVAINL VMRKSILVRNLMNVKNVRRPSVGAISLLNIKKPILGRSP TNVKTVGRLFDGCAQASLFIRGFILVKNPMNVKTVERPF GVVMSSLSTRDSTLGRKTTNAKTVGRPLAVCINLFSTRE PIVGRSLTSVKTVGRLLFVVQASPSIKEFTQVRNPMNYK NVGRPLLLESITLLSIRRSFPVRSLTNVRSVGRPFAGVRAS LSTRGYIBARSRKTSAQNVGRPSIVAITSLSTRESTQAKFRI NVRSVGRLSFMDRAS* | 6709 | ATGTCAAAAGACCTGCTACTAGAGGCACCCCTCCTAGAACAACATCAGAGACATC ATAAGGAGAATTCCTTTGAATGTAAGGACTGTGGGAAGGCCTTTAGTCGTGGCTATC AACTTAGTCAACATCAGAAATCCATACTGGTGAGAAACCTTATGAATGTAAGAAT GTAAGAAGGCCTTCCGTGAATGAGCTTACTCAGCTTACTCAACATCAAAATTCATACTG GGGAGAAGCCCTACGAATGTAAAGACTGTGGGAAGGCTTTCGATGGGGCTCAAGC CTCGTTATTCATAAGAGGATTCATACTGGTGAAAAAACCCTATGAATGTAAAGACTGT GAAAAGGCCTTTCGGCGTGATGAGCTCACTCAGCACCAGAGATTCCACACTGG GGAGAAAGACTACGAATGCAAAGACTGTGGGAAGACCTTACGAGTGTAAACCCTATAAAC TTATTCAGCACTGGTTCAAGCCTTTATTTGGTTCAAGCCTCAGTGTAAAGACTGT GGGAAGGCCTTTGAATGTCAAGAATGTCAAGAATGTGGGAAGGCCTTTACTCGAGTCAATTACCTT ACTCAGCATCAGAGAATCCACACCGGTGAGAAGCCTCAGAATGTAAGGAGTGTGG GAAGGCCTTTGCGGGTTCGACGAGAATGTGCGACAGGATATACACGGGCG GAAGCGCCGTACAAGTGCACACAGGCGGAAAGCCTTCAATTGTGGCTATCACCTC ACTCAGCAGCACGAGAGAATCCACACAGGCGGAAACCCGTATAAATGTAAGGAGTGTGG GAAGGCTTTCATTTATGGATCGAGCCGTGA |
| | 4 | MGLKPRYS* | 6711 | ATgggGCTCAAGCTCGTTATTCATAA |
| | 1 | MSIR* | 6713 | ATGTCAATCAGATGA |

Figure 1 (Continued)

| | | | | |
|---|---|---|---|---|
| hsa-mir-527 | 2 | MIINYYKRPATREGTPPRTHQRHRKENSPECKDCGKAF<br>SRGYQLSQHQKIHTGEKPYECKECKKAFRWGNQLTQH<br>QKIHTGEKPYECKDCGKAFRWGSSLVIHKRIHTGEKPY<br>ECKDCGKAFRRGIDELTQHQRFHTGEKDYECKDCGKTF<br>SRVYKLIQHHCRIHSGEKPYECKDCGKAFICGSSLIQHERI<br>HTGEKPYECQECGKAFTRVNYLTQHQKIHTGEKPHECK<br>ECGKAFRWGSSLVKHERIHTGEKPYKCTECGKAFNCGY<br>HLTQHERIHTGETPYKCKECGKAPIYGSSLVKHERIHTG<br>VKPYGCTECGKSFSHGHQLTQHQKTHSGAKSYECKFC<br>GKACNHLNHLREHQRIHNS* | 6715 | ATGATCATCAATTATGTCAAAAGACCTGCTACTAGAGAAGGCACCCCTCCTAGAACA<br>CATCAGAGACATCATAAGGAGAATTCCTTTGAATGTAAGGACTGTGGGAAGGCCTTT<br>AGTCGTGGCTATCAACTTAGTCAACATCAGAAATCCATACTGTGAGAAACCTTAT<br>GAATGTAAAGAATGTAAGAAGGCCTTCCGTTGGGGCAATCAGCTTACTCAACATCAA<br>AAAATTCATACTGTGGGAGAAGCCCTACGAATGTAAAGACTCATACTGTGGAAGCTTTCG<br>ATGGGGCTCAAGCACTGTGGAGCTCGTTATTCATAAGAACTTCATACTGTGAAAACCCTATGA<br>GATTCCACACTGTGGGAGAAGACTACGAATGTAAAGACTCATACTGTGGAAGACCTTTAGC<br>CGTGTGTATAAACTTATTCAGCACAAGAGAATTCATAGTGGGAGAAGCTTACGA<br>GTGTAAAGACTGTGGAAGGCTTTTATTTGTGTTCAAGCTCATTCAGCATAAAG<br>AATTCACACAGGTGAGAAACCCTATGAATGTCAAGAATGTGGGAAGGCCTTTACTCG<br>AGTCAATTACCTTACTCAGCATCAGAAGATCCACACCGGTGAGAAGCCTCACGAATG<br>TAAGAGTGTGGAAGAGCCGTACAAGTGCACAGAATGTGGAAGACCTTTAAGCAGAGGA<br>TACATACTGTGGGGAGAAGCCTCGTTAAGCAGTGCACAGGTGCAGAATGTCAGAATGTCACG<br>GGCTATCACCTCACTCAGCACGAGAATCCACAGGCGAAACCCTGTTAAGCACATGT<br>AAGGAGTGTGGAAGGCTTCATTATGGATCGAGCCTGTGAAACATGAGAGAAT<br>TCATACCGGGGTGAACCTAGCAATGCAGAAAACGCACAGTGTGGGAGAGCTTAGTCACG<br>GCCATCAGCTTACACACAACATCAGAAATCGACACCATCTCCGAGAACATCAGAGGAT<br>AAGGAGTCGGGAAGGCATGTAACCACCTAAACCATCTCCGAGAACATCAGAGGAT<br>CCACAACAGTTGA | 6716 |
| | 3 | MSKDLLEKAPLLEHIRDIHRRIPLAVRTVGRPLVVAINL<br>VAHRKSILVRNLMNVKNVRRPSVGAISLLNIKKFILGRSP<br>TNVKTVGRLFDGAQASLFIRGFILVKNPMNVKTVERPF<br>GVVMSSLSTRDSTLGRKTNAKTVGRPLAVCINLFSTRE<br>RIVGRSLTSVKJTYGRLLFVVQASFSIKEFTQVRNPMNVK<br>NVGRPLLESITLLSIRRSTPVRSLTNYRSVGRPFAGVRAS<br>LSTRGYIRARSRTSAQNVGRPSIVAITSLSTRESTQAKPRJ<br>NVRSVGRLSFMDRAS* | 6717 | ATGTCAAAGACTGCTACTAGAGAAGCACCCCTCCTAGAACACATCAGAGACATC<br>ATAAGGAGAATTCCTTTGAATGTAAGGACTGTGGAAGCCTTTAGTCGTGGCTATC<br>AACTTAGTCAACATCATGAAAATCCATACTGTGAGAAACCTTATGAATGTAAGAAT<br>GTAAGAAGGCCTTCCGTTGGGGCAATCAGCTTACTCAACATCAAAAATTCATACTG<br>GGGAGAAGCCCTACGAAGACTGTAAAGACTGTGGAAGCTTTTGATGGGGCTCAAGC<br>CTCGTTATTCATAAGAGGATTCATACTGGTGATGAGCTCACTCAGAGACTTTAGAATGT<br>GAAAGGCCTTTATTTGCAAGGCCTGTGATGAGCTCACTCAGCACCAGAGAGATTCCACACTGG<br>GAGAAAGCGCTACGAATTCATAGTGGGAGAAGCCTTACGAGTGTAAAGACTGT<br>TATTCAGCACGACGACAAGAGATGCATAGTGGGAGAAGCCTTACGAGTGTAAAGACTGT<br>GGGAGGCCTTTCGCCTGGGTTCGAGCCTGTTAAGCAGTGCACGAGGATACATACGGCG<br>GAAGGCCTTTCGCCTGGGTTCGAGCCTGTTAAGCACGAGGATACATACGGCG<br>GAGAAACCGTACAAGTGCACAGAATGTGGAAAGCGAAACCCGTATAAATGTAAGGAGTGTGG<br>ACTCAGCAGCTTTCATTATGATCGAGCTCGTGA | 6718 |
| | 4 | MGLKPRYS* | 6719 | ATGGGGCTCAAGCCTCGTTATTCATAA | 6720 |
| hsa-mir-532 | 1 | MSRAPASLPLPGWAY* | 6721 | ATGAGCCGGCCGCGAGCCTCGCTGCCCTTGCCTCGCCGCCGCTGGGCTGTGTGA | 6722 |
| | 2 | MKJLCRLRGALTQLGVLDARADRARCPPAADTGSAAPD<br>LGDR* | 6723 | ATGAAGCTCTGCCGAGCGCGGCCTACGGTGCTGGATGCTAGGAGCTGATGCTGCCCAGA<br>GCCGACCGAGCGCGCTGCCCACCGGGACACGGGCTCGGACGTCGGACCT<br>CGGCCGGACAGGTAA | 6724 |
| | 3 | MGLPRARRWQPGA* | 6725 | ATGGGGCTCCCTCGGGGTTGCGGGGAAGTTCTTGCGGAGGCGCCAAGCCGCGCGCGCTTAG | 6726 |
| | 4 | MVPGLPERSFLAERRQARPAFESECLAACYPFPGLG* | 6727 | ATGGTCCCTGGGTTGCCGAGGCAAGTTCTTGCGGAGGCGCCAAGCCGCGCCC<br>GCTTTTGAATCGCAGTCGTTTAGCGCCTCCCTTTCCGCGTCCTGTGGACCTGGAGCAGCCAGTGGGGTAG | 6728 |
| | 1 | MDQGVEGGGCGPGVGRQSACSL* | 6729 | ATGGACCAGGGGTGAGAGGGTAGAGGGAGGTGGGTTGGAGGTCGGGCGCCAGTCAG<br>CTTGCAGCCCTATGA | 6730 |

Figure 1 (Continued)

| | | | | | |
|---|---|---|---|---|---|
| hsa-mir-539 | 2 | MKIDGKEGYRDRGRVGLRIARAAWHTVLG* | 6731 | ATGAAGGACGGAAAGGAGGGCTACAGAGATAGGGGAAGAGTGGGGCTGAGGATAGCCAGAGCGGCTTGGCACACAGTTTAGGGTAA | 6732 |
| | 3 | MTEPVTPGSSFKACLMGDSVVPVTKLGPESQGRAHQVAALP* | 6733 | ATGACTGAGCCGGTCACTCCAGGGTCTTCCTTCAAAGCGTGTCTAATGGGAGACAGCGTTGTCCCAGTAACCAAATTGGGACCCAGAGTCCCAGGGAAGGGCTCATCAGGTGGCCGCTCTGCCTTGA | 6734 |
| | 4 | MILFPLIDPAPLVPFSL* | 6735 | ATGATTCTCTTCCCTCTGGATCAGCCGCCCTCTAGTTCCCTTTCACTTTGA | 6736 |
| | 1 | MDQGVEGGGCGPGVGRQSACSL* | 6737 | ATGACCAGGGGTAGAGGGGAGTGGGTGGACCTGGGGTCGGGGCCAGTCAGCTTGCAGCCTATGA | 6738 |
| | 2 | MKIDGKEGYRDRGRVGLRIARAAWHTVLG* | 6739 | ATGAAGGACGGAAAGGAGGGCTACAGAGATAGGGGAAGAGTGGGGCTGAGGATAGCCAGAGCGGCTTGGCACACAGTTTAGGGTAA | 6740 |
| hsa-mir-541 | 3 | MTEPVTPGSSFKACLMGDSVVPVTKLGPESQGRAHQVAALP* | 6741 | ATGACTGAGCCGGTCACTCCAGGGTCTTCCTTCAAAGCGTGTCTAATGGGAGACAGCGTTGTCCCAGTAACCAAATTGGGACCCAGAGTCCCAGGGAAGGGCTCATCAGGTGGCCGCTCTGCCTTGA | 6742 |
| | 4 | MILFPLIDPAPLVPFSL* | 6743 | ATGATTCTCTTCCCTCTGGATCAGCCGCCCTCTAGTTCCCTTTCACTTTGA | 6744 |
| | 1 | MIQMSNCLYLTLFVYLQK* | 6745 | ATGATCAGATGTCCAATGTCCCTCTACTTAACCTTATTGTCTACCTTCAGAAGTAA | 6746 |
| hsa-mir-542 | 2 | MVKL* | 6747 | ATGGTGAAGTTATAA | 6748 |
| | 3 | MVQNVRCYTPSWGR* | 6749 | ATGGTTCAAAACGTGAGGCGCTGCTATACCCCCTCGTGGGAAGTAG | 6750 |
| | 4 | MMLHFGTPEPCSGRM* | 6751 | ATGATGCTCATTTGGCACCCTTTCCCGTGCTCAGGTAGAATGTAA | 6752 |
| | 1 | MDQGVEGGGCGPGVGRQSACSL* | 6753 | ATGACCAGGGGTAGAGGGGAGTGGGTGGACCTGGGGTCGGGGCCAGTCAGCTTGCAGCCTATGA | 6754 |
| hsa-mir-543 | 2 | MKIDGKEGYRDRGRVGLRIARAAWHTVLG* | 6755 | ATGAAGGACGGAAAGGAGGGCTACAGAGATAGGGGAAGAGTGGGGCTGAGGATAGCCAGAGCGGCTTGGCACACAGTTTAGGGTAA | 6756 |
| | 3 | MTEPVTPGSSFKACLMGDSVVPVTKLGPESQGRAHQVAALP* | 6757 | ATGACTGAGCCGGTCACTCCAGGGTCTTCCTTCAAAGCGTGTCTAATGGGAGACAGCGTTGTCCCAGTAACCAAATTGGGACCCAGAGTCCCAGGGAAGGGCTCATCAGGTGGCCGCTCTGCCTTGA | 6758 |
| | 4 | MILFPLIDPAPLVPFSL* | 6759 | ATGATTCTCTTCCCTCTGGATCAGCCGCCCTCTAGTTCCCTTTCACTTTGA | 6760 |
| | 1 | MDQGVEGGGCGPGVGRQSACSL* | 6761 | ATGACCAGGGGTAGAGGGGAGTGGGTGGACCTGGGGTCGGGGCCAGTCAGCTTGCAGCCTATGA | 6762 |
| hsa-mir-544 | 2 | MKIDGKEGYRDRGRVGLRIARAAWHTVLG* | 6763 | ATGAAGGACGGAAAGGAGGGCTACAGAGATAGGGGAAGAGTGGGGCTGAGGATAGCCAGAGCGGCTTGGCACACAGTTTAGGGTAA | 6764 |
| | 3 | MTEPVTPGSSFKACLMGDSVVPVTKLGPESQGRAHQVAALP* | 6765 | ATGACTGAGCCGGTCACTCCAGGGTCTTCCTTCAAAGCGTGTCTAATGGGAGACAGCGTTGTCCCAGTAACCAAATTGGGACCCAGAGTCCCAGGGAAGGGCTCATCAGGTGGCCGCTCTGCCTTGA | 6766 |
| | 4 | MILFPLIDPAPLVPFSL* | 6767 | ATGATTCTCTTCCCTCTGGATCAGCCGCCCTCTAGTTCCCTTTCACTTTGA | 6768 |
| | 1 | MCGNJFFLPLRWGLTLLPRLATS* | 6769 | ATGTGTGGAAATATTTTTTTCTTTTTGAGATGGGTCTCACTCTGTTGCCCAGGCTGGCAACATCATAG | 6770 |
| hsa-mir-545 | 2 | MGSHSVAQAGNIIAGTIIAHCSLDFLGSSDSSTSAF* | 6771 | ATGGGTCTCACTCTGTTGCCCAGGCTGGCAACATCATAGCTGCACAATCATAGCTCACTGTGATTCTTCCACCTAGCCTTCTGA | 6772 |
| | 3 | MSPELVSNS* | 6773 | ATGTCACCCGAGCTGTCTGAACTCCTGA | 6774 |
| | 4 | MGEGLTKEVWAEGGMMVEASVTEGRGKVEEAEWDSVLGKK* | 6775 | ATGGGAGAGGGATTGACCAAAGAAGTATGGGCTGAGGAGGGGATGATGGTGGAGGCCAGTGTGACCGAGGGAGGGAAGGTGGAAGAAGCAGAGTGGGATAGCGTCCTGGGAAAGAAGTGA | 6776 |

Figure 1 (Continued)

| | | | | |
|---|---|---|---|---|
| hsa-mir-548a-1 | 1 | MLTRELGGQIPGIQKLNSTSVPSLYAIECVGPAWWKHRI PRLSTSTFCRENAFFPQLVSRQMHSDLRGKCVLLVINK* | 6777 | ATGTTAACCAGAGAGCTGGGAGGGCAAATCCTGTATCCAGAAGCTGAATAGCAC TTCTGTTCCCTCACTGTATCCTATTGAGTGTGTTGGCCCAGCATGGTGAAACACCG CATTCCCAGGCTGAGCACCTCAGCACCTCATGCTTTGAGTGTGTTCTGCAGAGAAATGC TGTGTCACGCCAGATGCACTCGATCTCAGAGGGAAATGTGTCTACTGGTAATTAA TAAATAA | 6778 |
| | 2 | MLLSVLAQHGGNTAFFG* | 6779 | ATGCTATTGAGTGTGTTGGCCCAGCATGGTGAAACACCGCATTCCCAGGCTGA | 6780 |
| | 3 | MVETPHSQAEHLMLLQRKCFSASACVTPDAL* | 6781 | ATGGTGGAAACACCGCATTCCCAGGCTGAGCACCTCATGCTTCTGCAGAGAAATGC TTTTCGCGCTCAGCTTGTGTCACGCCAGATGCACTCTGA | 6782 |
| | 4 | MLFRLSLCHARCTLISEGNVCYW* | 6783 | ATGCTTTTCCGCTCAGCTTGTGTCACGCCAGATGCACTCTGATCTCAGAGGGAAAT GTGTGCTACTGGTAA | 6784 |
| hsa-mir-548a-2 | 1 | MYLKCVCFFYL* | 6785 | ATGTATCTTAAATGTCTGCTTTTCTATTACCGTAA | 6786 |
| | 2 | MCLLFLLPVHLJVMTQYL* | 6787 | ATGTCTCTGCTTTTCTATTACCGTAATATCTTGTAGTAATGACACAATATTTATGA | 6788 |
| | 3 | MKCSQYAREEERGREKRRBKVMSER* | 6789 | ATGAAGTGTCTCAATATGTCTAGGGAAGAAGAAGAGGGAGAAGAGAAAGAAGAA GAAAGGTGATGTCTGAGAGGTGA | 6790 |
| | 4 | MLGKKKEGERKEEER* | 6791 | ATGCTAGGGAAGAAGAAGAAATATTTTGAGTGCTGTGTTGCTTTTTTTACCAGATGA | 6792 |
| hsa-mir-548a-3 | 1 | MENIFGVLVAFFTR* | 6793 | ATGGAAAACATTTTTGAGTGCTGTGTTTTTTTACCAGATGA | 6794 |
| | 2 | MYSPESMF* | 6795 | ATGTATTCCCAGAAAGTATGTTTTAA | 6796 |
| | 3 | MHQSALCKMHQSALCKTHQSAGPQK* | 6797 | ATGCACCAATCAGCGCTCTGTAAAATGCACTCTGTAAACGCACCAA TCAGCAGGATTCCAAAGTAG | 6798 |
| | 4 | MEHGRGPQGNKSWPPPASTWGSLPCCGSCPFALRNKPC YRSLFESVPSLRAVNSHREGLQLHS* | 6799 | ATGGAACATGGAGGGGACCACAGACGAATAAAAGCTGGCCACCACCAGCCAGCCAC CTGGGGTTCTCTTCCATGCTGTGGAAGCTGTCCTTTGCTCTTCGCAATAAAACCTGC TACCGCTCACTCTTTGAGTCGCTGCCATCTTTAAGAGCTGTTAACAGTCACCGGGAA GGTCTCGACTTCATTCTTGA | 6800 |
| hsa-mir-548b | 1 | MATPGMSWQQHYYGGSAAKFAPSPATAQLAGHSMDY SQEMHLKMSKKIAQLTKVRGAATGQVATPCSPRRTHL SPREAVRPAPAARGTLLLRRSNSKRRHLQKPANFGGTLA T* | 6801 | ATGGCGACCCCGGGCATGAGCTGGCAGCAGCACTATTACGGCGGCTCCGCGGCCAA ATTCGCGCCCTCGCCCGCAACGGCACAGCTGGCTGGCACAGCTGGCACATGGACTACAGCC AGGAGATGCACCTGAAAATGAGCAAGAAAATGCCCAGCCTCACCAAGGTAAGGGGG GCAGCGACGGACGGACCAGTTGGCGACCCGTCGCGGCGCGCCAGACTCACCTGTCTCC CGGGAGGAGCAGTGCGCCTCGCGCGCCAGCGAGGGGAACTTCCGCGTCTCCCGGAA GCAACAGCCGGAGACACCTCCAAAACCTGCAAACTTGGTGGAACGCTGGCAACA TGA | 6802 |
| | 2 | MNLS* | 6803 | ATGAATTTAAGCTAG | 6804 |
| | 3 | MHLPGLREASHYSTI* | 6805 | ATGCATCTGCCAGGGCTCCAGGAGCATCACACTAGTACCATTGA | 6806 |
| | 4 | MTRIN* | 6807 | ATGACTCGGAATTAA | 6808 |
| hsa-mir-548b | 1 | MITWATPSVLCKCVMTNQPGRPRDLPLEIGNFHLCL* | 6809 | ATGATTACCTGGCAACCTTTCTGTCTATGTAAATGTAATGACTAATCAACCA GGACGGCCAAGGAGTTTGTTTCTAGAGATAGCATTTCATTTGTGCCTGTGA | 6810 |
| | 2 | MCND* | 6811 | ATGTGTAATGACTAA | 6812 |
| | 3 | MMIDQNKRRNHFTHA* | 6813 | ATGATGATGACCAAAACAAAAGAAGAAATCATTTCACTCATGCTTAG | 6814 |
| | 4 | MCMR* | 6815 | ATGTGCATGCGTTGA | 6816 |
| | 1 | MSSGIYSSLEEDAEDFFTARTSFRRAPQGKPRSGQQVS GARRALQPAPQSSGEPASPRPLPRVSAGRSGDARREGG AGREVASAFSGPGNVPGACACRRGKAEEGRGG* | 6817 | ATGAGCAGCGGCTACAGCAGCCTGGAGGAGGACGCCGAGGACTTCTTTACCGC CAGGACCTCCTTCCGCCGGGCCCCTCAAGGAGAGCCCCAGGGCAAGCCCCGTCCGGCCAACAAG TGAGTGGCGCCGCGGCGGCGCTGCAGCCCGCCCAGAGTTCCGGGAACCCGCC AGCCCGCCGCCGCCGTCCACGTCCTCTCCGGACGTCCCTTTCGGAGATGCTCCGGGC GAAGGAGGAGCCGGCGAGCCCGAGAGTGCTCCTGCCTTTGCCTGCCGGCGAAGCCTTTGCCTGCCGGCGAAGCCGAGGCGCTGGAAGGCGCGGCGCTGA | 6818 |

Figure 1 (Continued)

| | | | | | |
|---|---|---|---|---|---|
| hsa-mir-548c | 2 | MLAGKEERAEKWLLPFRVPGTCLELVRVGEGRRRKGG EAEGRLLPSAPDGLCSSASGCRLRGAAPEPAGVPGPLPQ VSPSRPKWVDGRVRAPVLPVSQLTHLWPPEWLGSTCNS * | 6819 | ATGCTCGCCGGAAGGAGGAGCGGCCGAGAAGTGGCTTCTGCCTTTCGGGTCCC GGGAACGTGCTGGAGCTGGGGCCGGCTGTGTGCGTTGCAGCTGTAGCGAGGAAGGCGAGGAAGGGCGGG GAGGCTGAGGGCCGGCTTCTGCCTTCCGCCAGATGCCCTCAGATGCCTCTGCAGCTGCCGCTCG GCTGCCGCCTGCTGGGGAGCAGCCCGGACGCAGCCAGCAGGCGTCCCGCGGCACTCCC CAAGGTTTCCCCTTCGCGTCCGTGGGGTCCAGCAGGCGTCGGGTTCGGCGCTCTGTCCT CCTTGTTAGTCAGCTTACTCATCTGTGGCCCCCAGTCTGGGCTGGGTTGGGTCAACGTGTAA TAGCTAG | 6820 |
| | 3 | MASAAPPRAAACGEQPRSQQASPGHSPRFPLRVPAGST VGFARLSFLLVSLLICGPQSGLGQRVIARGGRVT* | 6821 | ATGGCCTCTGCAGCTCCGCTCCGCTCCGCTGCGGGGAGCAGCCCCGGAGCCA GCAGGCGTCCCAGGCCAACTCCGCTTTCCCCTTCGGTCCCGTCCGGGTCGAC GGTCGGGTTCGCGCGCCTGCTCCTTGTGAGTCTGTCAGTAGCTGTAGCGTGGGCCCCA GAGTGGCTTGGGTCAACGTGTAATAGCGGTGGCGGGTGACCTGA | 6822 |
| | 4 | MFCKQAPMLNTSQRQLTFSPVSSFGGSMPWEARVGKR WEGNLCQFRQL* | 6823 | ATGTTTGCAAACAAGCTCCTATGCTCAAATACTAGCAGCGACAGCAGCTAACCTTCG CCGGTTTCTTCCTTTTGAAGGCAGCATGCGTGGGAAGCACGAGTTGGGAAAGA TGGAAGGGAACTTGTGCCAGTTTCGCCAGCTGTAG | 6824 |
| hsa-mir-548d-1 | 1 | MALCCESPRGGSSNQGLSFCAVEKPGETLK* | 6825 | ATGGCGCTTTGCTGTGAATCTCCGGGGAGGCTCCCAACCAGGGCTGAGCTTC TGCGCTGTGGAGAAGCCAGGTGAGACACTGAAATAA | 6826 |
| | 2 | MTASRTLSERDSTPRLTLL* | 6827 | ATGACCGCATCGAGGATGCTTTCCGAAAGGGATAGCACCCAAATCTCACTCTATTG TAA | 6828 |
| | 3 | MVSFLC* | 6829 | ATGGTATCTTTTGTCTACTAA | 6830 |
| | 4 | MVKLRLY* | 6831 | ATGGTGAAACTCCGTCTACTAA | 6832 |
| | 1 | MGFQKLTYEKSCCVPNCDNNQVASHGPHRNRAESKTP STARKARTTATLJFRTKDPLRTRTSFPLHSSVLCAERTIRY SQESRALPHP* | 6833 | ATGGGCTTTCAGAAATTAACCTATGAGAAGAGCTGCTGTGTCCCAACTGTGATAAC AATCAAGTTGCTTCCCACGCCACACAGACACCGGCAGAAACGCAGAAACAACACCCTC GAACCAGAACTTCATTTCTCTTCCTGCATCATGGCCGTCTGCTGAAGGACCATCC GCTATTCCAAGAAAGCAGGGCCCTCCCTCATCATG | 6834 |
| hsa-mir-548d-2 | 2 | MRRAAVSPTVITIKLLPTAHTETAQKAKHPPPRGRLEPR QRPSEPKTLCEPELRELFIHLCCVLKGPSAJPKKAGPSLIH SVNVECSH* | 6835 | ATGAGAGAGCTGCTGTGTCCCAACTGTGATAACAATCAAGTTGCTTCCCACGGCC CACACAGAATGACGGAACGTTTCAGAACCAAAACACCCTCTGCAACCAGAAGCTAGAACC ACGGCAACGCTTTCAGAAGAACCCTCTGCAACCAGAACCATCGCTATTCCAAGAAAGCAGGGCCC CATTCCATCTGTGCTGTGTCTGAAAGGACGTTGAGTGTTCACACTAG | 6836 |
| | 3 | MPSS* | 6837 | ATGCCATCATCTTAG | 6838 |
| | 4 | MVKNPVGWMQWLMPHPTLWEAEVGGLLEPKSLRPA* | 6839 | ATGGTCAAGAATCCGTGGGGTGGATGCAGTGGCTCATGCCTATAATCCCAACACTT TGGGAGGCTGAGGTAGGAGATGCTTGAGCCCAAGAGTTTGAGACCAGCCTGA | 6840 |
| hsa-mir-549_08 | 1 | MKLPSTRPRLAQVGRGPCARAGPGRALAAALGDADLSP RSPGAQSPRARSSQVRALEARTRWSGRGPRRASPRASK EPGSPVPRSRPGAPSEAKRQWRTGEKVCACHRLAASRG PRLSLRJSF* | 6841 | ATGAAACTTCCTCCCACGCGCCTGCCACGCGGGGTCCTGTGCC CGGGGCCGGACCGGGGCGCGGGGACGCAGACCGCAGAGCCCTGGAGCC GTGGGCGAGTCCGGGTGCGCAGAGTCCGCCCCGACAGCGGAGCCCTGGAGG CAGGGACTCGGTGAGCGCGTGGAGCGCCGGCGGAGGAGCAAGTCCCGGGCTCC AGGAGCCAGTGAGGAGGACAGGAGAAAAGTTCTGCCACAGAATCGCGCAGTC GGGGTCCCAGGCTAAGTCTCAGGATCTCTTTTAA | 6842 |
| | 2 | MLGSLKGTLV* | 6843 | ATGTTGGGTGTTACTAAAGGCACCTTAGTTGA | 6844 |
| | 3 | MPVTTVYRLTPPSLSPLIRKMGSVMLPH* | 6845 | ATGCCAGTTACAACTGTTACAGGATCTTAACCCTCCAGTTCCTCATCA GGAAAATGGGTTCTGTGATGCTTCCTCACTAG | 6846 |
| | 4 | MVRLK* | 6847 | ATGGTGAGGCTTAAATGA | 6848 |

Figure 1 (Continued)

| | | | | |
|---|---|---|---|---|
| hsa-mir-550-1 | 1 | MAAVAAAREEAVPRSGAPSAAAESGSGPSWRTRTETS GSRTAT* | 6849 | ATGGCGGCGGTAGCAGCGGCCGCCGCCCGAGAGGAGGCGGTGCCGAGATCGGGGCGC CGAGCGCGGCCAGCAGAGAGCGGTAGCGGCCCGTGTGGCGCACCAGAACCGAAACC AGCGGCAGCCGCACGGCCACTTGA | 6850 |
| | 2 | MGAKQSGPAAANGRTRAYSGSDLPSSSSGGANGTAGG GGGARAAAAGRFPAQVPSASHGPSASGGAAAAAAPAA PAAPRSRSLGGAVGSVASGARAAQSPFSHPNSSSGPYGS QDSVHSSPEDGGGGRDRPVGGSPGGPRLYGSLPAHLSP HMFGGTIDPSPRTRARSSRGCTWAVAAGYFYPSPFLLLP GRRGLPGPARVGLHPGRNPALNTGGAATA* | 6851 | ATGGGCGCGAAACAGAGCGGACCGGCCGCCGCTAACGCGCCACGCGCGCGTACTC GGGCTGGATCTACCTCGGGGCGCGCAGTAGCAGGCGGGGGAACGGCCACCGCGGCGG GCGGGGGCGCTCGGGCGCCGCCGCGCAGGAGGTTCCGGCTCAGGTGCCAAGCGCG CACCAGCCCAGCGCCTCCAGCCGCCTCCCTCGGCGCGCTCCGCGGGGAGCCGCCCC GGCGCGGCCCGCAGCGCCTCCCCTTCAGCATCCGAACAGCAGCAGCGCCGTACGGCT CGCAGGACTCGGTGCACAGCAGCCTGAGGACGGGGCGGGACCGCCTGGTGATCGGCTCTTACCAGCTCACCT GTGGGCGGGAGCCCTGGGCCGTGGCCGCGCCTGGTACGGACCCTCTCGCACCGCGTCGGTCTC TCCGCGCACATTTTGGAGGTACGGACCCCTTCGACCAGCCCGCGGCGCGCTCGGTCTC CTCGGGGCGCTGCAGTGGGCCGTGGCCTGCCTCCGACCAGCCGCGCTCGGTCTCTTT CTGCCGGGGCGGCGGCGGGCGCTTAACACCGGTGGTGCGCTACCGCATAG | 6852 |
| | 3 | MGPRAAAGALGPPRGGSRLRCPARTSPAPPAAPRRFK RPRQPRPRAAAPSAGPWGAWRRGPARRSPPSASRTAA AARTARRTRCTAALRTAAAAGTGRWAGAPAGRAW* | 6853 | ATGGGACCCGCCGCGGCGGGCGCTCGGGCGGCGCCGCCGCGGGGAGGTTCCC GGCTCAGTTGCCCAGCGCGCACCAGCGCCCCAGCCGCGGCCGCCGCCGCCCCG GGGCGGCCCGCAGCCCGGCGGCTCCTCGCCGCAGCCGCAGCCCTCGGGGGGCCGTG GGGAGCTGGCGTCGAGCCCGTACGGCTGCAGGACTCGGTGCACAGCAGCCCTGAACAG CAGCAGGCGGCCGGGACCGGCCGCCTGGGGAGCCCTGAGGACGGCG GCGCGGCGGCCGGGAGCCCGGTGGGGAGCCCTGAGGACGGCGGCTGGTGA | 6854 |
| | 4 | MTGANVVLQQTDETALVVVFSTRKSGGDQLLNVVLS GDSSGEQFLKAKSQSVSNEH* | 6855 | ATGACTGGAGCAAATGTTGTTTTACAACAGACGGACGAAACAGCCCTTGTGGTTGTG GTTTTTAGTAGGAAGTCAGGAGGAGACCAGTTGCTAAATGTAGTTCTATCTGGG GACTCGAGTGGGGAACAGTTTTTAAAGGCCAAAAGTCAAAAGTGTCTCAAATGAACA CTGA | 6856 |
| hsa-mir-550-2 | 1 | MREGRPWPWGRRRELLCLHRSPCAALMCCAR* | 6857 | ATGAGGGAAGGCGGCCGGCCGTGGCCGTGGCGGGGAGCTGCTTGCCTCCACCTG ATCTCCCTGTGCGGCCTCAATGTGCTGCTGCTGA | 6858 |
| | 2 | MEKARRGGDGVPRGPVLHVVVGPHHKKGCQVRKGPA PAPSRSGVRPFRGPPALLLCAQLASCSPPHSACDPSPLNL TPFAAPPTRPT* | 6859 | ATGGAGAAGGCCAGGAGAGGCGGGATGGGTGCCCCGCGGGGGCTGCCCCGTACTGCACAT CGTGGTGGTCGGATTTCACCACAGAAAGGCTGCCAGGTGAGGAAAGGCCCGCTGC CCGCCCACAGCTCGGCCGCTTCGGCGTTCCGCCCTTCGCCCTGCGGGGCCCCGGCCCCTGCTCTGT GTGCTCAGCTCGGCGTCTTTTGCAGTCCTCTCCACAGCCGCTGCGACCCTTCGCCTCTCA ACCTGACTCTTTTACAGCAAACCACCACAGAAAGATAA | 6860 |
| | 3 | MASPGGPYCTSWWSDFTTRRAAR* | 6861 | ATGGCCGTCCCCGGCGGCCCGTACTGCAGCTGGTGGTCGGATTTCACCACAAGAA AGGGCTGCCAGGTGA | 6862 |
| | 4 | MKPSPHNLFLLPLKNG* | 6863 | ATGAAGCCCAGCCCACACAACCTCTTCCTTCTGCCCTTGAAAAATGGTTGA | 6864 |
| hsa-mir-550-2 | 1 | MAAAASTGRWAGAPAGRAW* | 6865 | ATGGCGGCGGCGGCGAGCACCGGCCGCTGGGCGGGAGCCCCGGGGCGGGCGCG CCTGGGTGA | 6866 |
| | 2 | MFGGTDPSPRARARFSRGCTWAVAAGYFYRSPFLLPPG RRGLLPGPARQGLLPGPARAGLHPGKKPGT* | 6867 | ATGTTTGGAGGTACGGACCCCTCTCCACGCGCCGTCGTCCCGCGCTGCACGTGCCGGGGCCCGGCTGC ACGTGGCCGTGGCCGCCGGGCTACTTTTACCGTTCGCCCTTCCTCCCCGGCGGGGC GCCGGGTCTCCATCCTGGGAAGAAAACCGGCACGTAA | 6868 |
| | 3 | MLFYSKPTK* | 6869 | ATGTTGTTTTACAGCAAACCACCAAATAG | 6870 |
| | 4 | MNSELPSLDRLLJ* | 6871 | ATGAACTCTGAGTTACCATTCTTGACCGACTTTAATATAA | 6872 |
| | 1 | MCQPQVTAMTRVRQA* | 6873 | ATGTGCCAGCCCCAGGTAACAGCCATGACCCGGGTAAGACAAGCTTAA | 6874 |

Figure 1 (Continued)

| | | | | | |
|---|---|---|---|---|---|
| | 2 | MGEFASVKAAAATSFFQTRRDGWSCWSCSSRLATRHPR SISLGSAEAPSPQQQPTMGLPVGGVKPSVFNSGMGSCL ADVEHVVPKSPRCTATRAGP* | | ATGGGAGAGTTGCTCTGTGAAAGCAGCAGCAGCCACTTCCTTCAGACTGA CGTGATGCTGGAGCTGCTCCGGAGTGCTGAGGTCTCAAGTCCACAGCAGCCGCTGCTTGCAACCCGACATCCACG CAGCATTAGTCTCCGGTGGAGAGGTCAAGCCCAGTGTGTTCAACTCTGGGATCATGGGTTCCT GCCTCCGGTGACGTAGAACACGTTGTTCCCAAGTCACCCCGGTGACAGCAGCCACCAGAG CCGGCCCTTGA | 6876 |
| hsa-mir-551a | 3 | MAGAAGAAAALQPDIHAALVSGVLRLQVHSSSPPWA SRWEGSSPVCSTLGSWVPVLLT* | | ATGGCTGAGCTGCTGGAGCTGCAGCAGCCGCTTGCAACCCGACATCCACGCAGC ATTAGTCTCCGGAGTGCTGAGGTCTGAGGTCTCAAGTCCACAGCAGCCACCATGGGCTC CGGTGGGAGGGTCAAGCCCAGTGTGTTCAACTCTGGGATCATGGGTTCCTGTCTT GCTGACGTAG | 6878 |
| | 4 | MVTGVAAGTHQGLPSRPWEAPGSWHLLGACECRKALG TQAPLHRPLHPTAPQGPTLTRRTLPEGWGLWARLRSGP GQRPAPPSGAGRGLRCGRRLEPKCKIKVTGEADLAKGRE GKVAGVGGPQQPQGAGQGAGRAVPALAPHRGLGRWG SVQGTPPPPVLSQRGRGRAQSHLPTAAAPGSRSPDPARLT CVPASLGSAGPGQGARAGAGPRGEGLEPAAGRCLV RKVAGLEWWAGPCGEGLGPVAGRRLVQKGPGAGREG AGRERGGAMRGRARAAAGRRLVQKGLGAGRVGPGDA SSQBRGSRPPSPGARRCRGAGQGLQRAALSAPRRLAL GASRVPDLLHPCWSPSDATSLPAPRGPGCSADETAGGS GRVWA* | | ATGGTCACAGGTGTGGCGGCAGGAACCCATCAGGGACTCCCCTCCAGGCCCTGGGA GGCTTCACCGGATCCTGGCACCTCTGGGGCTTGTGAGTGCAGGAAGCCCTAGGTA CACAGGGCCCCTCCATAGACCTCTTCACCCACAGGCCTCAGGGCCCCACACTTA CCCGGAGAACCTTGCTCGAGGGCTGGGCTCTGGGCCAGGTCAGGTTGCCGTCAGGGCCT CCTGAGCCTAAAGTCCACCTCCAGCGGAGCAGGTCGTGGGCTGAGGTGGCAGACG AAGGGAAAGTGGCTGGTGTCGGGGCGACCGGAGAAGGCGATCTTCTAAGGCCCGGG AGCCGGTGCGGGGCAGTTCGTCCCTGGCCGCAGCACGCGGGTTAGTCCGGTTGGGGGGT CAGTCCAGGGCACGGCCCCACGCCCCCACCCCCAGTTCTCAGCGAAGCCGCAGCCCGGGACAGA TCGCACCTGTCTCCCCGCTCCTCGGCTCCGCAGGGCCGAGCTGGGCAGGGGCGA GGGCCGGAAGGTGCGGAGGGCCCACGCGGGGCTAGAGTGTGCTGGTCAGAAGGGCTGAGGGCCTGA GGTCCGGAAGGTAGGCCCCACCGTGGAGCGCCTACGGGGCCAGGGGGCCAGGGAAGGTGCTG GGAGCGGCCCTGGTCCAGAAGGGCGCGGAGCCATGCGGGGCTGAGGCCGCAGGAGAGG GGGCCCGGCAGGCTCTGCAGAGGCCTCCCCAGCCCTGCCCCAGAGCTCGCGCC TTGGGGCCCAGGGGCCCAGAGCCCTGCCCGGCTCAGCCGGAGCCCTGACGCA GCAGCCTCCAGGAGCTCCAGCCGGACCCTGCAGCCGCTGCAGGAGCGAGAGTGCGCCGGGGAGGC TCTGGGCGCCGTCTGGCCTGA | 6880 |
| | 1 | MCLLLAGSTFVCLPLR* | | ATGTGCCTCTTCTGGCTGGCTGGAAGCACGTTTGTTTGCTTACCGCTCAGGTGA | 6881 |
| | 2 | MRKASLUS* | | ATGAGAAAAGCAAGTCTATCACATCTTGA | 6883 |
| hsa-mir-551b | 3 | MGANYMFPHTQSLCLWLNLERTTPVVVWKLPSISS* | | ATGGGGGCGAATTACATGTTTCCACACACAGTCTCTTGTCTCTGCTAAATCTA GAAAGAACAACTCCAGTGTGTTTGAAAATTACCTAGCATCAGCAGCTAA | 6886 |
| | 4 | MHQYIPPLTPTSTSVHCV* | | ATGATTCAGTACATCCACACTAACTCCCACATCGAACTCAGTTCACTGTGTTGA | 6888 |
| | 1 | MGSKGSLGQVIGDHPLPE* | | ATGGGCAGCAAGGGCAGCCTTGGACAGGTGATAGGTGACCATCCCCTTCCAGAGTGA | 6890 |
| | 2 | MRARGLVCAPSLRSLGRELPPSGRDPE* | | ATGAGAGCCAGAGGCCTGGTATGTGCACCCTCATTGCGAGGCCTGGTCGGGAACT CCCTCTTCCGGTCGGACCCCGGAGTGA | 6892 |
| hsa-mir-552 | 3 | MCTLIAEPGSGTPSFGSGPGVKNRLCCELLRTAPPGGAR TRRALVENVGH* | | ATGTGCACCCTCATTGCCGAGCCTGGTCGGGATCTCCTCTTCGGGTCGGACCCC GGAGTGAAGAACCGGCTGCGCTTTGGTGAGCTGTTGAGAACGGCCACCAGGGGCGC TCGAACGCCGCGCTTTGATTGGGGATTTGA | 6894 |
| | 4 | MWGFDLVGTGAPGASCHGHRGGF* | | ATGTGGGGATTTGACCTTGTCGGAACAGGAGCACCTGGGCTTCAGGTCACCGGGAT CCGGTGGCGGATTCTGA | 6896 |

Figure 1 (Continued)

| | | | | | |
|---|---|---|---|---|---|
| hsa-mir-553 | 1 | MRTDCGTGRTRGFVSADSSVPRGAASSAFSSGSCAPGM NQGF* | 6897 | ATGCGCACTGACTGCGGAACTGGGCGAACCCGGGGGTTCGTTCTGCTGACTCCAGT GTCCCGAGAGGCGCCGCTTCTTCCGCTTCTGTCAGGCTCCTCAGGTCCTCAGGCATG AACCAAGGTTTCTGA | 6898 |
| | 2 | MAGPRVEVDGSIMEGVSTERSGRGCSLTKEGSSHHRCA YPSSPCTPTFAGRPDPESLYGLELSPRPPLAGAEDPSRPE HARPEVNLAGGGVGP* | 6899 | ATGGCTGGGGCCGCGAGGGTCGAGGTCGATGGCAGCATCATGGAAGGGGTGAGTACAG AGCGAAGCGGCCGCGGCTGCAGCCTACCCAACCTTTGCAGGGCGCGCACCACCGGTGT GCTTACTTCTCTTCCTCCGTACCCCAACCTTTGCAGGGCGCGCAGATCCTGAGAGT CTCTACGGCCCTTGAGCTGTCCTGTCCTAGGGCCTCCTGCCGGTGCAGAAGATCCGAGC CGGCCGGGAGCACGCCAGGGCTGAGGTAAATCTGGCTGAGGGGGAGTTGGGCCGTG A | 6900 |
| | 3 | MAASWKG* | 6901 | ATGGCAGCATCATGGAAGGGTGA | 6902 |
| | 4 | MGDPGRGTLPGRWPGL* | 6903 | ATGGGCGATCCAGGCGGGCACTCTGCCTGGCGCTGGTGTAA | 6904 |
| hsa-mir-554 | 1 | MGLYKGAVPRAPAQLEPDSGVDKWRVCCDPEGR* | 6905 | ATGGGCCTATACAAGGGGGCGGTTCCGGCGCCCAGTTGGAGCCAGACAG CGGGGTGGACAAGTGGCGTGTGTGCTGCGACCCGGAGGGAAGATGA | 6906 |
| | 2 | MNGTRNWCTLVDVHPEDQAAVRKSALAVFSVLYSRFL SPPLPCPAPCWLTSPGARLARSALRGASLFFCLRRAV GVAG* | 6907 | ATGAACGGGACGGCAAACTGGTACCCTGGTGACGTGCACCCAGAGGACCAGCC GGGGTAAGAAAAGCGTCGCTGCTTCTCCGTTGTATTCCGGTTTCTAAG TCCGCCCCTTCCGTGCCCGCCCGCCGTGTGCTGACATCACCTGGTCGCGCTCGC GCGGTCAGCCCTGCGCGCCAGCTTCTCTCTTTATTCTTTGACGTTGTGTCCTCGCGAGGAG GGAGTCGCGGGTGA | 6908 |
| | 3 | MSSSDWVPERLWTLCPAEEA* | 6909 | ATGAGCTCAAGCGACTGGGTCCTGAGCGCCTTGAGGAGGCTTAG GCTAG | 6910 |
| | 4 | MVLWMHSMKKNGRVNYRAWTGGRGASRGR* | 6911 | ATGGTGCTTTGGATGATCAGTAACAAGAAAAATGGTAGAGTAAATTACAGGGCTTG GACTCGAGGGGCGGCGAGGCAAGTAGGGGACGGTAG | 6912 |
| hsa-mir-555 | 1 | MGEGRAGRGILSLPGSPSRRGEGVSLTGRLPEGAGK* | 6913 | ATGGGGGAGGGAGGGAGAGCGAGGGTGCTCCTGACAGGCAGACTCCGGAGGGCTCGGGAAGTA | 6914 |
| | 2 | MIGASPIYQFYCV* | 6915 | ATGATCGGAGCTCCCCATAGTCCAGTTGTGTGTGTTAA | 6916 |
| | 3 | MWERQDDLSVVSLINVTG* | 6917 | ATGTGGGAACGACAGGATGATCTCAGTGTTGAAGTTAATAAATGTCACTGGTTAA | 6918 |
| | 4 | MISVL* | 6919 | ATGATCTCAGTGTTGTAA | 6920 |
| hsa-mir-556 | 1 | MPSKTKYNLVIDGHDLRIPLHNEDAFQHGICFEAKVRG LRGGCYLWWRLGGHV* | 6921 | ATGCCAAGCAAAACCAAGTACAACCTGGTCGACGATCCGGATCCC CTTGCACAACGGCAGCGTCCCTGTTGGAGGCCAAGGTGAGGG GGCTCCGGAGGGCTACCTGTGGTGCGGGTGCCATGTTGA | 6922 |
| | 2 | MGITCGSPCTTIRTPSSTASALRPR* | 6923 | ATGGGGACGACGACCTGCGATCCGGACGACCTCGAGACGCCTCAGCACGGCATCT GCTTGAGGCAAGGTGA | 6924 |
| | 3 | MFERMGCTAYLDPELAG* | 6925 | ATGTTTGAGCGGATGGGATGCACAGCGTCCTGGACCCAGAGCTGCGGGCTAG | 6926 |
| | 4 | MHSRPGPRAGGLGRFGGLSLREGNSPF* | 6927 | ATGCACAGCCGTCCTGGACCGAGCTGGCGGGCTAGCCGATTTGGGGGCCTTTCT CTTAGGGAGGTAACTCTCCCTTCTGA | 6928 |
| hsa-mir-557 | 1 | MLIFPYDSSPFFSVL* | 6929 | ATGCTTATATTCCCTTATGACTCTTCCCCTTTTCTGTCCTATAG | 6930 |
| | 2 | MTLPLFLFLSYRISLFSSLLIVSFAVQKRFSLTRYHLSIFFC SCNCPWGLSQKFFAKADVEKSTS* | 6931 | ATGACTCTTCCCTTTTCCTTTTCGTCCTATAGGATTAGCTTATTTCTAGTCTGTT GATAGTTCTTCTGCGTGCAGAAGCGCTTAGTTAACTAGTACCATTTGTCAATT TTCTTTTTGTTCTTGCAATTGCCCTTGGGACTTAGCCCAAAAATTCTTTGCCAAGGCTG ATGTTGAGAAGAGCACTTCCTAG | 6932 |
| | 3 | MLRRALPRFSSRFIV* | 6933 | ATGTTGAGAAGAGCACTTCCTAGGTTTTCTTCTAGAATTTTATAGTTTGA | 6934 |
| | 4 | MSYI* | 6935 | ATGTCTTACATTTAA | 6936 |

Figure 1 (Continued)

| | | | | |
|---|---|---|---|---|
| hsa-mir-558 | 1 | MGRAGVVKGTLGRSLGSFQSKREASDCLFSHQSRDRD PEVRFRPRPNSCTVRTENGQKAAGTAAKGLRAYRTGK KGGGPHLAEMHGGQPLPPRGAGRTREPPLPRLTGRN WDAADAELARPAARGTIREPSRACSTRRPARAPGPASL PASPPLPSASLRVWFLRPGDRRSACVRAPDFTSG* | 6937 | ATGGGAGGGCAGGCGTGGTAAAAGGTACAGGTTTGGGAAGGTCGCTCGGTTCCTT CCAATCCAAACGAGAGGCTTCTGCGCACGAGCTTATTCTCAACCAGAGCGTGACCGAGA CCCAGAGGTCGCTTCGCCGCCGAACCGCTGGAACCGCGCTACGGGAACG GTCAAGGCGCAGCTGGGGTCCCCACCTAGCGAAATGCACGAGAGCGCAACCTCTCCCTGCC AAGGGCCGGGGTCCCCACCTAGCGGAAATGCACGAGAGCCAACCTCTCCCTGCC CCCGCGAGGAGGCGGGGCGGACTGCAGCTGGCGGAACTGGCCAGAGACCCCGGCGCTCCCAGGTCACAGGAAGAA ACTTGGGAGCGGAGCCGACCGGAACTGGCCAGACCCCGCGCTGCACCGCGCGAG PASPCCTGCTTCGCCACCGGCGTGGAATGTCCAGCCGCCTCCCGAGTTGCCCTCCGGGT GCGATCGACGTTCCCGCGTCGGGCGCCCTGACTTCACTTCCGGCTAA | 6938 |
| | 2 | MLHPPASSPRPGPRLPPCFSPSPVYSLPPSLAPPAGRSTERV RAGA* | 6939 | ATGCTCCACCCGCCGCTCTCCCGTCAGCTCCTCCCTGCAGCTTCCTCCGTTC TCCCCTCTCCCGTCAGCTCCGTTCCCTCCGGCCCCGCCCGCTCCTCCTGTTC TTCCCGTGCGTGCGGGCGCCTGA | 6940 |
| | 3 | MVTGGGAAPPGTVTEPLPSVIVLSAGRKMAAAAAAAAS GPGCSSAAGAGAAGVSEWLVLRDGCMHCDADGLHSLS YHPALNAILAVTSRGTIKVIDGTSGATLQASALSGESSA RRAGAKPGKEAVQPRGSASRLGEARWREGRAGGSGPA VKGGPEADGGGP* | 6941 | ATGGTACTGGTCGTGGTGCTGCAGGCCGGAACGTCTCACTGAGCGCTTCCCAGT GTGATTGTGCTGAGCGCAGCCGGAAGATGGCGGCTGCGCGGCGGCTCAGAGTGGCTGG CCCCGGCTGCTCCTCCTGCACGCGCGGAGGCGCCCGCCCCGGCTCCAGAGTGCTCGG TGCTGCGGGACGGCTGCATGCACTGCGACGCCGACGGGCTGCACAGCCTGTCTAC CACCCTGCCTCAACGCCATCCTGCCGTCAGCCTGCGCTGAGCACATCAAAGTCATC GACGGCACCTCGGGGCCACACTGCAGGCCTCCGCTCAGCCAGTGGTGAGTCTTCGC AGCGCCGGCGGCGAAGCGTGGGAAGAAGCCGTCAGCCCGGGCTTGGCCT CGCGACTCGGGGAAGCCCGGAAGCCAGGGGGCGAGATGGCGAGGGGACCCTAG | 6942 |
| | 4 | MARCGQGWGPGPSREGRPGS* | 6943 | ATGGCGAGAGGGCAGGGCTGGGGTCCGGTTCGAAGGGAGGCCGGAA GCTGA | 6944 |
| hsa-mir-559 | 1 | MSHRPGVGVSRLPSPSPGAAVGARPSPQVWARAPRSA PPQVLRLHCKGVRDLWWPPRRFEDSVLRLFPNRRSAALK P* | 6945 | ATGAGTCACCGCCCGGAGTTGGGCGAGTAGGCTCCCCCCTCCCAGCCCGG CGCTGCAGTTGCGGCCGAAGGCCCTCTCCACAGGTGTGGGCCCGCGGCTCCGC CCCGCCCCCAGCTGCTTCGTTCGTCCATGGCGGTTAGGAGATCTTTGGTGGCCCGAG GAGGTTGAAGATTCTGTGTGAGACTTCCTTTAACCGAGGAGCGCTGCTCTGAA GCCTTGA | 6946 |
| | 2 | MAALGIFGGLRGGLKLC* | 6947 | ATGGCGGCGTTAGGGATCTTTGGTGGCCTCGAGGAGGTTTGAAGATTCTGTGCTGA | 6948 |
| | 3 | MGPGGKGAGTG* | 6949 | ATGGGCCGCTGGGGAAGGGTGGGAACTGTATAG | 6950 |
| | 4 | MSVSL* | 6951 | ATGAGTGTTTCTTTATAA | 6952 |
| hsa-mir-561 | 1 | MGFSLIPPSTHLRFRVHARDSPVGPQJTTJRD* | 6953 | ATGGGTTTCTCTCTCATTCCACCTCCACCTCCGGTTCGCGTGCACGCGCGA GATAGTCCAGTGGAGCCCACAGATAAACGACCATCAGAGATTAA | 6954 |
| | 2 | MSKETARSAQAGVG* | 6955 | ATGTCAAGGAGATCGCAAGAGTCGCAAGCCGGAGTCGGCTAG | 6956 |
| | 3 | MLRESSSTKGG* | 6957 | ATGCTCAGGGAGTCGTTCAGCACTAAAGGAGGCTAA | 6958 |
| | 4 | MAALEK* | 6959 | ATGGCAGCGCTTGAGAAATGA | 6960 |
| hsa-mir-562 | 1 | MSPAPHSPLLTDPASQAALIAPGPL* | 6961 | ATGTCCCAGCTCCCACTCTTGCCTCTGACCGACCCGCCTCCCAGGCCGCTT ATAGCGCCGGGCCCTTGTAG | 6962 |
| | 2 | MFRTGRDGEPRES* | 6963 | ATGTTCAGGACTGGCAGGGATGGGGAGCCTCGGGAATCTTGA | 6964 |
| | 3 | MGSLGNLEGQPLNYNMSLTFALSTVIHFISFIDHREFFEFL INF* | 6965 | ATGGGGAGCCTCGGGAATCTTGAAGGGCAGCCGCTTAATTATAACATGTCCTTGACG TTTGCGCTTTTCCACAGTGATACACTTTATCTCCTTTATTGATCATGAGAGTTTTTT TTTTAATAAACTTTTAG | 6966 |
| | 4 | MGHJTHAG* | 6967 | ATGGGCGATACCCATGCAGGTTAG | 6968 |

Figure 1 (Continued)

| | | | | |
|---|---|---|---|---|
| hsa-mir-563 | 1 | MGEFDLHVERA* | 6969 | ATGGGCGAGCCGACTTGCACGTGAGAAAGCGTGA | 6970 |
| | 2 | MCPWVWGGWGAKEWDERWSRNGGRCCPPRGLQAET G* | 6971 | ATGTGCCCCTGGGTTTGGGAGGATGGGGAGCCAAGGAGTGGGATGGAGAGGTGTC ACGGAATGGGGGCGCTGCTGTCTCCCGGGAGCCTGAGACCGGAGACCGGGGTGA | 6972 |
| | 3 | MRKGRGMGGAAVLPGGCRPRPGEGRG* | 6973 | ATGAGAGGTGGTCAGGAATGGGGGGCGCTGTCTGTCCTCCCGGGGGCTGCAGGCC GAGACCGGGTGAGGGCGCGGCGGTGA | 6974 |
| | 4 | MLALWTEGRRLRSRTGCGRPIVFLPVVPIRS* | 6975 | ATGCTGGCACTCGGAACGGAAGGGCGTCGTTCTGCAGCCGACAGGTTGTGGACG CCCAATCGTTTTCTGCCCGTAGTCCAATCCGAAGCTAA | 6976 |
| hsa-mir-564 | 1 | MAERPGPPGGAVSATAYPDTPAEFPPHLQAGAMRRRF WGVPNCLCAGAFGALAAASAKLAPGSEVEPGALLVLLL RAGGRGAAGRRGAAGPAGLLGWGGGGRRAPPHPRRS VPPGPRAAGGAAVSWGGRECFASNHAKPSSSVGGKRR RGLRPLPLPGT* | 6977 | ATGGCCGAGAGGCCGGGAGCTCCGGGCGGCGCCGTGTCCGCGACCGCGTACCCTGA CACCCCCGCGGAATTCCCTCCGCAACCTCAGGCCGGTGCAATGCGCCGCCGCTTTG GGGCGTATTCAACTGCTGCTGCGGCGGCGTTCTCGCGGCCCTGCCGCCGCTCCGC CAAGCTGGCCTTCGGCAGCGAGGTCGAGCCGGGCGCTGTTGGTGCTGCTCCTGC GGGCCGGGCGTGGGGCGCGCTGGGCGCCGTGGGGCGAGGACGGCGCCCCCACGGGG GCTCTTGGGGTGGGCGGGGCGGGCAGGGCGGCCAGGGCGCCCACCCTGCCGGTCTG CCCGGCGGGAGCTCCTAATGACGCCAAACCCTGTCAGGTAGGTGGTCAGAGAG TGTTTCGCCTCTAATCACGCCAAACCCTGTCAGGTAGGTGGTCAGAGAG GGACTGAGGCGCTCTTCCCTTACCAGGGACCTAA | 6978 |
| | 2 | MTSLPHYQENWEFGH* | 6979 | ATGACCAGTCTGCCCACTACCAAGAGAAATTGGAGTTTGGATACTGTAG | 6980 |
| | 3 | MLQVSPLGVVHGVSGRK* | 6981 | ATGCTTCAGGTAGTATCCATTGGGGTGGTCATGGGGTAAGTTCATGGGTCGAAAGTAA | 6982 |
| | 4 | MNNFVWAVKFVVRN* | 6983 | ATGAATAACTTTGTATGGGCGGTGAAGTTTGTTGTCAGGAACTAG | 6984 |
| hsa-mir-566 | 1 | MARAGARALGC* | 6985 | ATGGCCCGAGCTGGGCGGGGGCTCTAG | 6986 |
| | 2 | MAPGGR* | 6987 | ATGGCCCCTGGGGGCGCTAG | 6988 |
| | 3 | MDVWMMWPAGSPMCKATESCKYLGGCSRTPPPSRFW SGSSDPPSASALSPINARGSALPRRCACPTSVSLLEDWPA RREAVYWQSPRGGSPTSAEWEDLQS* | 6989 | ATGGATGTGTGGATGATGTGGCCTGCGGGTCACCCATGTGCAAAGCAACTTTTCC TGCAAGGTTCTGGGTGCGGTCTCTGCCTCAGCTCTTCCATACACCCCCACCTTCACGCTTCGAACGGGG AGTTCCGATCCCTCCTTCGCCTTGCCCTGCCATTAACGCCAGCGCAGCGCTC TTCCCGTAGATGCGCTTGCCTATCCTACTGCAGTGTCTCTACTTGAGGACTGCCAGCC GAAGGAAGCGGTATACTGGCAGTCCCACGTGGGGGGTCTCCACATCAGCAGAG TGGGAGGAGCCTGCCTACTCAGTCTCTACTCGA | 6990 |
| | 4 | MRLPYLSVST* | 6991 | ATGCGCTTGCCTACCTCAGTGTCTCTACTGA | 6992 |
| hsa-mir-567 | 1 | MDLAQPSQPYDELELSVLERQPEENTPLNGADKVFPSL DEEVPPAEVRSPWRWP* | 6993 | ATGGACCTGGCCCAACCTCACAGCAGTAGACGAGCTGGAGCTCGGTGCTCGA GCGGCAGCCAGAAGAGAACACGCCTCTCAATGTGCCGACAAGGTCTTCCCTTCTTT GGACGAGGAGGTCCCCCGGCCGAGGTAAGGTCCCTGGCGCTGGCCTAA | 6994 |
| | 2 | MVPTRSSLLWTRRSPRPR* | 6995 | ATGGTGCCGACAAGGTCTCTCCCCTTCTTTGGACGAGGAGGTCCCCGGCCGAGGTAA | 6996 |
| | 3 | MEPSHRDTFRPEQSPPQPLGSSNPSDPRGALGILVVRCG RCCLQRGIPEMEVVP* | 6997 | ATGGAGCCAGTCACGCGACACCCTTCGGCCGACACTTCGGCCGACAGTCCTCCCCCAGCCCTG GGGTCCTCCAACCCTCTGACCCCGAGGCGCTTAGGAATCCTAGTGTGAGGTGT GGCCGCGTCTGTCTTCAGAGAGGTATTCCGGAGATCGAAGTAGTTTTTAA | 6998 |
| | 4 | MRMTN* | 6999 | ATGAGAATGACAAATTGA | 7000 |
| hsa-mir-568 | 1 | MLQKALPSLYVCNMCKRV* | 7001 | ATGTTGCAGAAAGCATTGCCATCACTGTATGTGTGCAATATGTGCAAAAGAGTGTGA | 7002 |
| | 2 | MCAICAKECEIJYTSNAADLVNFHAPNMLNTYHHNMF* | 7003 | ATGTGTGCAATATGTGCAAAAGAGTGTGAAATATATATCATCAAATGCCGCGATCTG GTTAATTTCCATGCATTTAACATGCTTAATACCATCATCAATATGTTTAA | 7004 |
| | 3 | MPPIWLISMHLTCLIPTISSICFNAYFPHTIWSS* | 7005 | ATGCCGCCGATCTGGTTAATTTCCATGCATTTAACATGCTTAATACCATCATCAT CAATATGTTTAATGCATATTTCTTTCCACAATACAATATGGTCTAGTTAG | 7006 |

Figure 1 (Continued)

| | | | | |
|---|---|---|---|---|
| | 4 | MHRSFHQYGLVRKEPTSSTALLTAMFQPKTSCWGQHNES* | 7007 | ATGCATATATTCTTCCACATACAATATGGTCAGTTAGGAAAGAGCCAACATCTCCACAGCCTTACTCACTGCTATGTTCAGCTAAAACTTCTGGCCAGCACAATGAGAGTTAA | 7008 |
| hsa-mir-569 | 1 | MCLIITANASAIHAQAKKHVPFKYTHAAPAPLADRGAQPTRTAARGLEIRAGWAPGPGGPTRGGSGSGAVGLGWAGEAGPGASGATPA* | 7009 | ATGTGTCTCATTATAACAGCCAATCAGCCGCCATCCACGCACAAGCAAAGAAGCATCCCACCACCGCCGTCTCCAGCAGCCCTTAGCGATCGGGCTCGGGCTCGCTCAGGCTGGACCGACCGCGGAGGATCCGGAGGCTGGGGCTGGGGGTGGGCGGGGGAGTCTGGGCCTGGGGCCCTCTGGCGCGACACCCGCATGA | 7010 |
| | 2 | MQPPSTHKQRSMSHLNTPTQPQRP* | 7011 | ATGCAGCCGCCATCACGCACAAGCAAAGAAGCATGTCCATTTAAATACACCACGCAGCCCCAGCGCCCTTAG | 7012 |
| | 3 | MRTRYK* | 7013 | ATGAGGACGCGAGTGAAATAG | 7014 |
| | 4 | MASDSPARSLDEIDLSALRVSRTFSGFFPVYWVRVNGLGAWTGGWGWGRGTAAGHECVGEGTWIPVLIRGC* | 7015 | ATGGCGAGCGACTCCCCGCTCGATGAAATAGATCTCTCGGCTCTGAGGGTGAGCAGGACGTTTCGTGTTTCTTCAGTCGTTTGGGTTAGGGTGAATGGCTGGTTGCGTGACTGGGCGCTTGGGCGCAGGGGAGCAGCAGCGGGAGAATGCGTCGGGGAGGGAACCTGGATTCCGTTTGATTCGGGGTTGCTGA | 7016 |
| hsa-mir-570 | 1 | MTQWSTGHLTGPPAVRPVRHPLSIPLCC* | 7017 | ATGACACAGTGGAGCACTGGCATCTCACAGGTCCTCCTGCTTGTCAGGCCCGTTGCATCCCCTCTCCATTCCCCTTCTGCTAG | 7018 |
| | 2 | MNDSALYSCLGPTSPFLIRSWHSL* | 7019 | ATGAATGACTCTGCTTAGTCAGCTGCCTGGCCTTTACCAGCCCCTTCCTCATCAGATCCTGGCATTCTCTGTAG | 7020 |
| | 3 | MILL* | 7021 | ATGACTCTGCTTAG | 7022 |
| | 4 | MSWFTKLLSVIWPLATCSTSPLQGPGP* | 7023 | ATGTCATGGTTTACAAAGCTGTCAGTGATCTGGCCTTGGCCACCTGTCTACTCTCCTCTGCAGGTCCCGGACCCTAG | 7024 |
| hsa-mir-571 | 1 | MWRGSLRLATTRPRVRGFISLRSQLWEALVIRPQLSLRRSVTCGYWMHGS* | 7025 | ATGTGGCGCGGGTCTTTGCGTCTGGCTACTACCAGACCGCGGTTAGGGGCTTCATCTCTGCGGTCCAGTTGTGGGAGGCCTTGGTGATTCGGCCACAAGCTCAGCCTCCGTCGCTCTGTGACCTGCGGGATTGGATGATTGGTAGCTAA | 7026 |
| | 2 | MVSVRGRASQG* | 7027 | ATGGTGAGTGTGCGGGGACGAGCGTCCCAAGGCTGA | 7028 |
| | 3 | MAAGPSLRTESPLPLPLSPGASVPSGEGPGLLSVPAQRLWPSLQPSLCCSSAPAAPHLPQAVG* | 7029 | ATGGCCGCGGGACCGAGTCTGCGAACGGAGTCCCCGCTCCCGCTTCCGCTCAGCCTGGGGCCTCAGTACCCTCCGGTGAGGGACCTGGGCCTCTCGGTCCCGTCGGCACAGCGGCTCTGGCCCAGCCTCTGCTGCCGCTCCAGCCCGCCACCTTCCCCAGGCTGTCGGGTGA | 7030 |
| | 4 | MPAWEELWEKLWSGDPVPALPCSE* | 7031 | ATGCCGGCGTGGGAAGAAGCTGTGGAAGCTGTGGTCTGGGAGATCCGGTCCCTGCTTTACCCTGTTCGAATGA | 7032 |
| hsa-mir-572 | 1 | MAWEREBJAL* | 7033 | ATGGCTTGGGAAAGGAGGAGAAATAGCCCTTTAA | 7034 |
| | 2 | MQSLNDIQLEDVINTSYGRETRLGKFPACRENH* | 7035 | ATGCAAATCTTTGAATGACATACAATTGGAAGATGTCATAAATACCAGTTACGGCAGAGAGACCAGGCTGGGTAAATTCCCAGCATGCAGAGAAATCACTGA | 7036 |
| | 3 | MTYNWKMS* | 7037 | ATGACATACAATTGGAAGATGTCATAA | 7038 |
| | 4 | MQRKSLSSLLLSPFGTH* | 7039 | ATGCAGAGAAAATCACTGAGCAGCTACTCCTACTCAGCCCTTTGAACTCACTAA | 7040 |
| hsa-mir-573 | 1 | MVSVLGKKRAK* | 7041 | ATGGTGTCGGTCGTGGCGAAGAAAAGGCAAAATAG | 7042 |
| | 2 | MTSLNIFSLQFPHCN* | 7043 | ATGACAACATTTCTCAACATTTTCTACTTCAGTTTCCTCACTGA | 7044 |
| | 3 | MNRIS* | 7045 | ATGAATAGGATTTCCTAA | 7046 |
| | 4 | MESEGLQYLPNSRSEEGKATGRGRRPKKGRTNEAAGGTGVPAFGRRARAPRSHAHSHARTLRKRARAQAPSSPPPE* | 7047 | ATGGAAAGTGAAGGTTCCTCAGGTTCTTCCTAACAGCCGCTCCGAGGAGGGAAAGCTTACAGGAAGAGAGGAGGAGGAGACCCAAGAAAGGTCGGACAATAGGCAGCGGCGGACAGGAGTTCCCGCCGTTTGGGCGTCGTGCGCGCGAATGCCTCCGCTCACACGCACACTCGCACCGCCAGCCCCAGGCCCTGTCGGCCGCCGCCATTTTAG | 7048 |

| | | | | |
|---|---|---|---|---|
| | 3 | MLYKCNCNPDPYRPQELSLPLRLLKLLEFACSV* | 7069 | ATGCTATATAAGTGTAACTGTAACCTGACCCAGTTGGCCTCAAGAACTGTCATTG CCGCTGCGGCTGCTGCTCAAGCTTTTGGAGTTGCTTGTAGTGTTGA | 7070 |
| | 4 | MKKRARVGPALRQGLHTGSSQMQHESRFHIKVVGF* | 7071 | ATGAAAAAACGTGCCAGAGTTGGCCCTGCTTGAGGCAGGCCTTCATACAGGCAG CAGCCAAATGCAGCACGAAAGCCGTTTCATATTAAGGTCGTGGGCTTTTAG | 7072 |
| hsa-mir-577 | 1 | MPQPGELEALAVRGE* | 7073 | ATGCCCCAGCCCGGGGAGCTGGAGGCGCTCGCAGTTCAGAGGCGAGTGA | 7074 |
| | 2 | MAAVQGRGGN* | 7075 | ATGGCTGCTGTCCAGGGGCGCGGGGGGTGGGAATTAG | 7076 |
| | 3 | MASVRGFSRVCALKAEGGTYNGEAIRPRTLYLTPEGMGT AEPRGQSQLPGQGWRWGTRRSFGTSSTPLYSVFPLRRN KSGMCWGWGMSWGCTSSLRLFGARRFVPARLSTMDS VQRWWQGFTGPRADLGMVRGALALEKPVRAPGIREEVS ACGRGEKDALLAKRRAPSMDWRSKGEGAWYVCFGFEG GKPHRRVQVDAVRRGKRIT* | 7077 | ATGGCATCCGTTCGAGGGTTCTCTCGCGTTGTGCGCTCAAGGCAGAGGGAGGGTAT AACGGGGAGGCGATTCGGCCGAGGACTCTGTACTTGACCCTGAAGGGATGGGCAC CGGGAGGAGTTCGGGACCTTCAACTCCGTTACTCGCCCTTCCCCTAAGGAGG AGGAGAGCTTCGGGGACCAGCAGCTCCAACGCCCGTCTTCCCCTAAGGAGG AACAAGAGCGGGATGTGTTGGGGTGCGGGAATGTCTTGGGCGTACAAGCTCGCT GAGACTTTTCGGAGGCCGCGTTTCGGGTGCCCGCGACTCTGACAATGGACAG TGTACAGTGGTGGCAGGGTTTCACGGGGCCGATTTGGGAATGGTACGGG GTGCCCTTGCATTAGAGAGAGAAGTCAGTGCCGGTGCTGGCAAAAGAAGGGCGCTTCAT GGACTGCGGGCGAGGGAGCCGCGTGGATGGCAAAGAAGGGCGCTTCAT AACCGCATCGGAGAGTGCAAGTAGATGCAGTGCGTCGGGCAAAGGACAATCTGA | 7078 |
| | 4 | MEVGDQEELRDLFNSPLLRLPPKEEQERDVLGVGNVLG LYKLAETFRGPFPRARATLDNGQCTVVAGFHGSPRRF GNGTGCPCIREACAGPRD* | 7079 | ATGGAGGTGGGGGACCAAGAGGAGCTTCGGGACCTTTTCAACTCCCCTTTACTCGT CTTCCCCCTAAGGAGGAAGAACAAGAGCGGGATGTGTTGGGGGTGGGGAATGTCTTGGG CTGTACAAGCTCGCTGAGACTTTTCGGGCCATTTCCGCGTTCCGCCGCGAC TCTGACAATGGACAGTGTACAGTGGTGGCAGGGTTTCACGGTCATCCGGGATT TGGGAATGGTACGGGGTGCCCTTGCATTAGAGAAGCCTGTGCGGGCCCGGGATT AG | 7080 |
| | 1 | MAGRGGSALLALCGALAACGWLLGAEAQEPGAPAAG MRRRRRLQQEDGISFEYHRYPELREALVSVWLQCTAIS RIYTVGRSFEGRELLVIELSDNPGVHEPGKGAAP* | 7081 | ATGGCCGGGCGGGGCGAGCGGCAGGCGCTCGGCCTCGTGCGGGCACTGGCTGCCTG CGGGGTGGCTCCTGGGCGGCCGCTGCAGAGCCGCAAGAGGACGGCCATCCTTCGAGTACCACCGCTAC CCCGAGCTGCGCGAGGCGCTCGTGTCCGTGTGGCTGCAGTGCACCGCATCAGCAG GATTTACACGGTGGGGCGCAGTCTGGGAGCGCCTGGTCATCGAGCTGT CCGACAACCCTGGCGTCCATGAGCCTGGTAAGGCGCTGCCCCTGA | 7082 |
| | 2 | MSLVRALPPDSPGHPEGGGRGWDWRWGKEGGMGP GVPLGKRYLRWKVGSGGRIDNGNGEEPDLERQWPNFCFP VPSPQHQSHLPRP* | 7083 | ATGAGCCTGGTAAGGCGTGGGACTGGTGGCGGTGGGGAGGCAGGGGCATCCGGAGGGGG CGGCAGGAGCTGGGACTGGTGGCGGTGGGGAAGGAGGGGAGGGGATGGGGCCAGGG GTGCCCCTTGGTCAAAAGGTATCTAAGGTGGGAAGGTGGAAGGTGGAAGGGGATGG AAATGGGAAGAAAACCGACTTAGAGCGCCAGTGGCCCAATTTCTGCTTTCCGTCCC ATCCCCCAGCACCAATCCATCTCCCCAGACCTTAG | 7084 |
| hsa-mir-578 | 3 | MEMGKNPT* | 7085 | ATGGAAAATGGGGAAGAAACCCGACTTAG | 7086 |
| | 4 | MGGIAIQKKQHLTHATPAVALTILCIEKPKGMIASPPQGG LVFLADKSRKIRCRRQ* | 7087 | ATGGGGGGGATAGCAATACAGAAAAAACAATCTGACGCACGCAACCCAGCGGT CGCTCTCACTTTGCTGTGTGAAAAAACCAAAGGAATGATTGCCAGTCCCCGAAGG GGGGTTGGTCTTCTTCGTGCTGCTTGACAAGAGTAGAAAGATAAGGTCAGAAGGCAGTGA | 7088 |
| | 1 | MPSTGAPAQCCGRRRRSVLR* | 7089 | ATGCCGAGCACAGGCGCGCCTGGCACGGCGGTCGGCAGTGCGGAGGCGGTCTGTTCTCCG CTGA | 7090 |

Figure 1 (Continued)

| | | | | |
|---|---|---|---|---|
| hsa-mir-579 | 2 | MIPCPYVSFTYGFSNVAREASARPPWPRLAGSRGGW GRLRGGGGRHPGVRVSEGVRGGRGRRRGHLGPARRA ALTAPLSFSPCPPSASRLLCVSCPAMGPDSSCPPQCPAG WGKMPKWRPATTLDSPTAGRRRRRLRPWKGNGILPSLC SPLALIPSVRHLSMRRPRARPQPSQSPGPLQAWPGPARRP LPPRPAPPRLARPGPARGGERPPVGGR* | 7091 | ATGATTCCCATATGCCCTGAGTTCTTCACCTATGGTAGTCTAATGTGCCGCGG AGGCCTCTGCCCGGCCCCCTGGCCCCGGAGGGCAGCCGCCGGGGGGTTGG GGCAGGCTCCGGGAGGAGGGGCGGACGCCACCGGGGGTGCGAGTGAGGG GAGTGCGAGGGGGGAGGCGGGACGGCGGCGGCGGCCTGGGCCCCGCAGGGC GCTCTCACGGCGCCGCCTCTCTCCTGCCCTCTGCCCGCCGCGTCCGACTCCTC TGTGTCTCTTGTCCCGCCATGGAGACCGACTCTTGTCCCGCCGACTATTCACCACAGCC GGCTGGGGAAGATGCCAAATGCGACCGGCAACTACTTTGATTCACCAGCC GGGGCGGCGGCGGCGGCTGCGGCCAATATAGGTAACGCATCCTGCCTTCTC TCTGTTCGCCCCTTGCTCTCCCTCGGTCCTGACGGATCCTGATGCGACGCCCGGGGC CGGTCCCCAGCCATCGCAGAGCCCGACCCCTGCAGGCCTGCCAGGCCGCAGCCG CGGGCCTCTGCCGCCCCCAGTGGGGGAGGTAG | 7092 |
| | 3 | MPCSFHL.W* | 7093 | ATGCCCTGTAGTTCTTCACCTATGGTGA | 7094 |
| | 4 | MVSLMWPARPLPGPLPGPGQRGAAGYGAGSGEEAAAA TRACE* | 7095 | ATGGTGAGTCTAATGTGGCCGCAGCCCTCTGCCGGCCCCCTGGCCCCGGG CAGCGGCACCGGCGGGGGGTTGGGGCAGGCTCCGGGAGGAGGCGGCGGCCGCGCCA CCCGGGCGTGCGAGTGA | 7096 |
| hsa-mir-580 | 1 | MSAAGL* | 7097 | ATGTCAGCGCTGGACTGTAG | 7098 |
| | 2 | MPLQP* | 7099 | ATGCCCTTGCAGCCTTGA | 7100 |
| | 3 | MGINERTVFGNELYPCTQGASSKAIWLLAVAQLATCVC VAA* | 7101 | ATGGGAATAAATGAAAGGACTGTATTTGCAACGAGCTTTACCGTGCACGCAGGG GGCCTCCAGCAAAGCCATTTGGTTGCTGCTCAGCTGGCTACGTGTGTTG CGTCGCGCCTAA | 7102 |
| | 4 | MKGLYFATSFTRARRGPPAKPPGCLLSLSWLRVFASPPK SELLSAYLC* | 7103 | ATGAAAGGACTGTATTTTGCAACGAGCTTTACCGTGCACGCAGGAGGGCCTCCAGCA AAGCCATTTGGTTGCTGCTCAGCTGGCTACGTGTTTGCGTCGCGCCT AAAAGCGAGCTGCTTTCAGCTATCTCTGCTGA | 7104 |
| | 1 | MSTLLSRCPPAWPIAAPLV* | 7105 | ATGAGCACGCTTCTTCCTTCCCTCGCCCGCCAATCGCCGCGCCCCTGTGT AA | 7106 |
| hsa-mir-581 | 2 | MSDLRITEAFLYMDYLVGAGQGWHVASRISACPMAPC LEEQPFCFLSLG* | 7107 | ATGTCTGATCTCCGAATAACTGAGACGTTTCTGTACATGGATATCTGGTAGGTGCA GGGCAGGGGTGCATGCGCCTCCGATCTCGGCGTCCGATGGCCCCTGCCTT GAGGAGCAGCTTTTTGCCTTTCTTCTTGGGATAG | 7108 |
| | 3 | MSPLGSRRARWPPALRSSLFAFFLWDRMPLGPFLPQPAG KPFPGLGGAASRAGGWWS* | 7109 | ATGTCGCCTCTCGTTCTTCTTTGGGATAGGATGCCTCTGGGGTTCTTCTCCCGCAGCCGGCTG GTAAGCCTTTCCCGGACTCGGAGGGGCAGCCTCCAGGGGGTGGTGGAGC TGA | 7110 |
| | 4 | MGRPRJRRVPCPRSASWLPSALSAEDFLSGGAGVFLSPW SRTPGAIKEP* | 7111 | ATGGGGCGGCCGCGGCGGCGGCGGCACTTTCTTCCGGGGAGCAGGAGTTTCTTCCCCTGG AGCAGAACTCCAGGTGCTATTAAAAGAGCCATAA | 7112 |
| | 1 | MAQGTSPDTLTVPEVEDNPHCPNPWLNEDLVKSLRENLL QHEKSKTARKSVSPKLSPVISPRNSPRLLRRMLLSSNPK QRRFTVAHTW* | 7113 | ATGGCTCAGCAGCAGCAAGCCCGGACACTTAACAGTACCTGAAGTGGATAATCGCAT TGTTCCAAACCCGGTCGTCAAACGAAAGCCTTGTGAAATCCTTGCGAGAAACCTGTTG CAGCATGAGAAGTCCAAGACAGCTCGAAGACCTTCTGGTTCTCCAAGCTCTCTCAGTG ATCTCCGAGAAATTCCCCAGCCTTCTCGCAGAATGCTTCTCAGCAACATC CCCAAACAGGCGTTTCACGGTGCACATACATGGTAA | 7114 |
| hsa-mir-582 | 2 | MRSPRQRGNRFLPSSLQ* | 7115 | ATGAGAAGTCCAAGACAGGAGGAAATGGTTTCTCCAAGCTCTCTCCAGTGA | 7116 |
| | 3 | MVRFAQTSQKWWPFFRESCSRAFNFGGREGGPSSFLT GDLWPSDLP* | 7117 | ATGGTAAGGTTTGCGCAGACCTCGCAGAAATGTGGCCGTTTCCCTTCAGGAGTCC TGCTCTCGCGCCTTTAATTTGGGGGTAGGGAGGAGGAGGACCATCATTCCTCACC GGGGATTTATGCCAAGTGATCTCCCTTAA | 7118 |
| | 4 | MVAVSLQGVLLSRL* | 7119 | ATGGTGCCGTTCCCTTCAGGAGTCCTGCTCTCGCGCCTTTAA | 7120 |

Figure 1 (Continued)

| | | | | | |
|---|---|---|---|---|---|
| hsa-mir-582 | 1 | MPLS* | 7121 | ATGTTCTGTCCTAA | 7122 |
| | 2 | MPWEGVIVSRKY* | 7123 | ATGCCCTGGAGGAGTGATTGTAAGTAGAAAATACTGA | 7124 |
| | 3 | MIRF* | 7125 | ATGATTCGTTTTTAA | 7126 |
| | 4 | MCRFKTMNLKASKNWQGYSSFVP* | 7127 | ATGTGTATCAAGTTCAAGACGATGAATCTTAAAGTTCTTAAGAACTGGCAGGGTTAT TCCAGCTTGTGCCATGA | 7128 |
| hsa-mir-583 | 1 | MSDVTSGRLG* | 7129 | ATGTCTGACGTCACGTCTGGTCGTCTTGGCTAG | 7130 |
| | 2 | MAVTK* | 7131 | ATGGCCGTGACCAAATAA | 7132 |
| | 3 | MPFVWWAWYNRELSFVFPTCPVVILWDHNWWG* | 7133 | ATGCCTTTCGTATGTGGGCATGTATAATAGAATTGAGTTCGAGGTCTTTCCT ACGCCATGCCTGTTGTGATTCTCTGGGATCACAACTGGTGGGGATGA | 7134 |
| | 4 | MVGMV* | 7135 | ATGGTGGCATGGTATAA | 7136 |
| hsa-mir-584 | 1 | MVHTWVAASASPGSGV* | 7137 | ATGGTACACACATGGTGGCTGCTTCTGCATCCCAGGGAGGCGAGTCGA | 7138 |
| | 2 | MGGFCFPRERSLTRGPGEFPRGPLACGLAKVDGPVEA QGPAGLEKLFSQRWGDDCAFWLPLLPPWVSVCHAGSV KREQSLEASFS* | 7139 | ATGGGTGGCTGCTTCCCAGGGAGCGAGTCTGACCGGGCTGAGCTGATGGAGTC TGTTTCCCAGGGGCCTTGCCGTGGTTGGCCAAAGTGGATGGTCAGTAGAGG CTCAGGACACTGCTGGGTTGGAGAACTTTCTCCAAAGATGGAGATGATTGTG CTTCTGGCTGCCTCCTCCTCCTGGTAAGTGTTGTCATGGCTGGCTCTGTAAA AGGGAGCAAAGCTGAAGCATCTATTTTTCCTGA | 7140 |
| | 3 | MIVLSKCLSFLPG* | 7141 | ATGATTGTCTTTCTGGCTGCTCCTCTTCCTGGGTAA | 7142 |
| | 4 | MLAL* | 7143 | ATGCTGCTCTGTAA | 7144 |
| hsa-mir-585 | 1 | MRSGAAPAPPMELLLPPPPGAPRSARAPCA* | 7145 | ATGCCCAGCGGGGCAGCCCCCGCTCCGCCGATGGAGCTGCTGTTGCTGCCGCCT GCCGCCCGAGCCCGGGTGCAGCAGGGCCCCGCTGCCGCCTGCGCTGCTGA | 7146 |
| | 2 | MAPGWAGVGAAVRARLALALASVLSGPPAVACPTK CTCSAASVDCHGLGLRAVPRGIPRNAERL* | 7147 | ATGGCCCCCGGGTGGCGAGCGGTCCTGAGCTGCGGTCCTGAGCTGCCCGCTGGC CTTGGCCTGCTGGCGAGCGTCCTGAGTGGGCCTCCAGCCGTCGCCTGCCCAAGTG TACCTGCTCCGCTCCACGGGCTGCCAACGCTGGAGCGCTGTGA | 7148 |
| | 3 | MQSLFSSLPGYDPSLSELGVCRLGQIWKERSRMPQRWA KSSASPGVRVPDAGPADSFQQVAEERRGEARALQPOGL RVRVRGLRSLKRGAGEGESYRMMGRQGAEAGERARD C* | 7149 | ATGCAGTCGCTATTCTCATCCTCACCTGGATACGATCCGAGCTCCGAGCTGGGG TCTGTAGGCTGTGGTCAGATCTGGAAAGAGAGGTCTCAGACGCCAGGGATGGCA AAGAGCAGTGCCTCTCAGGGGTGAGGGTTCAGACGCCCGCTGACAGCTT CCAAGGAGTAGCTGAGGAGGCGAGGGAGGCAAGAGCACTGCAGCCTCAAGGT CTTAGGGTGAGGGTCAGGGGTCAGGGGCCGTCAGGCCGTGTAAAAGGGGCGCGGGCGAAGGAGA AAGCTATAGGGATGAGGGGCCCGAGGCGCGGAGAGGCCCGAGAC TGTTGA | 7150 |
| | 4 | MGKEQCLSRGEGSRRRAR* | 7151 | ATGGGCAAAGAGCAGTGCCTCTCCAGGGTGAGGTTCAGACGCAGGGCCCGCTGA | 7152 |
| hsa-mir-586 | 1 | MARREKS* | 7153 | ATGGCACGCAGAGAGAAGAGTTAG | 7154 |
| | 2 | MAHL* | 7155 | ATGGCGCATCTTATAG | 7156 |
| | 3 | MRKYTLNA* | 7157 | ATGAGAAATACACGTAAACGCTTAG | 7158 |
| | 4 | MTVTLFSQRIRTLGLTRESEVMKTVICNI* | 7159 | ATGACTGTGACCTTATTTCTCAGAGAATCAGGACACTTGGTCTCACACGTGAGAGT GAAGTTATGAAGACAGTGATATGTAATATTTGA | 7160 |
| hsa-mir-587 | 1 | MMRNTCGA* | 7161 | ATGATGAGAAACACTTGTGGGCGTGA | 7162 |
| | 2 | MRKRGRWASPWMRRGHHDARLTSAIE* | 7163 | ATGAGGAAGAGAGGAAGGTGGCGAGGCCCTGGATGAGAAGGGCCACCACGATG CCAGGCTCACCTCTGCCATTGAATAG | 7164 |
| | 3 | MPGSPLNSCSVTPHSLQSNLLIIYSSPSQTTNLGRKQG* | 7165 | ATGCCAGGCTCACCTCTGAATAGCTGCTCGGTGACTCCTCACAGTCTGCAA AGCAACCTCCTTATAATCTATAGCTCACCAAGTCAGACTACCAATTAGGACGTAAA CAAGGCTGA | 7166 |

Figure 1 (Continued)

| | | | | |
|---|---|---|---|---|
| | 4 | MTATLKDSSGQLEDHSLWLLPQLYLPLGIVTI* | 7167 | ATGACAGCCACACTTAAGGACAGCAGCGGGCAGCTGGAGGATCATTCCCTCTGGCT GCTCCCCAGCTGTATTTACCTCTGGCATAGTGACTATCTAA | 7168 |
| hsa-mir-588 | 1 | MKRPKIRSNEIT* | 7169 | ATGAAAAGACCTAAGATAAGATCAAATGAAATTCTTAACGTAG | 7170 |
| | 2 | MKLRRSVkFLTVSI* | 7171 | ATGAAAATTACGTAGAAGGTGTAAAATTCTTAACTGTAGTATCGA | 7172 |
| | 3 | MHSLLGRHGISAVGHLRHHKLLFVGBRDSIE* | 7173 | ATGCATTCCTGCTAGGAAGGCATGCATTAGTGCTGCGGAATCCTGATAAAACAT CACAAACTTCTGTTCGTTGGTATTAGGGACAGTATAGAGTGA | 7174 |
| | 4 | MALVLSES* | 7175 | ATGGCCATTAGHGTCGTGCGGAATCCTGA | 7176 |
| | 1 | MAAA* | 7177 | ATGGCGGCGGCCTAG | 7178 |
| | 2 | MASSGEVLSATVSALLLPRRPRSPWVLPSRPGFPCILSIP TPTPRRPSHPDPGLAPAPVLPASCPQDSYPVSEGTSCLPL RSCIPDRQSCPRLSVP* | 7179 | ATGGCCAGCTCCGGAGAGGTACTGTCCGGACTGTCTCCGCTCTGCTTCTGCCTCGG CGGGACTCCGGTTCCTCCGGGTTCCTACGACCGGGTCCGCCTCCGCATCCTTCTA TCCCGAACCCCTACCCGCCGCTGTGTCCCAAGACTCTACCTCTCGCCTTGCCCTGCTCC CGTCCTTCCCGCATCCTCTGTCCCAAGACTCTACCTGTCGATCGCCAGAGGCACAAGCTG TCTCCCCCTTGCCTCGTGCATGCCAGAGTTGTCCCGTCTCAGAGTTGTCCCGTCCCCC TGA | 7180 |
| hsa-mir-589 | 3 | MLSFSPSPLLPGACLLNDVGGG* | 7181 | ATGCTCAGTTTCAGCCCGTCCTGAGCCTGCTTGCTGAATGACGTG GGGGTGGGTGA | 7182 |
| | 4 | MTWGVGDGGKAISPEGLTTYPGILSQHSPNLGPMEKPA ASL* | 7183 | ATGACGTGGGGGGTGGGTGATGAGAAAAGCCATTCACTGAGGGACTTACGAC GTACCCGGAATTCTTCCAACACTCCCAAATCTGGGTCGATGGAGAAGCCGGC CGGTCCCTGTAA | 7184 |
| | 1 | MADFDTYDDRAYSSPGGGRG* | 7185 | ATGGCGGAGACTTCGACACTTACGACGATCGGGCTTACACGCAGTTCGGCGGGGGCCAG AGGGTGA | 7186 |
| | 2 | MARSFGRRRLGSRGLACGADPFHCLPPTTTCWFLPCL GRGGADARRRAPASSSPIPPTVGPVRG* | 7187 | ATGGCGCGGCTCGGAGACGGCGGGGCGGGGCTCCCGGGGTCTTCCTGCGG GGCGGATCCCTTCCACTGCCTCCGCCAACGACACCGTGTTGGTTTTGCCCTGCCTT GGCCTCGCGGCGCCCGATGCCGGAGACGGAGGCGCCGCCCATCCCCCC TACGGTAGGACCAGTGCGGGGCTGA | 7188 |
| hsa-mir-590 | 3 | MPGDERPLPAPSPLR* | 7189 | ATGCCGGGAGACGAGCGCCCGCTTCCAGCCTCCCCATCCCGCTACGGTAG | 7190 |
| | 4 | MVRLLAGGGRPRR* | 7191 | ATGGTACTCCTTGCGGGCGGAGGCGAACCAAGGAGATAA | 7192 |
| | 1 | MGGQHPHDPRRREGVGRQARNARCLAVSPPPPPPGL EVSRPGPKRQPASQWVPQSPATGANHGGRQGNRGPEA GGSAPAGSAWGCERLGRSRVWVGATGGAKWGAGQPF HLAAGGRGPLLPGSTGGRCRDRGPTSQRKLCGPDTPT WPGREVGA* | 7193 | ATGGGCGGGCAGCACCCGCACGATCCACATGACCCTCGCCGCGGAGGGTGGGAGGCAGG CCAGGAACGAGCCGCCAACGGACGCCAGCCAGTCAGTGGGTCCCGCA CTAGAAAGTGAGCCGCCAACGGACGCCAGCCAGTCAGTGGGTCCCGCA GTCGCCGCAACGGGCGAATCATGGCGGCGCCACAAGGTAACCGCGGGCCGAGG CCGGGGGAGCCAGCCTGCCTGCCGGATCAGCTGGGGTGCGAGAGCTCGGCGCTCA CGTGTCTGGTTGGTGCCACAGGGAGGCGAAATGGGGTGCGGCAGCCGTTCCA CCTTGCGCTGCTGCGAGGAGGGCCACTCTCCCGGCCACGCAGGCGGGTCGGT GCAGAGACCGAGGCCCGACCTGCAGCGGGAAACTTTGTGGGCGGCCGCCCACT TGGCCGGGAGGGGAAGTTGGTGCCTGA | 7194 |
| | 2 | MTRAGGRAWGGRPGTHAAWPYRRPHRRRRRD* | 7195 | ATGACCCGCGCCGCGGCGGGGAGGCGTGGGGAGGCAGGCCAGGAAACGCACGCTGCCT GGCCGTATCGCGCCGCCGCCGCCGCGGGACTAG | 7196 |

Figure 1 (Continued)

| | | | | |
|---|---|---|---|---|
| hsa-mir-591 | 3 | MAAAKVTAGPRPGGARLPDQRGGARGSGAHVSGLVPQ AEQNGYVPGSKSTLRLLEGGHSSRAAQAVGAETEARPR SGNFVGRTLPLGERGGKLVPDGAEPGPTRRSGRDWGLV HPGPASAGGPLYLPSALLLLTPLVVDSGFFQGPEPGLKP DPITFQGHLRPPAGGEVILTSYLETA* | 7197 | ATGGCGGCCGCCAAGGTTAACGTCGGGCGCCTGAGCCGGGGAGCGCGCCTGCCGG ATCAGCCTGGAGGGTGCAGAGGCTCGGAGGCTCACGTCTGGGTTGGTGCCACAG GCGGAGCAAATGGAGGTGCCGGGCAGCCGTTCGACCTTGCGGCTGCTGAGGGAGG GGGCCACTCCTCCGGGCAGCACAAGGCCGGTCGGTCAGAGAACCGGGCCGACCTC CAGGCGGAAACTTTGTGGGCGGAACTCCACTTGCCGGGGAGGGAAGTTGGTG CCTGACGGGCTGAGCCAGGGCCAGGGCGAGGAGCGGCGGCGACTGGGGCTGG HGCACCCTGGCCGGCAAGGCGTGGGGTCCGGCTTCCAGGGCAGAGCCGGGCTGA TCCTGACCCGGCTGGTTGTTGACTCCGGCTTCTTCCAGGGCCAGAGCCGGGCTGA AGCCTGATCTATTACGTTCAAGGGCTCCGCCTCCGGGGTGGGGAAGTTACTT TGACTTCCGTTTTGGAAACTGCCTAG | 7198 |
| hsa-mir-592 | 4 | MGCRAAVPPCGCWREGATTPPGQHRRSVQRPRPDLAAE TLWAGHSHLAGEGSWCLTLGLSQGRRGGAGATGAWCT LGRQALGVLSTFPARSCS* | 7199 | ATGGGGTGCCGGGCAGCACAGGCCGGTCGGGGCTGCAGAGACCGAGGCCCACTCC TCCCGGGCAGCACAGCGGTCGGTCGCTGCAGAGACCGAGGCCGACCTGCAGCGGAAA CTTTGTGGGGCCGGACACTCCCACTTGGCCGGGGAGGGAAGTTGGTGCCTGACGGGG CTGAGCCAGGGCCGACTGAGGAGGAGGACGGGACTGGGCTGTGCACCCTGGG CCGGCAAGGCCGTGGGGTCCTCTACCTTCCAGGCGGGCTCCTGCTCCTGA | 7200 |
| hsa-mir-592 | 1 | MPTEPPFHGP* | 7201 | ATGCCCACAGAGCCTTTCCCACATGGGCCTGA | 7202 |
| hsa-mir-592 | 2 | MGHDGSLQKVQPQVVPFLLWQE* | 7203 | ATGGGCCCTGATGTAGCCTCCAGAAGGTGCAGCCTCAGGTGGTGCCCTTTCTTCTG TGGCAAGAATAA | 7204 |
| hsa-mir-592 | 3 | MVASRRCSLRWCPFFCGKNKLWVLDCNTTCGENGMR GKAISLLPLFLPLDRQVLLDPHNDAKNSQPGVCPFHTOG WGHYFGGSLPCPRKGRERGALWGAEEGKGDSQTGGH ALCN* | 7205 | AAACTTTGGTCTTGCAGAAGTGCAGCTCAGTGGTGCCTTTCTTCTGTGGCAAGAAT AGCGGATCAGCCTCTTGCCCTTGTCTTCTCCTGGAGAAAATGTATGCGAGGAA CACAATGATGCAAAGAACTCACAGCCAGGAGTAATGCCCATTCCATACGGGTGGATG GGGACATTATTTGGGAGCTGAAAGAACGCCGGGGATCAAGGGAGAGAGAGGGGTG TTGTGGGAGCTGAAAGAAGGGAATCACAGATCACAGATGGAGGCCATGCTTTA TGCAATTGA | 7206 |
| hsa-mir-592 | 4 | MVCEGKRSASCPCFFLLTAKFYWILTMMQRTHSQEVA HESIRVDGDHILGGLFPVHAKGERGVPCGELKKEKGIHRL EAMLYAIDQENKDPDLLSNJFLGVRRJLDTCSRDTYALEQ SLTFVQALIEKDASIDVKCANGDPPIFTKPDKISGVIGAAA SSVSIMVANILRLFKVGKGIVFLTIVKEQ* | 7207 | ATGGTAGGCGAAGGAAAAGGGATCAGCTCTTTGCCCTTGTTCTTCCTTGACCGCC AAGTTCTACTGGGTGGATGGGACATTATTTGGGAGCTGAAAGAACTCACAGCCAGGAGTAFGCCAT TCCATACGGGTGGATGGGGACATTATTGGGAGCTGAAAGAAGGGATTCACAGAC TGGAGGCCATGCTTTATGCAATTGACCAGATTAACAAGGACCCTGATCTCCTTCCA ACATCACTCTGGCCCTGCTCCGCAACATTCTCGACACGTGCTCTAGGGACACCTATGCTTTGG GAGCAGTGCTTAACAATGCCAAGCCATTTCTAACGATGGTGAAGATCTTCGATGCATAGAGGT GCTGCTAATGACGATCCACCATTTCTACCCAAGCCGACAAGATTTCTGGCGATGCATAGAGT GTTCGCAGCAAGGCATTGCTTCTGTGACCATTGAAAGACAATGA TAGGTAAAGGCATTGTTTGAAAGACAATGA | 7208 |
| hsa-mir-592 | 1 | MEVKGLN* | 7209 | ATGGAGGTGAAAGGGTTAAACTGA | 7210 |
| | 2 | MKLALKC* | 7211 | ATGAAACTGGCATTGAAATGTTAA | 7212 |
| hsa-mir-593 | 3 | MLTVSAKKGLSSEEVAVEISWTVASDAPFTEWHDYGE* | 7213 | ATGTTAACAGTGTCTGCTAAAAAGGGCTTTCTCTGAGGAAGTGGCTGTTGAGATT TCCTGGACTGTTGCATCTGATGCACCTTTCACAGAATGGCATGACTATGGCGAGTAA | 7214 |
| | 4 | MHLSQNGMTMASKCPRRSTI* | 7215 | ATGCACCTTTCACAGAATGGCATGACTATGGCATGGATGAGTAAGAAGTGTCCCAGGAGATCCACC ATTTAA | 7216 |
| | 1 | MGPPLPLLLLLLLPPRVLPAAPSSVPRGRQLPGRLGE WGAPGEGRLNELVGGVVRGAPP* | 7217 | ATGGGGCCGCCGCTCCCGCTGCTGCTGCTGCTGCTGCCGCCACGCGTC CTGCCTGCCGCCCCTTCGTCCGTCCCGGGGAGACCTCCAGCTCCCGCGCCGTCTGGT GAGTGGGGGGGCCGCGGGAGGGAGCGCCTCAATGAATTAGTTGGGGGCGTGTGAG AGGGGCGCCTCCGTGA | 7218 |

Figure 1 (Continued)

| | | | | |
|---|---|---|---|---|
| hsa-mir-595 | 2 | MQGRRLNK* | 7219 | ATGCAGGGAAGGCGCCTCAATAAATGA | 7220 |
| | 3 | MSGGVGGGAPLRGSGGGTPQ* | 7221 | ATGAGTGGGGGCGTTGGGGGAGGGGCGCCTCTGAGAGGTTCTGGGGGAGGGACGCCTCAATGA | 7222 |
| | 4 | MNERGAWGEGRLNECGAWGKGRLNE* | 7223 | ATGAATGAGAGGGGCGTGGGGGAGGGGCCCTCAATGAATGCGGGGCGTGGGGGAAGGGGCGCCTCAATGAATGA | 7224 |
| hsa-mir-596 | 1 | MHRPAAHALAAEPRAACAACIGPTGRRPRGKPSVTIRA* | 7225 | ATGCACCGTCCTGCGCCACGGAGCCCCACGGAGCGCCAGCGCAGCGGAGATCCCACGGAGAAGCGTCTGTAACCATCCGAGCCTAG | 7226 |
| | 2 | MAAAALRRPTRRPIPGCCLGHCPCVPLFYFRTLIKTQTDE* | 7227 | ATGGCAGCTGCTGCCCTTCGGAGGCCGACTCGACGCCATCCGTGGTCTGTCTAGTCACTGTCCTTGTGTTTTGTTTTACTTTAGAACTCTTAAAGACACAAACCGATGAGTAG | 7228 |
| | 3 | MSRDKLTLGNGLGVYVCKAGSAVCVRNPLSSGSVLGCFL GQRPQPSYLQSILLSWRASAMAPRLYCSL* | 7229 | ATGAGTAGAGACAAACTCACACTAGGAAATGGACTGGGTGTGTTTGCAAGCGGGGAGCGCCGTCTGTGTCCGAACCCTCTGAGCTCAGGAGCGTCTCGGGTCTTTCTGGGGCAGCGGCCACAGCCGTCCACGCGGCTCATCTGCAGAGCATCTGCTTCCTGGAGGGCATCTGCGATGGCCCCAGGCTGTACTGTTCCCTGTAA | 7230 |
| | 4 | MDWVWFAKRGARSVSGTL* | 7231 | ATGGACTGGGTGTTGGTTTGCAAAGCGGCGAGCGGTCGTGTCGTGTCCGAACCCTGA | 7232 |
| hsa-mir-597 | 1 | MLIGFTVGSEGGRWGPLPQ* | 7233 | ATGCTGATTGGTTCCGACAGTCGGAAGTCGAAGGTGAGGGCCGTGTGGGGGCCGTTGCCGCAGTGA | 7234 |
| | 2 | MAASRRSQHHHHHQQQLQPAPGASAPPPPPPLSPG LAPGTTPASPTASGLAPFASPRHGLALPEGDGSRDPPDR PRSPDPVDGTSCCSTSTHCTVAAAPVVPAVSTSSAAGV APNPAGSGSNNSPSSSSSPTSSSSSSPS&PQSSLAESPEAA GVSSTAPLGPGAAGPGTGVPAVSGALRELLEACRNGDV SRVKRLVDAANYVNAKDMAGRKSSPLHFAAGQRLLNCL LRVMGLLGAGSG* | 7235 | ATGGCAGCAGTCGCGTCGCGTCAGCATCATCACCACCATCATCAACACAGCTCCAGCCCCCCAGGGGCTTCAGCGCCGCAGCCTCTCCCCGACTCTGCCGGAGGACAGCCCTGGCCTGCCCCCGGGGACCACCCCGAGCGCTGCGGAGGACAGCCCTGTGCCGGAGCAGTCGGAGCAGCCGGATCCGCCGACAGGGCCGCGATCCGTCGCCGCGCCCAACCCAGCCGGCAGTGGCCCCGCTCTCCTCCCGTCTCCCGGGTTCCCGGGGTCTCAACAATTCACCGTCGTCTACTTCATCGTCGCTGGGTCGCTCCCGACTCTTCCTCCGACGTTACGTGCGCCGCCAACCAGCCGGGGACAATCCCTCCGATCCGAGTAGCAGCAGCACAGCAGCCGGAGGCCCCGAGGCCCGCGGGAACGGCCTGCCCCGGAGCGGGACAGGGGAACTGCTGGAGCGCCTGCCAGGGAACGCGGGGGACAGGCCTGCAATGGACATGGCGCCGCAGCGGGAAGGAGGCCTGTGGTGGACAAACAAGATGCATGGCCAAATGAGCGAGTTCCTCTGGTAACGCTGCTGGGTCCGGACTTGGGTGTCCAGGGTCCCAGGGGAGCAAACGATAATGTTTGAATTGTTATTAAGGGTTATGGGTTTGGGTCAGGGTCCGGTTAG | 7236 |
| | 3 | MAVGIRPTGPDPRTRLTVPAVAVPPAQSVPSPPLPWSQR FLLHLPLGSLPTQPAVATHRRPLLPHLPLPHPPLD RAWRRAPRRPELAAQHHWGLGQQDLGQGSQQ* | 7237 | ATGGCAGTCGGGATCCGGCCGACAGGCCCGATCCGACAGGCCCGGTTGACGGTACCAGCTGTTGCAGTACCACCAGACAATCGTACCGTCGCCGCCCAACCAGCCGCAGTGGCAGTGCGGGTTTCTACTTCACCTCGCCCCTGGGTCCCTGCCCACTCAGCCCGCCGTCGCCCAACCCAGCCGCCAGTGGCAGTGAACAATTCACCGTCGTCTACTTCATCGTCCCTCCATCTCCCCTGGATCGAGCTTGCGGAGAGCCCTGAGGCCCCGGAGCTTAGCAGCACAGCAGCCGGAGGTGA | 7238 |
| | 4 | MGTCPG* | 7239 | ATGGGGACGTGTCCGGGTAA | 7240 |

Figure 1 (Continued)

| | | | | |
|---|---|---|---|---|
| hsa-mir-598 | 1 | MAAKSDGGGVGVGFAQLHNLDEAVGSGGEEDGEPGG GGCGGGDGSEPGESSSMHBCHCCNTSSCYWGCRSACL RSLLGRKPRRSAAADGGDQPLQPPAAPGAGRQPPTPSA ARPEPPPQVERPWLDCLWIVLALLVPFGDVGTDLWLA LDYYRKGIDYVYPGLTLFVLVPSLLVQSLSFRWFVQDY TGGGLGAVEGLTSRGPPMMGAGYVHGAARGGPGVRV SPTPGAQRLCRLSVWIWQSVIHLLQMGQVWR* | 7241 | ATGGCGGCGAAATCCGATGGCGGTGGCGTGGGGTGGCCTTCGCTCAGCTGCACAA CCTGGACGAGCCGGTGGGCAGCGGCGGCGAGGAGGACGGCGAGCCCGGGGAGGC GGCTGGCGGCGACGGCAGCGAGCCCGGCGAGAGCAGCAGCAGCTCGATGCACAT CTBCCACTGCTGCAACACCTCGTGCTACTGGGGCTGCCGCTCCGCCTGCCTGCG CTCCCTCCTGGGCAGGAAGCCTCGCCGGCGGAAGCCCCGCAACCCGACGCCTGCCGGCG CGCTCAGCCTGGGCGGCCCCGCGCCCCGGCCCCCCGGCGCCAACCCGACGCCTGGCCG CGGGGCCGAGCGCTGGGCTGCTGGTGTTCTTCGGGACGTGGGGACCTGTGGCTGGCC ATCGTGCTGGGGCTGCTGCCAAGGGGACTACGTCGTACCGGGCTGACCCTCTTCGTG CTCGACTACTACCGCAAGGGGACTACGTCTACCCTGGGCTGACCCTCTTCGTG CTGGTGCTCGTCGCTGGGTGCAGCCTGAGCTTCCGCTGGTTCGTGCAGGACTAC TGGGGCCGGACTAGCGGCAAGGGCTGAGGGCTCACCAGCGGGGCTCCC CCACGCGGGGGCCGCTGCCACGCGCGCAGCGCCTGTGCCCTCCGTGTGATCTGGCAGTCGGTCA TCCACCTGCTGCAGATGGGGCAGGTGTGGAGGTAA | 7242 |
| | 2 | MAVAWGWASLSCTTWTRRWAAAARRTGSPGEAAAAA AATAASPARAARCTSATAATPPRATGAAAPACAPSWA GSRAAAPPPTGGTSRCSLPRPPAPAANPRRPRPRGRSRR RRRWSGRGSTACCGSCWRCWCSSGTWAPTCGWPSTTTA RGTTSTSG* | 7243 | ATGGCGGTGGCGTGGGGGTGGCTTCGCTCAGCTGCACAACCTGAGCAGCCTGTG GGCAGCGGCGGGCAGCGAGCCCGGCAGGAGGAGCAGCTGCATCTGCACTGCTGCAAC ACCTCCTGCTGGGGCGGCCGGGAGCCGGGCTGTGCACATCGCACTGCTGCAAC AAGCCGCCGCCAGCGCCGCCAACCCGACGCCGCTGCAGCCTGCCGC GCCCCGGCCGCCGCAACCCGACCCCTGGCCTGCAGCGCCGCCGGCCGC CGGTGTTCTTCGGGACGCGTGGGCACCGTGGGGCACCGACCTGTGGCTGGCCATCGTGCTGGGGCTG CTGGTGTTCTTCGGGACGTGGGCACCGTGGGCACCGACCTGTGGCTGGCCATCGTGCTGGGGCTG AAGGGGGACTACGTCTACTTCGGGCTGA | 7244 |
| | 3 | MTPNHCFPRRKKDFFFWFAGLDVSFS* | 7245 | ATGACTCCAAACCACTGCTTCCCAGAAGGAAAAAAAGACTTTTTTTTTGGTTTG CTGGATTAGACGTCTTGTCCTTTTCTTAG | 7246 |
| | 4 | MGASVWC* | 7247 | ATGGGCGCTCGAGCGTTTGTGTTAA | 7248 |
| | 1 | MSESAA* | 7249 | ATGTCAGAATCTGCAGCTTAG | 7250 |
| | 2 | MESTGRGRKRCRGFEQNESPPLCREKGFSGSPPPC* | 7251 | ATGGAGAGTACAGGGAGGGAGGAAAGAGTGCAGAGGATTTGAACAGAATGAGA GTCTTCTCTTGCAGGAGAAAGGCTTCAGTGGGTCTCCCCTGCCTAG | 7252 |
| hsa-mir-600 | 3 | MRVLLCAGRKASVGLPLPARDPPCQPWAGRWQARSQV SRRGQERSQASGEKCLLSNLPRAIGFPLSQTGSPGGESE AGLACMHRESVPTWGV* | 7253 | ATGAGAGTCCTCCTCTGTGCCAGCAGGAAGGCCTCAGTGGGTCTCCCCTGCT AGGGATCCTCCTTGCCAGCCTGGGCTGCCAGGCCGTGTCCCAGGTCCTCC CGCCGAGGGCAGGAGAGGAGGCCAGGGTCCAGGGAGAAGTGCTTACTGAGTAATTT ACCAAGAGCGATAGGCTTCCCACTGAGGCTCACAGAGAGTGGATCCCAGGAGGGAGTCAG AGGCAGGCCTGGCATGCCATGCACAGAGAGGTGCCCACTGGGAGTGTGA | 7254 |
| | 4 | MHAQRECAHLGSVKGLAVGPERMSRVKWQVGHTVCS HFLKGPGWCVLQ* | 7255 | ATGCATGCACAGAGAGTGTGCCCACTTGGGAGTGTGAAGGGCCTGCTGTGGG ACCCGGAGAGATGAGCAGAGTCAAGTGGCAGTGGGACACACAGTCTGCAGTCACT TCTTAAAAGGCCCTGGGTGGTGTCCTTCAATGA | 7256 |
| | 1 | MAFAGLERVH* | 7257 | ATGGCGTTCGCCGGGCTGGAGCGTGAGCTGAGTACATTAA | 7258 |

Figure 1 (Continued)

| | | | | |
|---|---|---|---|---|
| hsa-mir-601 | 2 | MRRPGDHGLQDQVSAAGPGGAGPGAGRRGRARAAGR GPRGGL VAEFRGAPRVTPARGEGDGCYGDPGRRGGGV RAGWQGAGGQVSPPHLGVGTAEHTGRPPPRVYGEPLK MVLQLWGRGVGKPRKHLPMFGHVWGAPESWQVRRGC SLAA* | 7259 | ATGAGGAGGCCTGGGGACCATGAGCTCCAGGATCAAGTGAGTGCGGCGGCCGGG CGGAGCCGGGCCGGGGCACTGTTGCCGAGACCAGAGGGCGCCCCGTGACGCCGCACG CCGGCGCGGGGGACGGTTGCTATGGCGATCCAGGAGGCGCCCAGAGGAGGGCGCGGGTTCGC GGGGGGGTGGCAGGGCGCCGGAGGGTCAGGTGTCCCTCCAGGAGGCGCCTCCTCAGCTGGGGTCGAAC AGCTGAGATTACAGGCGGCGCCGGTTACGAGGAGCCCCTGAAAATGG TCCTTCAACTGTGGGGCGTCGGGGAAGGGAGTGGGAAAGCCCCTGAAAGCCACTCCCATGTT GGGCATGTTTCGGGCTGCGCCCCTGAAAGTTGGCAGGTCCGAGAGGTTGCAGCCTGGC CGCTTGA | 7260 |
| | 3 | MGSRIK* | 7261 | ATGGGCTCCAGGATCAAGTGA | 7262 |
| | 4 | MAIQGEAGAGCAARGGRAPGVRCPLLTWGSEQLRLQGG PLPGFTESP* | 7263 | ATGGCGATCCAGGGAGAGGCGGGAGGGCGGGGTGCGCGCGGGTGCAGGGCGCCGG GGGTCAGGTGTCCCTCACCTGGGGGTCCGAACAGCTGAGATTACAGGGCGGCC CCCTTCCCCGGGTTTACGGAGAGCCCCTGA | 7264 |
| hsa-mir-602 | 1 | MARGRGGATLRARAMAAADAEVSSGAGGGRRGGGGQ RRERRGGEEPGGAAAGGRRAGGAPGPPAAAAAAAAS GRGRAEAAGRPARAPAGRALCAARAGRRLLGERAGAQV REATAYLCPRPPRTPCRRRRRPQAGSAGRASARVPGRCG GQKEK* | 7265 | ATGGCGCGCGGAGGGGCGATCTCGCGCGCCGCGGCCATGGCCGCCGCCGCCG ATGCCGAGGTGAGCAGCGGCGCGCGGAGGGCGGCGGGGGGGCGTAGGCGGCCAGCGG CCGAGGGGCGGCCCGGGTCCCCCGCCGAAGAACCGGGTGGCGCGGTCAGCGGTCGCGCG GGAGGCGACCGCGTACCTGTGCCCGCGCGTACCTGTGGGGAGCGAGGGCAGGCGCAGGTTGAG CCCGCAAGCCGGATCTCCGGGAGGCCCTCGCCAGGTGGCCGGGGAGGGTCGG AGGACAAAAGGAAAGTAG | 7266 |
| | 2 | MAPSLTKSWPVPACFSHDNAAPALLAVRSRKARSVGSL RTQVYFQTSSFKGLSM* | 7267 | ATGGCACCATCTTTAACGAAAAGTTGGCCAGTCCGCGTGTTTCTCCCCAGACAAT GCTCTCCAGCCCTGCTGCAGAAGCAGAAAGCACGCTCGGTGGGAAGCTT GCGGACTTCAAGTTTATTTCCAAACCAGCAGCTTTAAAGGCTCTCGATGTAA | 7268 |
| | 3 | MLLQPCWLSEAGKHARWEACGLKHSKPAALKGSRCK KFTFFC* | 7269 | ATGCTCTTCCAGCCCTGCTGCTGTCAGAAGCAGAAAGCACGCTCGGTTGGGAAGC TTGCGGACTCAAGTTTATTTCCAAACCAGCAGCTTTAAAGGCTCTCGATGTAAAA GTTCACATCTCTTTTGTTAA | 7270 |
| | 4 | MVSAPPVLHLKDSLFPCLGKEAA* | 7271 | ATGGTCTCGGCCTTCCCGTGCTCATTCTCAAGGATAGTTGTTCCTTGCTAGGAA AGGAAGCAGCGTAG | 7272 |
| hsa-mir-603 | 1 | MRARWLQVSAEQLPYGERGEARGRQPRPEVSAAEVCV GCPAAPPARVGGTSPLLG* | 7273 | ATGAGAGGCGAGGTGGCTCCAGCAGGTCCGGGGAGCAGCTGCCAGTGGAGGAGGAG AGAGGCGAGGGGCGGCAGCGTCGGCCGAGTAAGTGCAGCAGAAGTTTGCGTCG GTTGCCCGCCCCCAGCGGAGGGGAGGCACATCTCCCTCCTTGGATAA | 7274 |
| | 2 | MGCQKEKTPNWEEGLERNRTPGISEREGCGESEGGGSH TYPGDLGVPPWSGEPGAYIGATRMLPRFSLGAAKRALL FLMAGRCQGGEREPAPRRAGGWGHWGVWSWGFGVG GLGLLRRSRLSGGGRGRGRRRM* | 7275 | ATGGGGTGCCAAAAGGAAAAGAACCCCAACTGGAGGAGGGACTGGAGAGGAACC GGACCCGGGATCTCAGAAAGGGAAGATGTGGGAGACAGGGGAAGTGGCAGCCAGGGCTTA TCACACCTATCCTATGCCTAGGATGTTGGGGACACTGTTGCCTGTTTCACCTGGAGAGGGCATT GCTTTTTCTGATGGCTGGAAGACAGGCAAGGAGAGAGAAACCGGCCCGAGACGAGAGGGAGG TTTGGGTCTTCTGAGAGCTCCGGAGGCCGGGCAGAGGTCGAGTGGAGG GGCGAATGTGA | 7276 |
| | 3 | MWGE* | 7277 | ATGTGGGGAGAGTGA | 7278 |
| | 4 | MLGAFGSWSLILVIGRFRGEIRQRPGAG* | 7279 | ATGTTTGGCGCCTTTGGCAGCTGGTCATTAATTGTCATCGGGAGGTTTCGCGGA GGGCGACAGCGCCCGGAAGCAGGGTGA | 7280 |
| | 1 | MEENESQKCEPCLPYSADRRQMQGK* | 7281 | ATGGAAGAAAATGAAAGCCAGAAATGTGAGCCGTGCCTTCCTTACTCAGCAGACAG AAGACAGATGCAGGGTAAGTAA | 7282 |

Figure 1 (Continued)

| | | | | |
|---|---|---|---|---|
| hsa-mir-603 | 2 | MKARNVSRAFLTQQTEDRCRVSNRPIQRWSYRDACPLP LAAFYKLQLWDPAKEKKKGNFLGWYIFQTE* | 7283 | ATGAAAGCCAGAAATGTGAGCCGTGCCTTCCTTACTCAGCAGAAGACAGATG CAGGGTAAGTAACGAACCATTCAAAGATGAGTTACAGGACCGTGCCCCTTGC CGCTTGCTGCTTTTATAAACTGCAGCTCTGGGACCCGCAAAGGAAAAAAAAA AAGGCAATTTCTTGGGATGTACATTTCAAACTGAGTAG | 7284 |
| | 3 | MELQGRVPLAACCPL* | 7285 | ATGGAGTTACAGGACCGTGCCCCTTGCGCTTGCTGCTTTTATAA | 7286 |
| | 4 | MVHFPN* | 7287 | ATGGTTACATTTCAAACTGA | 7288 |
| | 1 | MAGRRVARGVARQ* | 7289 | ATGGCGGGGAGGCGGGTGGCCCGGGAGTGCGCCAGTGA | 7290 |
| | 2 | MRGAPGHPSCPRPCARAGSPKGVV* | 7291 | ATGCGCGTGGTGCGCCAGGCACCCAGCTGCCCACGTTTCTGTGCGCGTGCGGGCTCC CGAAGGGAGTGGTTTAG | 7292 |
| hsa-mir-604 | 3 | MRDLYKSDSLLQ* | 7293 | ATGAGAGATCTTGTGAAGTCTGACAGTTTATTGCAATGA | 7294 |
| | 4 | MRSSSQGERPAGEIKGAPVRHPQPHPEVVITCACANPST GTRFVIEMSEAASLLRQMFLSI* | 7295 | ATGAGAAGTTCCTCACAAGGGAGAGCCAGCTGGGGAAATTAAAGGAGTCCTGT CCGCCATCCACAAATGCCAATCCGAGGTTGTGATAACTTGTGCCTGCAAACCTAG CACAGGCACGTTTGTCATAGAAATGTCAGAGGCAGCATCTCTACTGCGCCAGAT GTTTCTCAGCATCTGA | 7296 |
| | 1 | MSFLEEDFAKILMLKEERIKELEKRLSEKEEEIQELKRKL HKCQSVLPVPSTHGPRTTRAQGISAEPQTYRSFHDLRQ AFRKFTKSER* | 7297 | ATGAGCGAGCTAGAGGAAGACTTTGCCAAGATTCTCATGCTCAAGGAGGAGGAT CAAAGAGCTGGAGAAGCGGCTCTGTCAGAGAAGGAAGAAATTCAGGAGCTGAAG AGGAAACTCCACAAATGCCAGTCAGTCCTGCCCGTGCCCAGCACACATGGACCCCC CGGACCACCGGGCGCAGGGCATTCTCGGCCATCTGTGCGGGGCTACTTCACCAAGTCC GACCTCTCAGACGGCATTCCGGAAGTTCACCAAGTCCGAAAGGTAG | 7298 |
| | 2 | MPVGAPSALIDPHRPPDHPGAGHLGRAADVQVLPRPPTG IIPEVHQVRKVGAEAVGPGARPGPRRRGWGLWPRRRGR VGPGRPLLAAARGVGVAPRPGNGKCLFLFLPITCCACLR RAGKGELHGETRPCGVGVGRRTAESLLARANLCPPHM AAVARLSFVRPAGSVHAGTQPCPSRGLESSPAATPRTQA TGHAQWGCPSLLGRGDWRLDRVGLNLGTELAQNPSSA GGCGDRERRDRGLSLGQGSSLERGGEEGRGLFTGSLSR QL* | 7299 | ATGCCAGTCGGTGCTCCAGTGCTCCAGTCGCCCCTCGCGCCCCGGACCACCCGGGC GCAGGCATTCTCGGCCATCTGTGCGGGGCTACACGGTCCTCGACAGG CATTCCGGAAGTTCACCAAGTCCGAGAAGGTCCGAGACGTAGGCGCGCGGAGCCGGG CTGTCCGGCCGCAGGGCGCCGCCTCGCGCGAGGCCCGCGGGCGGGGCGGGGCGG GCCCGGGCGGAATGGAAGTTCATTTTTATTTCTGCCACATCCTGTCCCTCGTCTC GCCCGGGCTGCAGGGCAGCTAGCGGCGGGAGACCGCGCCCCTGTGCGTGCGGGGT GGGGAGGAGGAGGACCGCGGAAAGTTTACTCGCGGGCCGGGTCTGCCCTCCACACA TGGCTGCAGTGCAGCCCATCCAGCTGCCGCGGGCCGTGCACAGGTC ACCAACCTGGAACATGCTGGGCAGGTTGGGCTCAACTTAGGGACTGAACTTGCCCAGAACCCGAGCT GAGGCTGGACAGGGTTGGCTCAACTTAGGGACTGAACTTGCCCAGAACCGAGCT GGATCAGCTCGGCGATGGGCGTGGGGCGTGGGGGCGAGGAGGGCGAGACTGGGGACT TTCAAGGCAGCAGTGTGA | 7300 |
| hsa-mir-605 | 3 | MGSVYFYFCPSRAVLVSAGLGKASCTGRRAPVAWGWG GGPRKVYSRGLTCALHTWLQSRGCPSCAPLGASTQGPN PAHPGAWRASQRRPGLRPLDMLSGAVRAS* | 7301 | ATGGGAAGTGTTTATTTTATTTCTGCCATCAGCGTGCTGTGCCTGTCGCCGGGC TGGGAAAGGCAGCTGCACGGGAGGACGGCCCCTTGGCGTGGCGGGTGGGAGG AGGACCGCGGAAAGTTTACTCGCGCGAAATTGTGCCCTCACACATGGCTGCA GTCGCGCGGCTGTCTTCGTCGCAGGCTAACCTCAGGCAGGACCAGGCCTAG TGCCCATCATGCTGAGCGGGGCTGTCCGAGCTCGAGCCTCTAG | 7302 |
| | 4 | MRGQQEAGQGLVSRAGIQPGAWRGGEKFHRVTFKA AVMSARHCKETPPSGRFFALIVPLPEVQHLRLL* | 7303 | ATGCGGGGACAGGGGAGGCGGAGGCGGAGGATCCAGGGCTTGTCTCTAGGGCAGGATCCAGCC TGGAGCGTGGGGGCGAGGGGGGAGGAGTTATTCACAGGGTCACTTTCAAGGCAG TGTGATGTCAGCAAGACATTGCAAGAAACCCACCTTCTGACGTTTCTTTGCTC TGATTGTGCCTCTTCCAGAAGTTCAACACCTAAGGCTGCTCTAG | 7304 |

Figure 1 (Continued)

| | | | | |
|---|---|---|---|---|
| hsa-mir-605 | 1 | MGTLRDLQYALQEKIEELRQRDALIIDELELEDQKDELJQKLQNELDKYRSVIRPATQQAQKQSASTLQGEPRTKRQAISAEPTAFDKQDLSHVTLPFYPKSPQ* | 7305 | ATGGGCACCTTGCGGGATTTACAGTACGCGCCTCCAGGAGAAGATCGAGGAGCTGAGGCAGCGGGATGCTCTCATGCGACGAGCTGGAGCTGGAAGTTGGATCGAGAAGGACGAACTGATCAGAAGCTGCAGAACGAGCTGGACAAGTACCGCTCGGTGATCCGACCAGCCACCCAGCAGGCGCAGAAACAGAGCGCTGAGCCGGAGCCACCTTGCAGGGCGAGCGCGCACCAACGGGCAGGCGATCTCCGCGAGAAGCAGGCGATCGCGGCCAAGGATCCAAGGATCTCAGCTCAGCCATGTGACCCTGCCCCTTCTACCCTAAGAGCCCACAGTAA | 7306 |
| | 2 | MLSSTSWSWSWIRRTN* | 7307 | ATGCTCTCATCGACGAGCTGGAGTCGAGTTGGATCAGAAGGACGAACTGA | 7308 |
| | 3 | MWRPGDGELRVSVLSVGPRPSRLPCLSSSSEMFHFNGHPLRGCARFSEPDSLHRRCLRVFVRCQGHFKYTYIPV* | 7309 | ATGTGGCGCCCTGGCGATGGGGAGCTGCGGGTCTCTGTATTGTCTGTCGGCCCCGCCCTCCCGCTTGCACTGATCCTCAGAAATGTTCATTTTAACGGCACTCTGTCGGGGCTGTGCACGTTCTCAGAGCCAGATCACTGCACATACGTTGCTTCGTGTCTTTGTCAGATGTCAAGGTATTATTTTAAATATACATTCGTATAA | 7310 |
| | 4 | MGSCGSLYCLSAPAPPACHVCPHPQKCFILTGTSCGAVHVSQSQTHCTYVAFVSLSDVKVLFLNHHSYKPPSVRRV* | 7311 | ATGGGGAGCTGCGGGTCTCTGTATTGTCTGTCGGCCCCGCCCCTCCGCTTGCCATGTCTGTCCTCATCCTGCAGCCCATGGGCACTTCTTGCGGGCTGTGCACGTTCTCAGAACTCACTGCACATACGTTGCTTCGTGTCTTTGTCAGATGTCAAGGTATTATTTTAAATATACATTCGTATAAGCCACCTAGTGTACGTAGAGTTTGA | 7312 |
| hsa-mir-606 | 1 | MAAGLVVRGTQVSPGQPRLRPGRSPRGEGQRGTEAPQGLDTPVPASGGCVCRG* | 7313 | ATGGCCGGAGTCGTGGTGCGTGGGACTCAAGTAAGTCCCGGCCAGCCCGCCTCCGCCCGGGCGCAGTCCCGTGGGACGGACGGGGCACAGAGGCTCCCAGGGCCTAGACACCCCTGTCCGCCCTCAGGGGCTGCGTCTGCACAGGGGTGA | 7314 |
| | 2 | MCGKNTRKVSSRSPHFLLPLAPH* | 7315 | ATGTGCGGGAAGAACACCCGCAAGGTCTCCGTTCCCCACTTCCTCTCGCCCTTA GCGCCCTCACTGA | 7316 |
| | 3 | MFQPHNLNFKNFWSKNPF* | 7317 | ATGTTCCAATTCATAATCTGAATTTAAAAACTTTGGTCAAAGAATCATTTGA | 7318 |
| | 4 | MEEGVYEGKSV* | 7319 | ATGGAGGAAGGGTTTATGAGGCAAAAGTGTCTAG | 7320 |
| hsa-mir-607 | 1 | MQRELE* | 7321 | ATGCAAAGAGAATTAGAATAA | 7322 |
| | 2 | MELRKSTGQDYHNLKFQRLKSPAEKTNH* | 7323 | ATGGAACTCAGAAAGTCTACAGGACAGGACTACATTATAAATTTAAAAATCTTTCAAAGACTAAAAAGCCCTGCTGAAAAAACCAATCACTAA | 7324 |
| | 3 | MLLKTCYMLSSMIVRNTK* | 7325 | ATGCTTCTCAAAACTGCTATATGCTCTCTTATGATAGTCGAAATACCAAGTAA | 7326 |
| | 4 | MHNNTLKE* | 7327 | ATGCATAATAATACTTTGAAAGAATAA | 7328 |
| hsa-mir-608 | 1 | MAPDPSAKVSKARSAGGALA* | 7329 | ATGGCCCCGGATCCGAGCGCAAAGGTGAGCAAGGCGAGGAGTGCGGCGGCGCCT GGCGTGA | 7330 |
| | 2 | MTALEGRGPGLGLRGVQTGHHGVGDQRGEGAAWRTVFPRIWVTSPGVRRDRRRACPRAAAVETEVRPDEGRGPRTVQDVGRGSRGRGSLKPGETAILLGRGKYRLH* | 7331 | ATGACGGCTCTAGAGGGCCGAGGGCCGGGCCTCGGGCTGAGAGGGGTGCAAACCGGCCACCACGGAGTCGGGGACCAGCGCGGCGAGGGGGCCGCTGGCGGACAGTGTTCCCCAGGATCGGGTCACGTCCGGGCGGATCGAAGCACTGCGGAGTTGTTCTCGAGCTGCAGCAGTAGAGACTAGAGTTAGACCTGCGACGAAGGGAGGACGACCGCGGACTGTCCAGGATGTTGGAGGGGAGGGGTCTCTCAAGCCAGGAGAGACCGCCTACACTAG | 7332 |
| | 3 | MLEGGGPGGGALSSQERPPSY* | 7333 | ATGTTGGAGGGAGGGGGTCCCGGGGAGGGGCTCTCTCAAGCCAGGAGAGACCGCC ATCCTACTAG | 7334 |
| | 4 | MKVESLLLH* | 7335 | ATGAAGGTCGAGAGCCTGCTGCTGATCCTCCATTGA | 7336 |

Figure 1 (Continued)

| | | | | |
|---|---|---|---|---|
| hsa-mir-609 | 1 | MGAGLTVSGRVYTAAASRPAAPRRRKGNRPALGCCVR CLLPPEENTAHGARPGARRRPH.RRRRVLVREVRCSRPR DRSGSRGTSCPKSPPPSSPSGSLGRLSPQLRPLPLCPQCL PSASLPV* | 7337 | ATGGGCGCGGGGCTTACGGTCTCCGGATACGGTGTACACAGCAGCGGCGTCGCG GCCCGCAGCCCCGGCGCCCGGCCTGCTGCCCGAGGAAAACACTGCCGCCGACCGTGCGTGCTGC CGAAGGCCCCACTCCGCGCCGGCCGGCCTCCTGTCCGTGAGTGCGGTGTTCACGG CCCCGACGATCTGGGTCTCGGGAACCTCCTGCCCAAGTCCTGCCCTCCCTCC TCTCCCTCCGGTTCCTTAGGGGCGCTTCCGCCCAGCTTGACCTCTTCCCCTGCC CCCAGTGCCTCCTCCCAGCCTCGTGTGA | 7338 |
| | 2 | MAQGRERDEGPHSAGGASLSVRCGVHGPATDLGLAEP PAPSPLLPPLPVP* | 7339 | ATGGCGCAAGGCGGGAGCGGGAGCGTGTCAGGTGCCAGCCCACTCCGCGGCGCGGCGGCGGTCTT GTCCGTGAGGTGCGGTGTTCAGGCCCGACCGATTCGGTTCGCGGAACCTCC TGCCCAAGTCCTCCCTCCTCCCCCTCCGGTTCCTTAG | 7340 |
| | 3 | MSRGFSPNQCPSLAFSTIFKHTPNI* | 7341 | ATGTCTCGAGGTTTCTCACCAAACCAGTGCTTCACTTGCCTTTCCACCATCTCA AGCATACCTTTAATATTTAA | 7342 |
| | 4 | MFFLCASLSFTSTSFLLFSTFICFKSKIWPHTLHLCK* | 7343 | ATGTTCTTTTGTGTGCTAGCCTTTCATTCACGTCGACTTCATTCCTTTATTTCTAC GTTTATCTGTATTTTAAATCTAAAATGGCACATACTCTTCATCTGTGTAAATAA | 7344 |
| hsa-mir-611 | 1 | MPLAPEALPFPVVLGACSCRRVLPVAERRISLRGAKW* | 7345 | ATGCCACTTGCCGAGGCACTTCCTTTCGGTTGTGTCTAGGCGCCTGCCTCG CGACGTGTTCTTCGCCGGACGGGCGGAGCGGGATTAGCCTTCGCGCGGCAAATGGTG A | 7346 |
| | 2 | MVRALRGVPDGDARTPRGLTHTALISSDAGDPEG* | 7347 | ATGGTTGAGAGCGTTGAGGGAGTTCCAGACGGAGATGCGAGGACCCCTCCGGGTCTT GACCCACACCGGCGCTTATCTCCAGACGCCGGAGATCCAGAGGGCTAG | 7348 |
| | 3 | MRGPLGV* | 7349 | ATGCGAGGACCCCTCGGGTCTGA | 7350 |
| | 4 | MNSLGFSARDF* | 7351 | ATGAACTCCTTAGGTTTCTCAGCTCGCGGATTTCTAA | 7352 |
| hsa-mir-611 | 1 | MTTASTSQVRQNYHQDSEAAINRQINLELYASYVYLSM VSAGGPKRWRGPGAVPGARAGAGRGCGHPRALPPPCA LLENGGCSRFPRTSLAQKVGAAGSSRLYPEMAPS* | 7353 | ATGACGACCGCGTCACCTGCAGTCGCGCAGAACTACCACCAGGACTCAGAGGC CGCCATCAACCGCCAGATCAACTGGAGCTCTACGCCTCTACGTTTACCGTCCAT GGTGAGCGCGGGCCGGGCCTAAGCGGGTGTGCCACGGCGGAGGGGCGGTTCCGGGGCG CGCGCTGGGGCGGCCGGCGGGCCCGGGGTTGTGCCACCGGGGTTCGAGGGCTCTCCGCCG CCTTCTGGAAATGGAGGGCTGTCTCGAGTTTCGCAGGACTTCTGTGGCGCAGAAAGT CGGGACAGCTGGTTCTTCGGGTGTACCGTGAGAATGCTCCCTCCTAG | 7354 |
| | 2 | MEAARGFRGLLWRRKSGQLVLLGCTLRMLPRPGPPLH TLLF* | 7355 | ATGGAGGCTGCTCGCGGTTTCCGAGGTTCCTGGCGCAGAAAGTCGGGCAGCT GGTTCTTCTGCTGTACCGTGAGAATGCTCCCTCCTAGCCAGGCCCGCTCTGCA CACCCTTCTTTTGCTTAG | 7356 |
| | 3 | MPAFFA* | 7357 | ATGCCAGCGTTTTTGCTTAG | 7358 |
| | 4 | MYLTVRGVEFGLLIEPPVLG* | 7359 | ATGTATCTTACTGTAAGAGAGTGTGGAGTTTGGCCTACTAATTGAACCCCAGTCCTT GGATAA | 7360 |
| hsa-mir-611 | 1 | MGVFLR* | 7361 | ATGGGCGTCTTCCTGCGGTAG | 7362 |
| | 2 | MEPTRPAQSCPGNRRFGSRTPGLAMRTRKGAMSKCFA SLPAGSRAGLAPGNCTVLALGSGRR* | 7363 | ATGGAGCCGACCCGGCCAGCGCTCAAGTGCCTGCCGGGAACCGCAGGTTGGTTCGG CACCGCCGGACTGGCCAACCGCCCAAAAATCGGGCAGTCCAGTGTTTCGC TTCGTCGCCGGCAGGGAGCCGCGCGGCTCGCTCCTGGGATCAACTGCACAGTCCT GGCTTGGGGAGCGGGAGGCGGTGA | 7364 |
| hsa-mir-612 | 3 | MFRPAAGREPRRARSWDQLHSPGFGEREAVSLPAPRPL PHQCVWGEVGMGSPGVRKRMGEEKEEVLGTGELSQFS TNPIVNAFN* | 7365 | ATGTTTCGTTCGGCTGCCGGACGAGAGGAGCCGCGCCGGCTGCTCCTGGGATCAACTG CACAGTCCTCACCAGTGTCTGGGTGCTCGGGGTGAGTGGGAGTGGGAGGAAGTGTTAGGAAGTGGTAGCTTTCACAAAAG GATGGGAGGGAGGAGAAGAGAGAAGGAAGTTAGGAAGTGGTAGCACTTTCACAAACTTCCA CAAACCCTATTGTAAATGCCTTCAATTAA | 7366 |

Figure 1 (Continued)

| | | | | | |
|---|---|---|---|---|---|
| | 4 | MPSINWDFFLYWLIDLRQGLARAPRLQCSGTTHAHCGLDLPGSNDPPTSASVVARTTGACHQARAHF* | 7367 | ATGCCTTCAATTAACTGGAGTCTTTTCTTACTGGTTGATTTGATTTAAGACAAGTCTTGCTTCGGGCACCCAGGCTGCAGTGCAGGCTGCACAATCATAGCTCACTGCGGCTCGAACCTCCCAGGCTCAAACGATCCTCCCACCTCAGCCTCTGTAGTAGCTAGGACTACAGGTGCCTGCCACCAAGCCGGCTCATTTTAA | 7368 |
| hsa-mir-613 | 1 | MGGASVPKISPKCG* | 7369 | ATGGGCGGAGCTTCGTTCCAAAATTTCCCTAAGTGCGGTGA | 7370 |
| | 2 | MFRAPCHRLRARGTRKARAGAWRGCTPPCLGKVELGSAGGWRWPGKEHLFATKKKKKKKEEIEEKCVISTATQNPS* | 7371 | ATGTTCCGCGCGCCGTGTCACCGGCTCGGGGCCCAGGGTACTCGAAGGCGCGGGCAGGAGCCTGGCGAGGATGCCACTCGCCCTGCTTGGAAAGGTAGAACTGGGAGTGCGGGAGGGTGGAGGTGGCCGGATGGCAATTACAGGAAAATAGAGGAGAAATGGTATTTCAACGCCACTCAGAAAAAAAAAAAAAAGAGGAGAAATAGAGGAGAAATGGTATTTCAACGCCACTCAGAACCCATCATAA | 7372 |
| | 3 | MHLFLPWKGRTGCGRYEVARKRTPLRNQKKKKKKRGNRGKMCYFNRHSEPHQPVGVIFIELNFKKVFFDPQSVFAGGIC* | 7373 | ATGCACCTTCCCTGCCTTGGAAAGGTAGAACTGGGAGTGCGGGAGGGTGGAGGTGGCCCGGAAAAGAACACCTTCGCAACCAAAAAAAAAAAAAGAGGGAAATAGAGGAAAAATGTGTTATTTCAACGCCACTCAGAACCCATCATAATTCAGCCAGTCGGTGTCATTTTATTGAATTAAATTTAAAAAAGTTTCTTTGATTTCCAGAGCGTTTTTGCGGGAGGAATATGTTAA | 7374 |
| | 4 | MLKQTQDTK* | 7375 | ATGTTAAAACAAACTCAAGATACGAAATGA | 7376 |
| | 1 | MGDSFSFL* | 7377 | ATGGGTGATTCCTTTCTTTCTTGTAA | 7378 |
| | 2 | MICKFIDLPVVSI* | 7379 | ATGATATGCAAATTTATAGACCTTCCAGTTGTTCATCTGA | 7380 |
| | 3 | MQJYRPSSCFHLSPLFRLFISASPCSPIRHLSSQLFFPIPLS* | 7381 | ATGCAATTTATAGACCTTCCAGTTGTTCATCTGAGTCCCTTTCAGGCTTTTATCTCTGCTTCCCCTTGCCTCCCAATCAGGATCCCTCCCTCAGCTCTCTTCTTTCCCATTCCACTCTAA | 7382 |
| hsa-mir-614 | 4 | MQSQDESRGSKINTAAAFSLCFYRKVCVAAFEESCFRLCKMMLSLVKVLVWSQETWLFFFFLRSLALLPRLECSGMISACCDLHLPGSSNSPASASRVAGITGSQYHTQLIPVFLVETGFHHDDQAGLELLTSGDPSTSAFQIAGITGVNHCPQSKRLGFYSCLL* | 7383 | ATGCAATCACAGGATGAGTCAAGGAGCAAATAAATACTGCAGCTGCTTCTCTCTTTGTTTACAGAAGATGCTCTTTTGAGACGAAGAAGTGCTTGGAATGGTCTCTTTTGAGACGGAGTCTTGCTCTGTTGCCAGGGCTGGAGTGCAGTGCATGATCTCGGCTTGCTCGACCTCCAGCTGCTCCAGGTTCAAGCAACCACCCAGCTAATTTCTCAGCTCCTGAGTAGCTGGGATTACAGGGTTCACCATGACAGCCAGGCTGTCTTGAACTCCTGATTAGTTAGAGACAGGTTCACCATGACAGCCAGGCTGTCTTGAACTCCTGACCTCAGGTGATCCATCTACCAGGGCATTACAGGGTCTGAACTCCTGACCTCAGGTGATCCATCTACCAGGGCATTACAGGTGTGAACCATTGCCCCAGTTAGAGGCTTGGCTTCTATTCTTGTCTCTGTAA | 7384 |
| | 1 | MGGHRQKLRASLSSFPTLWPPKGRRNAGAGVELGSCRCLRPSSLPGSSSCPLLATLLNFVWLLDDYNYFYF* | 7385 | ATGGGAGGGGAGAGACAGAAGTTGAGGGCATCTCTTCCTCCGACCCTCTGGCCCCAAGGGCAGGAGGAATGCAGGAGGAGAGTTGAGCTTGGGAGCTGCAGATGCTCCGCGGCCCCTCTCCGGCTTTGAGCTCTCCTGCCGCCTCTTGCAACTCTCCTAAATTTGTTGGCTTTGGCCTTTTGA | 7386 |
| hsa-mir-615 | 2 | MQEQELSLGAADASAPPLSQALPPAPFLQLSLLPGFWMHHFHFEFI* | 7387 | ATGCAGGAGCAGGAGTTGAGCTTGGGAGCTGCAGATGCCTCAGGCACTCCTGCCCTTAATTTGTTTGGCTTTTGGATGATTTATAATTTTTATTTTTGAATTTATATAA | 7388 |
| | 3 | MPPPLLSPRLFLLPPSCNSP* | 7389 | ATGCCTCCGCGCCCTCTCTCCTCGGCTCTCCTCCTGCCCTCTTGCAACTCTC | 7390 |
| | 4 | MCVCVELRQARQRHRMREDEKESGRERGRGEGERESDSSAR* | 7391 | ATGTGTGTCTGTGAGCTGAGACAGGCTCGGCAGCGGCACCAGAATGAGGGAAGACGAGAAAGAGTGGGAGACAGGAGGAGAGCAGAGGGGAGAGGAGTGACAGCAGGCGCTCGGTAA | 7392 |
| | 1 | MRLGATGEEDGAEWLQIPCEGYPGACPAHPPGPFHSSW* | 7393 | ATGAGACTTGGGGCTACGGGGAAGGATGGGCGAATGGCTGCAGATACCCTGCGAAGGCTACTCAGGCGCCTGCCACCCCCAGGTCGCCTCGCCCATTCCTCTTGGTAG | 7394 |

Figure 1 (Continued)

| | | | | | |
|---|---|---|---|---|---|
| hsa-mir-615 | 2 | MGPNGGCRYPAKATQAPALPTPQVRPIPLGSSEIALL* | 7395 | ATGGGGCCGAATGGCTGCAGATACCCTGCGAAGGCTACCCAGGCGCCTGCCCTGCC CACCCCCAGTGCAGTCCGCCCATTCCTGGAAGGCTACCCAGGCGCTGCCTGCCACCCCAGG | 7396 |
| | 3 | MAADTLRRLPRRLPCPPPRSAPFLLVAQKLLSCEPYGPR SLESLAQRPFPQRAHNGPFPLPCSRNICGFNLASPCPQL TSIFCLKPLA* | 7397 | ATGGCTGCAGACACCCTGCGCCTGCCTCGCCGCCTGCCCTGCCCGCCACGCCGCCCAGG TCCGCCCCCATTCCTCTTGGTAGCTCAGAAATTGCTCTCTTGTGAACCTTATGGATTCA GGTCCCTGGAAAGCCTAGCCCAGAGACCTTTCCCAAAGGGCACATAACGGGCCTT GTCCTCTGCCATGCCACGTAATATTTGTGGAGGCTTCAATCTTGCTTCTCCATGTCC TCAATTAACATCTATTTTCTGTCTAAAACCCTGCCATAG | 7398 |
| | 4 | MDSGPWKA* | 7399 | ATGGATTCAGGTCCTGGAAAGCCTAG | 7400 |
| hsa-mir-615 | 1 | MSSYVANSFYKQSPNIPAYNMQTCGMYGSASEVQASR YCYGGLDLSITFPPPAFSNSLHGVDMAANPRAHPDRPA CSAAAAPGHAPGRDEAAPLNPGMYSQKAARPALEEFRA KSSGEIKEEQAQTGPAGLSQPPAPPQIYPWMTKLHMS HGKL* | 7401 | ATGAGCTCCTACGTAGCCAATTCATTCTATAAGCAGAGCCCAAATATCCTGCCTAT AACATGCAAACTGTGGGAACTATGGATCGGCTCAGAGGTGCAGGCATCCAGGTA CTGCTACGGCGGATTGGACATGGCTGCCAACCACATCACTTTCCCACCGCCTCCAACTC TCTCCACGGGGTAGACATGGCTGCCAACCGCTCACCCGACGCGGCTCCTCTGA CAGCGCGCCGGCCCTCCGGGACACGTCCCGGGCAGAGACGAAGCGGCTCCTCTGA ACCCGGGATGTACAGTCAAAGAAGGCGGCTCGCCGCCAGACCGCTGAGGAGCAGCTAA AGCAGTGGGGAGATCAAAGAGGAGCAGGCCAGACAGGCAGCCCGCCAGACTAA GCCAGCCACCGCCCGCCCACAGATTTACCCGTGGATGACCAAACTGCACATGAGCC ACGGTAAACTTTAG | 7402 |
| | 2 | MDRPQRCRHPGTATADWT* | 7403 | ATGGATCGGCCTCAGAGGTGCAGGCATCCAGGTACTGCTACGGCGGATTGGACTTAA | 7404 |
| | 3 | MRGK* | 7405 | ATGCGGGGCAAATAA | 7406 |
| | 4 | MARKTVH* | 7407 | ATGGCTCGTAAAACTGTCCACTAA | 7408 |
| | 1 | MPACHFLIGRFWGPAPESRRARPW* | 7409 | ATGCCGGCTGCCACTTTCTGATTGGTAGGTTTGGGGTCCGCCCTGAGAGGAGG GCAAGGCCATGGTAA | 7410 |
| | 2 | MVKDYSQALPRSET* | 7411 | ATGGTAAAAGATTACAGCCAGGCGCTCCGAGTCAGAGACTTAA | 7412 |
| hsa-mir-616 | 3 | MLKMSGWQRQSQNQSWNLRREASTDSHLPETLLPSPQS WGIVRSLGRASLLHSEVRDRPREEWGESLILGWCLQTPI ASDDGVSPPLPGAGTIRALLCAAGQRDLGCPWEIHSFP* | 7413 | ATGTTAAAAGATGAGCAGGCGGTGGCAGCGACGAGCCAAAATCAGAGCTGGAACCTGAG GAGAGAGGCGAGTACTGATCTCCATCGATTCCCATCAGTCCCATCTCTCCTCAAAGTTG GGGCGTCCGCTCTTTAGGATGCGGCCTCACTCCTCCCACAGTGAAGTTAGGGACCGTCC GAGAGAGAATGGGAGAGTCCCTTATTCTGGGGTGGTGCTTACAAACCCTATTG CTTCGGACGACGGCGTCTCTCCACCCTGCCTGGTTGCCCTTGGGAAATTCATTCTTTCCGTAG GTGCTGCTGGGCAAAGGAACCTCGGTTGCCCTTGGGAAATTCATTCTTTCCGTAG | 7414 |
| | 4 | MGRVPYSGYVLTNPYCFGRRRLSTPARSRNTGPALCCW AKGPRLPLGNSFFPVANFRPHR* | 7415 | ATGGGGAGAGTCCCTTATTCTGGGGTGTGTTACAAACCCTATTGCTTCGGACGA CGGCGTCTCTCCACCCTGCCTGGAGCCGGAACACGGGCCTCTGCTCTGTGCTGTGG GCAAAGGACCTCGGTTGCCCTTGGGAAATTCATTCTTTCCGTAGCCAACTTCAGG CCTCATCGTTAG | 7416 |
| | 1 | MQSLSDTCSAPHRN* | 7417 | ATGCAGTCGCTTCGGATACCTGCTCAGCTCCGCACGCAACTGA | 7418 |

Figure 1 (Continued)

| | | | | |
|---|---|---|---|---|
| hsa-mir-617 | 2 | MLKPSVTSAPTADMATLTVVQPLTLDRGKGAARSPGH RVPSPLLPSPPANSQRDMGRAQAGGEGERGRARKAFAP RTEHFLPLSLPATFPLPTVLAPPRGRLLLALGSPLPLPA PRRVVSGPLALLEPLRGDGYRRQGLGVGEGQRASSPGQ SPEETGEGAACQLAWRRGPGGRKFVQAPEGEGRSNCW SPGGHSGGGLGAPLGCRAHSGAAAGRELPSAERARQS AGSRAPAAEIGSPRLLRDPKRRGSRLLPPPAAPGR* | 7419 | ATGCTGAAGCCGAGCGTCACTTCGGCTCCACGGCAGACATGGCGACATTGACAGT GGTCCAGCCGCTCACCCTGGACAGAGGTAAGGGAGCGGCTCGTGCCAGGCCAGT GCGTCCCCTTCCTCCTCCCTGCCAATTCCCAAGCGGACATGGGAC GCGCTCAGGCAGGAGGAGAACGAGCGAGCCAGGAGACGAGCCAGGAAGGCGTTCGCGCC GAGAACAGAACACTTCTTCCCCTTCTCCCGAGGGAGCACTTCTCCGAGTCCTGCCGCTGCCA CTGTACTTCCGCTCGCCGTCCTGTCCCGGCTCTCTGGCTCTTGTTGAGCCGCTGCCA GGGGACGGCTATAGGCGCCAGAGGAGACCGGAGGGAGGAGCCGCTGTCAGTTGCTTGG CGCAGGGGCCCGGGAGGAAGAAGTTGTCCAGGCGCCGGGAGGGCGAGGGTCGGT CCAACTGCTGGAGTCCGGTGGCCACAGTGGCCTGCGAGCAGCAGGAGCTGCCTCTGCGAAAG GGCAAGCAGCAGCCCGGGAGCCGCGGAGCCCAGCAGCCCAGATGCTCTCCGGGCC TTCGAGATCGAAAGCGGCACGGGTGCGCTGCCGCCGAGCTCCCGGT CGATAG | 7420 |
| | 3 | MESSAAIGASLVHPCGVIPVPECVGFLPGSSVQ* | 7421 | ATGGAGTCCTCCGCTGCGATCGGGGCCTCACTGGTGCACCCTGTGGGGTTATACCT GTCCCTGAGTGTGTGGGTTTCCTTCCGGCTCCAGCGTCCAGTGA | 7422 |
| | 4 | MKALESYGSAEEDTL* | 7423 | ATGAAGGCGCTCGAGTCCTACGGCTCTGCAGAAGAGGACACCCTCTAG | 7424 |
| | 1 | MQSLSDTCSAPHRN* | 7425 | ATGCAGTCGCTCTCGGATACCTGCTCAGCTCCGCACCGCAACTGA | 7426 |
| hsa-mir-618 | 2 | MLKPSVTSAPTADMATLTVVQPLTLDRGKGAARSPGH RVPSPLLPSPPANSQRDMGRAQAGGEGERGRARKAFAP RTEHFLPLSLPATFPLPTVLAPPRGRLLLALGSPLPLPA PRRVVSGPLALLEPLRGDGYRRQGLGVGEGQRASSPGQ SPEETGEGAACQLAWRRGPGGRKFVQAPEGEGRSNCW SPGGHSGGGLGAPLGCRAHSGAAAGRELPSAERARQS AGSRAPAAEIGSPRLLRDPKRRGSRLLPPPAAPGR* | 7427 | ATGCTGAAGCCGAGCGTCACTTCGGCTCCACGGCAGACATGGCGACATTGACAGT GGTCCAGCCGCTCACCCTGGACAGAGGTAAGGGAGCGGCTCGTGCCAGGCCACC GCGTCCCCTTCCTCCTCCCTTCCCCAGCGGAACATGGGAC GCGCTCAGGCAGGAGGAGAACGAGCGAGCCAGGAGACGAGCCAGGAAGGCGTTCGCGCC ACTGTACTTCCGCTCGCCCCCGCCAGGGTCGTCTCCGGTCCTGGCTTTGTTGAGCCGCTGCGC CTCCCAGCCTGCCAGCCGGGTCGTCTCCGGTCCTGGCTTTGTTGAGCCGCTGCGC GGGGACGGCTATAGGCGCCAGAGGAGACCTGGGGTTGAGAGGGCAGAGAGCAAGCT CGCAGGGGCCCGGGAGGCGCAGGGGGAGGAGCCCGCTGTCAGCTTGCTTGG CCAACTGCTGGAGTCCGGTGGCCACTCGGGGGTGCGGGTCGGGCGAGCAGCAGGAGGTCGGT TGCGGGGCGCACAGTGGCGGGAGAAGTTGTCCAGGCGCGGTGAGGGCGAGGGTCGGT GGAAGGCAGAGCGGGGAGCCGGGAGCCGAGCCCCGAGCAGGGACGCAGATCGGCTCCCGGAAAG TTGAGATCGAAAGCGGGCACGGGTGCCGAGGGTGCGCCGGCAGGGGCGGCTGCCGCCGAGCTCCCGGT CGATAG | 7428 |
| | 3 | MESSAAIGASLVHPCGVIPVPECVGFLPGSSVQ* | 7429 | ATGGAGTCCTCCGCTGCGATCGGGGCCTCACTGGTGCACCCTGTGGGGTTATACCT GTCCCTGAGTGTGTGGGTTTCCTTCCGGCTCCAGCGTCCAGTGA | 7430 |
| | 4 | MKALESYGSAEEDTL* | 7431 | ATGAAGGCGCTCGAGTCCTACGGCTCTGCAGAAGAGGACACCCTCTAG | 7432 |
| | 1 | MALVTLQRSPTPSAASSSASNSEVSPGLAAPGLGRRTPR RGRRSSWGRACGAGGRLRGLLGAPP* | 7433 | ATGGCCCTTGTGACCCTGCAGCGCTCGCCACGCCAGGCGCGCTCCTCTCGGCC AGCAACAGCGAGGTGAGCCCGGAGCCCGGCTGCGCCGCCGGCGACGCC GCGCCGAGGCGCCGCGGAGCTGCGGAGCTGGGCCCCGCGTACCGCGGC GGCTCCTCGGGGACCCCGCGTAG | 7434 |
| hsa-mir-619 | 2 | MQCDPSGSVCRILCVRCDPHQQVTFILG* | 7435 | ATGCAGTGCGACCCCTCTGGGAGTGTCTGCAGGATACTGTGTGTGCGCTGTGACCCA CATCAGGGGGTTACCCCATCTTGGGGTGA | 7436 |
| | 3 | MCNWDP* | 7437 | ATGTGCAACTGGGACCCTTGA | 7438 |
| | 4 | MPGCAM* | 7439 | ATGCCTGGCTGTGCGATGTGA | 7440 |
| | 1 | MPRSGGRARGS* | 7441 | ATGCCCCGCTCTGGCGGCCGGGCTCGCGGAGGATCATGA | 7442 |

Figure 1 (Continued)

| | | | | |
|---|---|---|---|---|
| hsa-mir-620 | 2 | MTAAANWVANGASLEDCHSNLFSLVSSRAAGRGLCRG RGGVPDLRRRPTFSSRRDFAPPSRLPAVRLSPILPLLDR LSLALDPKQCLFGSLKHCERGARRGICMWKSRSCGFWV ALRTPTLCCNRTPLLLPFPPFFSPRKCGRLCLVLPRLRSA TSSPVVGSAACPPACLLNFFKFHNDTCNFALK* | 7443 | ATGACTGCGGCAGCGAACTGGGTGGCGAACGGGGCAGCCTGGAGGATTGTCACTC CAACCTCTTTTCGCTGGTGAGTAGCCGCGGCGCAGGGGAGGGGCTGTCCGGGAA GGGGGTCCCCTGCGACTTCTCCCCGCCATCTCTGGAATCCCAGTGTTTATTTGGCTCTTTAAAAATCATT TGTGAGCGCGGCTCGGCGTGGAATTTGCATGTGGAAGTCTCGGAGCTGCGGATT CTGGGTCGCCACTGTTTCCCCGTAAATGTGGAAGGCTTTGCTCGTCCTGCCGCC TTCCCCCTTTTTTCCCCGTAAATGTTTGGATCAGCTGCCGCCCCGCCTGCTCCT TTGAATTTTTAAATTCCATAATGACACCTGCAATTTCGCCCTAAATAG | 7444 |
| | 3 | MWKALPCAAAPPIGNLFPRCWISCLPARLPEFF* | 7445 | ATGTGGAAGGCTTTGCCTTGTCTGCCGCGCCTCCGATCGGCAACCTCTTCCCCGT TGTTGGATCAGTCGCCTGCCCCGCCCCTGCCTTTCGAATTTTTTAA | 7446 |
| | 4 | MTPAISP* | 7447 | ATGACACCTGCAATTTCGCCCTAA | 7448 |
| hsa-mir-621 | 1 | MPARREGRRAGRCRRGC* | 7449 | ATGCCTGCGCGAAGGGAGGGCGGCGTTGCGACGTGGGTGTTAA | 7450 |
| | 2 | MEPLVNGDLLAAQEWAAGQGR* | 7451 | ATGGAGCCGCTTGTGAATGGAGACTTGCTGGCCGCCAGGAGTGGGCGGCTGGCA GGGGCGGTGA | 7452 |
| | 3 | METCWLPRSGRLGRGGERLGSGQESWKSSP* | 7453 | ATGGAGACTTGCTGGCTGCCCAGGAGTGGGCGGCTGGGCAGGGGCGGTGAACGTTT AGGGTCCGGCAAGAAGTTGGAAGTCTGTCCTGA | 7454 |
| | 4 | MASWPAAPLARSWDLPAAVRVPWVWKMQPHLLTLPSK KKLFSPRVEKSGWSALLFLSCTLV* | 7455 | ATGGCATGGCCTGGCCTGGCCGCTTAGCGAAGCTGGGATCTTCCGCAGCAGTT CGTGTTCCTGGTGCAAAATGCAGCTCATCTACTGACTCTCCTCCAAAAAAAG TTATTTTCCCAAGGGTCGAGAAAGTGGTGGTCGGCACTGTTGTTCCTCAGTTGC ACCCTGGTGTAA | 7456 |
| hsa-mir-623 | 1 | MRRVRRSSAASGLAAPDSSLRQECACAVAGARTSASPP PAPSGAPSPAGPCSPAPAPVCGSVSTGLRHPGCPLHATLG TSLRRLGQRGPSGLPEVVGPTLQTRVRTLLVPGLGGQR KPPFRPGGANGDKAPPPAPTPGIPRCSAQESLGAAAS GQVPWCSRGPAPGPLRSVCRAEGRGRPPPYHAPFF* | 7457 | ATGCGCCGGGTGCGCCGTTCGTCAGCGGCAGGGAGTGGCCTCGCCGCCGATTCGTC GCTCCGCAAGTGCACTCCTGGGGCCTCCGAGCCGGCCGGGACCCATGTTCACCAGCACCGGCTCC CCCGGCGCTCTGTGAGTAGCACCGGCGCCTCGCAACCTGGCTGCCGCCCTACACGCACCCT AGGCACCTCTTTGAAGGAGGTGAGAGGCAGCAGGGACCCTGCAGGTTGCCGGAGGTGG TGGGGCGAACCCTCCAGACCCCATTCGGAACCCTGCTAGTTCCCGGTCTTGGGGTC AGCGGAAACCCGCCCCACCTGGTATCCTGCCCAGGGGCGAATGGGGACAAAGCCCCGCCG GCCGCAAGTGGGACCCCAGGCAGTGCCCGGTATCCGCAGGGCCGGCCCAGCGTCTTGGGGC AGCGTGTGCCGCGCGGCGTGAAGGGGCCGTCCCCCATTCCTTTTTAG | 7458 |
| | 2 | MFTSTGSSGLCEYRPPPSWLPPTRHPRHLFEEAGAAGTL GFAGGGGADPPDPRPNPASSRSWGSAETAPISAWRGEW GQSPAARPDPTWYPQVLCPGVSWGRCKWAGALVFSW AGPRPFAERVPR* | 7459 | ATGTTCACCAGCACCGGCTCCAGTGGGCTCTGTGAGTACCGACCCCCATCCTGG CTCCCCCCTACACCGCCACCCCTCGACATCTTGAGGAGGCTGGGGCAGCGGGGAC CTCTGGGTTGCCGGAGGTGGTGGGGCCGACGACCCCCAGACCCCGGGAACCCTGC TAGTTCCGGTTCTGGGTGTCAGTGGAGCAAGGGAACCGCCGATTGCTGGAGGGTG AATGGGGAAGCCCCGCCGCCCGCCCGCCGACCCCTCGACCCCACCGGTATCCCCAGGTGCTCT GCCCAGGAGTCTTGGGGCCCCTTTGCCGGGCAAGGTGGTGCCGCGCTGA | 7460 |
| | 3 | MGTKPRRPPRPHLVSPGALPRSLLGPLQVGRCPGVLVG RPQALCGACAALKEGAVPLTMPHSPRLGGPN* | 7461 | ATGGGGACAAAGCCCCGCCGTCTTGGGCCGCACCCCGACCCCACTGGTATCCCAGGTGCTCTG CGGCCCAGGAGCTCTTGCCAGCCCTTGCAGCGTGTGCCGCCAGTGGGACCCGGGAATCCCT TACCATGCCCCATTCTTTAGGCTTGGGGGACCGAACTAA | 7462 |

Figure 1 (Continued)

| | | | | | |
|---|---|---|---|---|---|
| | 4 | | MCFFFSLQEEFLDKHTLMRVLSSGGKLGSRGEGAQLCC WMLLFSWRVSGGQVGGGVFLQPVKRLFSLSVWN* | 7463 | ATGTGTTCTCTTCAGTCTCCAAGAAGAGTTTTAGACAAACACACTGATGAGA GTGCTTTCAAGTGGAGTGGAAGTAGGAAGTCGTGGCGAGGGAGGCCAGCTGTCTG CTGGATGTTGCTGTTTCCTGGCGTGTAGCGGTGGTCAGCAGGTAGGGCGGAGT ATTTTACAGCCAGTTAAACGGCTTTCACTGAGTGTGTGAATTGA | 7464 |
| hsa-mir-623 | 1 | | MITFIQSRTTSR* | 7465 | ATGACCTTCACGCAGTCAGAACGACTTCCAGGTAA | 7466 |
| | 2 | | MKQWQYFLLLGTFVFSFTFYSEKCNL* | 7467 | ATGAAGCAATGGCAGTATTCCTTTATTAGGCACATTGTTTCAGTTTCACTTTT ACTCAGAGAAGTGTAATTATAA | 7468 |
| | 3 | | MAVPFFIRHICFQFHFLLREV* | 7469 | ATGGCAGTATTCCTTTATTAGGCACATTGTTTCAGTTCACTTTTACTCAGAG AAGTGTAA | 7470 |
| | 4 | | MFNLFLMPSRHT* | 7471 | ATGTTTAATCTTTTTTAATGCCAGTAGGCATACTAG | 7472 |
| hsa-mir-623 | 1 | | MVASPFAKWFAVKTRVLLSRLHLKSRFANPQRMSIAP CWAPGLW* | 7473 | ATGGTAGCGTCACCATTTGCTAAATGTTTGCTGTGAAGACTACTAGTACTGT TCCAGGTACATTTGAAAAGCTTCTTTGCCAATCCTCAGCGAATGTCAATTGCTCCCT GCTGGGGCTCCAGGTCTGTGGTAG | 7474 |
| | 2 | | MAVCCEDY* | 7475 | ATGGTTTGCTGTGAAGACTACTAG | 7476 |
| | 3 | | MIPSFLSVLPVTFLLLSRLLM* | 7477 | ATGATTTTCAGTTTTCTATCTGTACTGTCACTTTTCTTTACTCTCACGGCTTTT GATGTAA | 7478 |
| | 4 | | MCKLAF* | 7479 | ATGTGTCGCTTGGCCTTTGA | 7480 |
| | 1 | | MSGL* | 7481 | ATGTCAGGCCTCTGA | 7482 |
| | 2 | | MSLK* | 7483 | ATGTCATTAAAGHAA | 7484 |
| hsa-mir-623 | 3 | | MSVRLYTVEASLAGAVGLHPKLLCWSFPMYSVDVFAPS VLIAIPNQSLEHQLWP* | 7485 | AGTCTGTCAGAGTAGTACACAGTAGAAGCATCCTTGCAGGGCTGTTGGGTTGCAT CCTAAGCTGTGCTGGACTTCCGATGTACTCTGTAGATGTCTTTGCACCTTCTGTCC TCATTGCCATCCCAATCAGTCCTGAACCACGTGGCCCTGA | 7486 |
| | 4 | | MSLHLLSSLPSPISPWNTSCGPDSFSPCMECTGKACGLW DSSRLEQDRGRRDGAEGSR* | 7487 | ATGTCTTTGCACCTTCTGTCTGCATTGGCGATCCATCCCAATCAGTCCTGAACCAGCT GTGGGCTCGGTTGGAGATGGAGCAGTCAGCAGCTGAATGCCAGGCAAGCGTGTGCCTTT GGGACTCCAGCCGACTAGAGCAAGACAGAGGAAGAGACGAGGCAGAGGGCAG CCGATAG | 7488 |
| | 1 | | MEEGL* | 7489 | ATGGAGGAGGATTGTAA | 7490 |
| | 2 | | MAAAGGSSLL* | 7491 | ATGGCGGCAGCCGGCAGTTCCCTGCTGTGA | 7492 |
| hsa-mir-624 | 3 | | MDELAGGGRGGPGMAAPPRQQQGPGGNLGLSPGGNG AAGGGRPPASEGAGPAAGPELSRPQQYTIPGILHYIQHE WARFEMERAHWEVERAELQVPRWGRCAAGAAAAGFPA GGWGWGLHSAGAGALGGRAEPTCAAQVYMVLSTAFP GVPLPLSRISLLPNLHWLRGAGLLGAAHLAFSMASAGAP PEAAFPGLRGLGPSTSLWESPVWGLSTLSLLLFVPLEMK SPKRGTRIGILPPFSGGPPFPIWRIWPPSDLVRACPLTAT LLSWAARVHSDLGLTCEVLFPIVNFKYFLT* | 7493 | ATGGACGACGAGCTGGCCGGAGGCGGTGGTGGGGAGGGATGGCGGCCCCTCCCG GCAGCAGCAGGGACTGGGGGGAACCTGGGCCTTCGCCGGGGGAACCGGACG GCGGGGCGGCCGGCGGTCCTCGGAGGGAGCGGGTCCGGCAGGCCCGA GCTGTCCGGTGAGATGGAGCCACTGGGAGGTGCCACTACTACCAGCAGCA GGTACCTCGTTGGGGTCGGTGCGGGAGCTGGGTTCCCGGCCGGG ACCTACCTGTGCTGCAGTTGTGATGTCCCCAACCTTCACTGCTACGGTGGCGGC CTCCCCTCTTTGCCGCCATAAGCTTGCCTTTAGTATGGCGTCTCCGGAGTCCC GCGGCCTTCCCGGCCTCCCACCCATTGGCCGAGCACCTTCCTGTTGTTCGAGAAGAG GGTTTGGGCCTCTCAACACTGAGTTTGCTCTTGTTTGTTCGGACCACCCCTT TCCGAATTGGCGATCTTCCTGGCTCTACGGGTGCACAGTACTTGGACTGACCTGAA GTTTTATTTCCCATGCGTCAACTTTAAGTACTTTCTCACCTGA | 7494 |

Figure 1 (Continued)

| | | | | | |
|---|---|---|---|---|---|
| | 4 | MLPYSLGFSVVHPYLVTHQRFQH* | 7495 | ATGCTGCCTTACTCACTTGGATTCTCTGTAGTTATTCCTTACTTAGTGACTCATCAAC GCTTTCAGCACTGA | 7496 |
| hsa-mir-625 | 1 | MHQILGKTFLGQVPFFFFSWKEVGKISALIPRILEVKME HQTKMEFLGKCKALYLGJSKYYTV* | 7497 | ATGCACCAAATCCTGGGCAAAACATTCCTAGGACAGGTTTTTTTTTTTTCA GTTGGAAGGAGGTAGGGACAACAAGTGCTTTAATTCCTAGGATTTGGAAGTAAAA ATGGAACACCAGACAACTAGTATTACAAGTGTAA | 7498 |
| | 2 | MHNQLEVVLFFKFYF* | 7499 | ARGATTATTAACCACTAGAAGTAGTTCTTTTTAAATTTATTTTAA | 7500 |
| | 3 | MRVLLCCPG* | 7501 | ATGAGGGTCTTGCTATGTTGCCCAGCTGA | 7502 |
| | 4 | MLPRLKWLLTGTMWHCSLELLGLSDPSCFPYLKKKKLR LLVKIFLKCCV* | 7503 | ATGTTGCCTAGGCTGAAGTGGCTACTGACAGGCACGATGTGGCACTGCAGCCTGA ACTCTTGGGCTTAAGTGATCCTTCCTGCTTCTTATTCTATCTTAAAAAAAAAGTTACGC TTGCTTGTTAAAATATTTTTAAAATGCTGTGTTAA | 7504 |
| hsa-mir-625 | 1 | MLLLRSPPAQRGRGRGESLAHARVAVGGSGRRMRALS QKPGTPRGALPHSRAHAGARGRGFFPACARCQSRSGACAR YLRPTRAAGSLLSRPPPHPTPAAWPQTRPFVSPRNGAG TAQGRAPWTQLALGLALSATARLAPPRALPQSVAPKAP LSGGGGSCFRFFLSVRSGVASSTQPPFPLPHRGAAAAEG CGFGSCDGERRRPPLLPPGVRGRFGSRAPRASGSWAGL RAGSEEAPRLSLLVHPGLLLQLLPVNQRLSEKWGGSPR DALADALAQPRGRGQRVRGARLSSRDAELRRCCPRRR ASLPLRAGAKA* | 7505 | ATGCTGCTGCTACGCTCTCCACCGGCAGCGAGAAGGGCGGGGAGAATCCT GGCACATGCCAGGTTCGCGTAGGTGGCAGCGGCTGGCAGCATGCGGCCTCTCCC AGAAGCCAGGAACGCCCGAGCGGCCGCCCATTCGCGGCGCACGCGGCCT GGCCGAGGCTTCCCCCGGCTGCTCGTTGTCAGAGCCGTCCCTCCCCCATCGC TATCTCCGGCGACCCGAGCAGCCGGTTCCCCCCCCGTCTCTCCCAGCCCCCATCGC ACCCGCGACCCCGCGACCCGACCCGCCAGCGCCCGTCCCCGCAGCCTGCTCGCGGAGGCC GGCACTGCTCAGGGTGCGGCGCTCGCGGCGCCCGCGCCCAGCTGCTCGGCCGCGTCA GCGACTGCCGGCTGCGGCGGCGGCGTTCGCGTTTCGCTCCCACTCCCTCGTCGGTCGGGA CCGTTAAGCAGCCACGGCCCGGGCCGCTCTGTCGGGCAGCAGCCGGGCCCTCTGGC GAGGCTGGCTTTGGCAGCTGCCAGCGCGCGGGGAGCCGGCGAGACCCCTCTGCTCCC GCCTGGGGTAAGGGGCGTTTTGGAGGGCCATCTGCAGCGCCCCCCGAGCCCAGGGGCTCGGTCTTGGG CTGGGCTGCTGCAACTGCTGCCGGTTAACCAGGCGGCTCTGGAAAAGTGGGAGGG AGCCCCGGACCCCTGCCCCCTCTCCAGCGAGGCAACGTGCCCCGCCCCCTCCCCCTC GCGCTCGCGCATCCTTGCCTAGGCAGGCAGGCCAAAGCCTAG | 7506 |
| | 2 | MPGSP* | 7507 | ATGCCAAGGTTCGCGTAG | 7508 |
| | 3 | MGPALLRVARPGPSSLSVSRCQRLPGSRRLALCLSQWR RRLR* | 7509 | ATGGGGCCGGCACTGCTCAGGGTCGCGCGCCCTGGACCCAGCTCGCTCTCGTTCG CGCTGTCAGCGGACTGCCCGGCTCGGCCTCCGCCCGGTGCCTGGCCGCCAGTCAGTGAGCGCC CGAAGGCTCCGTTAA | 7510 |
| | 4 | MPWRSPGGAGRG* | 7511 | ATGCCTTGGCGCAGCTCCGGCCGCGGGGCGCGGGCAGAGGGTGA | 7512 |
| | 1 | MLCSTPRGARRIPACIGERPRAMVPGSWRGVRS* | 7513 | ATGCTCTGCAGCACACTCCGGGCACGGAGGGCGCCAGGGCGTATCCGGCGTGCATCGGGGAGGCG CCCAAGGGCCATGTTCCCGGCTCGGAGAGGCGTGCGAAGTTAA | 7514 |
| | 2 | MGLNP* | 7515 | ATGGGTTTAAATCATAA | 7516 |
| hsa-mir-626 | 3 | MTSRVVQQREDSGTRERSGAWVCGGRPRQVCAGATLA TRYARPHAPGGVFLARSVKSLGRVFVRWGEGERGRGGGG ALRRHVDATANLRPRRTHSFPRRPGVRRVH* | 7517 | ATGACTAGCCGGGTGGTCCAGCAGCGCGAGGATTCCGGAACGCCGCGAGCGGGAGCG CGGTGGTCGGCGGTGCCGGCCCCGGCCGCCTGGTGCCAGGTATGCAGGCCTTGCTTGCCA CGCTAGCGGCCGCGCGTCGCTACCGCCGTCGGTCGGTGTCGCGAGTGGGCGCGGTGGCGGGC GCTGAGGCGGTCACGTGACGCCACAGCAATCTCAGGCCGGACGTGTTCACTGA | 7518 |
| | 4 | MRRRLACHALRPSPRAWWRVLGAKC* | 7519 | ATGCGGCAGGGCGCCTTGCTTGCCACGCTACGCCCGTCCCACCGGAGCGCGAGCGG GTTCTTGGCGCGAAGTGTAA | 7520 |

Figure 1 (Continued)

| | | | | |
|---|---|---|---|---|
| hsa-mir-626 | 1 | MSPRARPRPHFRVAQLPNWEHRRQRERPRGGRGEKRP WLGPALACVGCRSAWTGPRDDFSPGAGL* | 7521 | ATGTCACCTCGCGCGTCCCGGCCTCACTTCCGCGTCGTCAGCTACTAACTGG GAACATGACGCCAGAGAGCGGCCACGAGGCGGAGAAGGCTGAGAAGCGCCAT GGCTCGGCCCTGCCTCCGTGTGGGGTGCCGCTCCGCGTACGGTCCGGTG ACGACTTCTCGCCGGCGCCGGCTCTAG | 7522 |
| | 2 | MARFCPRVCGVPLRVVRSA* | 7523 | ATGGCTCGGCCTGCCTCGCGTGTGGGAAGCAGGTGTTATTTCTTATTCCTCTGTG TGA | 7524 |
| | 3 | MREGKTGGKSRCVFLYSSVGQPFT* | 7525 | ATGAGGGAGGGAAAACAGGTGGAATGTCAAGTAGCTCTGCCCTCAGTGCAAGGT GGGCAGCCTTTACCTAG | 7526 |
| | 4 | MGFFVSVKWSSRSLPSVQGFWDINITPPPPQSSSSQS* | 7527 | ATGGGGTTCCCGTTCTGTTAAATGTCAACATAGCTCTGCCCTCAGTGCAAGGT ATCTGGGACATTAACATCACCCCCCCCAAAGCTCCAGTAGCCAAAGT TGA | 7528 |
| hsa-mir-627 | 1 | MATQQQNNSFRVHREEGAGLRLRKRRA* | 7529 | ATGGCAACTCAGCAACAAAACAATTCATTAGAGTGCACCGGAGGAAGGGCGGGG ACTTCGCGTCCGAAGAGGCGGGCTAA | 7530 |
| | 2 | MAVLLKGL* | 7531 | ATGGCTGTGTTGTTGAAGGGCTGTAG | 7532 |
| | 3 | MHDAFEPVPHLEKLPLQHDCLAAWGPPRGRGAEAESAQ ERSGSFLRPGKWTGVHPCGLRLDATRREGLRMREGREM TTGYRHRCLWGYLGDPSDFVJ* | 7533 | ATGCACGACGCTTTCGAGCCAGTGCCGATCCTAGAAAAAGCTGCTCTGCAAATCGAC TGTCTGCTGCCTGGCGTGAGCCAGGGCCGTCGAGGCGGACAGGCGTCATCCGTGTG GGAGCGGTCGGTTGGATGCTACACGAGAGGGGGCTTAGGATGAGAGAAGGCAGAGATG GCCTTCGGTTGGATGCTACACGAGAGGGGGCTTAGGATGAGAGAAGGCAGAGATG ACCACCGGCTATAGACATCGATGTCTGTGGGGCTACTTGGGTGATCCCAGTGATCCA GTCATTTAG | 7534 |
| | 4 | MLHERGLG* | 7535 | ATGCTACACGAGAGGGCTTAGGATGA | 7536 |
| hsa-mir-628 | 1 | MHCGAQPVTACRLQTPASRLFL* | 7537 | ATGCACTIGCGGCGCCAGCGCCGTCACCGCCGTCAGAGCGCCTCGGACGCAG GTTGTTTTATA | 7538 |
| | 2 | MKIHMVRCYVRHPAGFNASLSFDDI* | 7539 | ATGAAAATCATATGGTAAGATGTTATGTGCGTCACCCTGCCGGGTTAATGCAAGC CTGTCTTTTGATGACATTTGA | 7540 |
| | 3 | MLCASPCRV* | 7541 | ATGTTATGTGCGTCACCCTGCCGGGTTAA | 7542 |
| | 4 | MCVTLPGLMPACLLMTFEPP* | 7543 | ATGTGCGTCACCCTGCCGGGTTAATGCAGCCTGCTTTTGATGACATTTGAGCCC CCGTGA | 7544 |
| hsa-mir-629 | 1 | MPGRLJCTY* | 7545 | ATGCCAGGGCGTTTGATTTGCACTCTGA | 7546 |
| | 2 | MLGAAPARPPTGATR* | 7547 | ATGCTTGGGCGTGCCTGCCGGCGCGCCCCCTACAGGCGTGACCCGCTGA | 7548 |
| | 3 | MSAQSQALLTRSTQPPREGGRPLPAEP* | 7549 | ATGTCCGCTGCAGTGCCAGGCATTGACGGCGCTCGACGCAGCGAAGGCGGCCG GCGCTCGCCCGAGCCCTAG | 7550 |
| | 4 | MYPQRRHPVSNCNSVYLSIYHGRVNEAVYLAPPFCLLL PLWCVCLCVCSHTKGDAAGGRR* | 7551 | ATGTATCCGCAGGGCAGACATCCGGTAATTGCAACTCGGTTATTTAAGCATC TATCATGCCAGGGTAAACAGAGCAGTTATCTGGCACCTCCATTTGCTTGTTGCTA CCTTTATGTGTGTGTGTGTGTTGTGCTCTCACACAAAGGGGATGCGGCGGG GGGCGCGTTGA | 7552 |
| hsa-mir-630 | 1 | MEYIFPYLHSSY* | 7553 | ATGGAGTACATCTTCCCGTACTTGCACTCATCCTATTAG | 7554 |
| | 2 | MTKISLVKHNLSQSPSQKS* | 7555 | ATGACCAAAATTAGTCTAGTAAAGCACAACTATCACAAATCTCCTCACAAAATCC TAG | 7556 |
| | 3 | MTNFIQRMENLQSSREGVQTRDREMNQGFDFHLLSFA SRGALSQVM* | 7557 | ATGACAAATTTATTCAAAGAATGGAAAATCTTCAAGTAGCATAAGAGAAGGAGT ACAGACTAGAACAGAGAATGAGAATCAGGGCCTTGATTTCCACCTCTTATCATTGC AAGCCGAGAGCCTTGACCAAGTTATGTAA | 7558 |
| | 4 | MAFLAGFCFVLRQGLALSPGWSAVVRSWLTATSASRV QAILVPQSPRVAVFTGKCH* | 7559 | ATGGCATTTCTAGCAGGTTTTTGTTTGTTTGAGACAGGGTCTCGCTCTGTCTCCAG GCTGGAGTGCAGTGGTGCGATCTTGGCTCACTGCAACCTCTGCCTCCCGGGTTCAAG CGATTCTTGTGCCTCAGCCCTCCCCGAGTAGGTGATTACAGGAGCAAGTGCCACT AG | 7560 |

Figure 1 (Continued)

| | | | | | |
|---|---|---|---|---|---|
| hsa-mir-631 | 1 | MFYYSGVLFYKQHQRGPLENCI* | 7561 | ATGTTCTATATTCTGTGTGTTTATTCTATAAGCAACATCAGAGAGGCCCACTAGAG AACTGTATTTAA | 7562 |
| | 2 | MSRPGVVAHACNPSTLGGRGRWTR* | 7563 | ATGTCTCGCCCTGGGGTGGTGGTCACGCCTGTAATCCCAGCACTTTGGGAGGCCG AGGCAGGTGGATCACCTGTCTATTAA | 7564 |
| | 3 | MVKPCLY* | 7565 | ATGGTGAAACCCTGTCTATTAA | 7566 |
| | 4 | MSPGEFTDWLEFYFWDLSVLTSFSPHLSSF* | 7567 | ATGTCTCCTGGGGAATTTACTGACTGGCTAGAGTTTTATTCTGGGATCTTCTGTGC TCACTTCTTTTCCTTCCATCTTCCTCATTTTGA | 7568 |
| hsa-mir-632 | 1 | MQHPWVP* | 7569 | ATGCAGATTCCCTGGGTGCCGTGA | 7570 |
| | 2 | MLLPVLAGKHGSPLF* | 7571 | ATGTTGCCTCCCGTGCTGGCTGGAAAGCACGGTTCTCCTGCCTTAA | 7572 |
| | 3 | MFVSKYFCTVYILYIFVTYYLSTDSIKYPFSFSKPLVIQE VT* | 7573 | ATGTTTGTTTCTAAGTACTTCTGTATTGTACATTCTGTATATTTTGTGTAACATA TTATTTGAGCACAGATTCCATTAAATATTTTTTCTTTTTCAAGCCATTGGTTATTC AGGAAGTGACCTGA | 7574 |
| | 4 | MGGRG* | 7575 | ATGGGTGGAGAGGTGA | 7576 |
| hsa-mir-633 | 1 | MGRKKKQLKPWCWYPLSV* | 7577 | ATGGGTCGCAAGAAGAAGAAGCAGCTGAAGCCGTGGTGTGGTATCCTTTGTCGGT TTGA | 7578 |
| | 2 | MGFRGRQAFAVVGRVTL* | 7579 | ATGGGTTCCGAGGTCGACAGGTCTTTGCAGTTGTGGGTGTGACTCTGA | 7580 |
| | 3 | MEGWGQLRSLSPITFSVFTYFMCVLCLFPRHGGHLVKNQVS QPWFRTFFFFFSGREEN* | 7581 | ATGGAGGGTTGGGGACAGCTTCACAGTCTGCACCCACTTTTCTGTTTTATTACT TATGTGTGTTTCGAATTGGCGGTTAGTAAAGAACCAAGTTAG TCAACCCTGGTTTCGAACCTTTTTTTTTTCTTTCGGCGGGAGGAGAAAC TAG | 7582 |
| | 4 | MLFLEALIFFTLKLILFTVLYVKAACYSTAPM* | 7583 | ATGCTTTTTCTGGAAGCGTTAATATTCTTTACATTAAAATTGATTTATTTACTGTT TGTACGTAAAGGCGGCTTGTTTACAGTACGTGCGTTTATGTAA | 7584 |
| hsa-mir-634 | 1 | MCPRNTSQPHNSGRKPSEPRPDFTSPARMASVPLSGQDAL* | 7585 | ATGTGCCCCAGGAACACTTCCCAGCCTCATCCCAGCCAGATGGCATCAGAACCA CGACCCGACTTTACATCTCCAGCCAGAATGCATCGTTCCTCTATCCAGGATGCA CTTTGA | 7586 |
| | 2 | MHFEKWELPLPSVGPFELLFLRSDLHTPESGLHVLGDHK VH* | 7587 | ATGCACTTTGAGAAGTGGGAGTTGCCACTTCCTTCAGTTGGTTTTCTTTGTTGT TGCATCGACTTGCATACCCAGAGTCTGGCATTTTAATTGTCCTCGGTGACAT TATTAAAGTTCATTAA | 7588 |
| | 3 | MGRKVDLSPFQLPEWTTPNPCHPL* | 7589 | ATGGGAAGAAAGTTGATTTATCCCGTTCAGCCTCCTGAGTGGACAACTCCAAAC CCTTGCCACCCGCTATAA | 7590 |
| | 4 | MYEHFS* | 7591 | ATGTATATTGAGATATTTAGTTGA | 7592 |
| | 1 | MADVFPGNDSTASQDVAMRFARKGALRQKNVHEVKD HKFIARFFKQPFFCSRCTDFW* | 7593 | ATGGCTGACGTTTTCCCGGGCAACTGCACTGCCAGTCAGGACGTGGCCAACCGC TTCGCCCGCAAAGGGCGCTTGAGGCAGAAGAACGTGCACGAGGTGAAGGACCACAA ATTCATGCGCGCGTTCTTCAAGCAGCCACTTCTGCAGCCACTGCACCGACTTCATC TGGTAG | 7594 |
| | 2 | MAQGQRDSFKHDPVGQARWLTPVIPALWEAEAGGSPK VSSSRPAWQTW* | 7595 | ATGGCACAAGGGCAGAGGGACTCATTAAAATAGACCCTGCGCCAGGCGCGTG GCTCACGCCGCTGTAATCCAGCACTTGGAGGCGGAGGCGGGATCACCTAAGG TCAGTAGTTGAGACCAGCCTGGCAAACATGGTGA | 7596 |
| | 3 | MVKPRLLKIQN* | 7597 | ATGGTGAAACCCGTCTACTAAAATACAAAATTAG | 7598 |
| | 4 | MKQTILSTRD* | 7599 | ATGAAACAGACCCTGTCAACTCAGATTAG | 7600 |
| | 1 | MEAEAADAPPGGVESALSCFSFNQDCT* | 7601 | ATGGAGGCCGAGGCCGCGGACGCGCCTCCCGGGCGGGGTTGAGTCGGCAAGCTG CTTCTCTTTCAACCAGGACTGCACGTAA | 7602 |
| | 2 | MGGAGRWESQ* | 7603 | ATGGGGGAGCAGGGCGGTGGGAAAGCCAGTGA | 7604 |
| | 3 | MRKERKLQVDPGLCSWGPGR* | 7605 | ATGAGAAAGGAGAAGAAGTTGACCAGGAAGTGCGGGTTGAGTCGGCCCAAGG AAGATGA | 7606 |

Figure 1 (Continued)

| | | | | |
|---|---|---|---|---|
| hsa-mir-635 | 4 | MRVQEKLSHLSLSISTWHLGRASDKEAAYPCGQASPCPI PDAGHRACPLWMEETFGFLWLFSHRPPSQAGSPSRSPRL FSRAQTAFSPGNRSSTLLFLSGFLMPYFDVHIWALRGSW AEVCFRHLQDSVTYRQTPVSRPIFMEASPGDHMESSFW NVHPEHQAGMTDSQFPTSCCTSFCALAAGD* | 7607 | ATGAGAGTACAGGAAGAAAAACTTTGTCTTGAGCATTCTCCATTTGTCTTGAGCATTCTCAACGTGGCATCTG GGCAGGGCCTCGGACGCAGGGCATGTCGCCCACCCAGCCAGGCAGGATCTCCTCTGGAGTCC CATCCCGACGCTGTTTTCACATGCCGCCCACCCAGCCAGGCAGGATCTCCTCTGGAGTCC TCTTTGGCCTGTTTTCCGGCGCAGAGCTCTTCTCCAGGAAACAGGAGTCCACCCT AAGACTCTTTTCCGGCGCAGAGCTCTTCTCCAGGAAACAGGAGTCCACCCT GTTGTTTTTGAGTGGATTTTTAATGTTTTACTTCGATGTTCACATTTGGGCTTTGAGA GGGAGCTGGGCTGGAAGTGTGTTTCAGGCATCTCAGGAGTTCAGAAGCAACGCCTGTCTTCTTTCCCTATTTCATGGAAGCAGCCTGGGGACCATATGGAATCA ACGCCTGTTCTTTCCCTATTTCATGGAAGCAGCCTGGGGACCATATGGAATCA TCTTTTGGAATGTGCACCCTACCAGTTCTGTGCCTTGGCTGCTGGTGACTGA ACTTCCTCTGTCTGTACCAGTTCTGTGCCTTGGCTGCTGGTGACTGA | 7608 |
| | 1 | MSYGRPPDVEGMTSLKVDNLTYRTSPDTLRRVFEKYG RVGDVYIPRDRYTKESRGFAFVRFHDKRDAEDAMDAM DGAVLDGRELRVQMARYGRPPDSHHSRKGPPFRRYGG GGYGRRSRR* | 7609 | ATGAGCTACGGCCGCCCCCCTCCGATGTGGAGGTATGACCTCCTCCAAGGTGAC AACCTGACCTACCGCACTCCGCCCGACACGCTGAGGCGCGTCTTCGAGAAGTACGG GCGGGTCGGGCAGTGTACATCCCGGGACGCTACACCAAGGAGTCCCGCGGCT TCGCCTTCGTTCGCTTCACGACAAGCGCGACGCTGAGGACGCTATGGATGCCATGG ACGGGGCCGTGCTGGACGGCCGCGAGCTGCGGGTGCAAATGGCAAGATGGCCGC CCCCCGGACTCACACCACAGCGCGGGACCGCCACCCGCAGGTACGGGGGCGG TGGCTACGGACGCCGGAGCCGCAGGTAA | 7610 |
| | 2 | MWRV* | 7611 | ATGTGGAGGGTATGA | 7612 |
| hsa-mir-636 | 3 | MPWTGPCWTAASCCCKWRATAAPRTHTTAAGDRHPA GTGAVATDAGAAGKRG* | 7613 | ATGCCATGGACGGGCCGTGCTGGACGGCCGCGAGCTGCGGTGCAAATGGCGC TACGGCCCCCCGCCCGGACTCACACCACGCCGGAGCCGCCACCCGCAGGTA CGGGGGCCGTGCTGCTACGGACGCCGGAGCCGCAGGTAAACGGGGCTGA | 7614 |
| | 4 | MASGGEIMAAWAGARGRGRPRCLETPLCLLVPPAALG GVAAADPGVGVVPGLAADLATAARSLGPALVLDLGRP BSPDPHEGPSPSPRRSPDLVRGPGPGLGPGVLPQCPRGN PNPGRDRRVPPSLLKRKERCPLKKMVMSGNPRHITLHK WDLG* | 7615 | ATGGCGTCTGGGGGCGAGATAATGGCAGCCTGGGCGGAGCGCGGGGCGGGGCC GCCCCCGGCGTCGCCGCGGCCGATCCCGGAGTCGGTTCCAGCTCGCCAGCGAT CTCGCCTACAGCGCTCTCGGTCCCGCCACTCGTTCTCGAATCTCGGTCGACCT CCAAGTCCAGATCCAGATCCGCACGAAGTCCAAGTCGACACTCGGTTCGGTCTCCAGATCTC GTTCGGGTCCAGTCCGGTTCGGTTCGCAGAGTCCTCTCCCCCAAGTCTCCAGAAGAGGA AATCCAAATCCAGGTCGCGATCGAAAAATGGTAATGTCTGGAATCCAGAACACATAACCCTAAT TCATAAATGGGATTTGGGGTAG | 7616 |
| | 1 | MLERSLRDGQGLGLGGGRFCKGSHWGLPRGLCGDCGRE GAEDGGGDSDGALFGGPFWGVGETAVGGL* | 7617 | ATGCTGGAGCGGAGCCTTAGGGATGGGCAAGCCTTGGCGGCGAGGGGGAGGTTCTG CAAAGGGAGCCACTGGGGGTCTGCCTAGGGGTCTGTGCGGAGATTGCGGCGAGAAG GGGGCAGGAGACGGTGAGGAGACGCGGTTGGGGACTTTGA GGGGGAAGGAAGAACGCGGTTGGGGACTTTGG GGGTAGGGGAGGAACGCGGTTGGGGACTTTGA | 7618 |
| hsa-mir-637 | 2 | MGKALGAGGGSAKGATGVCLGACAEHAGEKGQRTVEE TQMGPFLAARFGG* | 7619 | ATGGGCAAGGCTTGGGGCGCGGGAGGTTCTGCAAAGGGAGCCACTGGGGTCTG CCTAGGGCTGTGGGAGATTGCGGGAGAAGGGACGAGGAGACGAGGAG ACTCAGGATGGGCCCTTTTTGCGGCGCCGTTTTGGGGTAG | 7620 |
| | 3 | MERGGRG* | 7621 | ATGGAGCGTGGGAGGAAGAGGTTAA | 7622 |
| | 4 | MVGGGRGCSIDEGLRPAEGKDQEGLR* | 7623 | ATGGTTGGGGGTGGGCGGGGGTGTCATCGATGAGGGGTCTTAAGAGACCTGCCGA GGGCAAGGACCAGGAGGCGTTAAGGTAG | 7624 |
| | 1 | MRRRP* | 7625 | ATGAGGCGGCGACCGTGA | 7626 |
| hsa-mir-638 | 2 | MGNRGMEELIPLVNKLQDAFSSIGQSCHLDLPQAVVG GQSAGKSSVLENFVGR* | 7627 | ATGGGCAACCGCGGATGGAAGAGCTGATCCGCTGGTCAACAAACTGCAGGACGC CTTCAGCTCCATCGGCCAGAGCTGCCACCTGGACCTGCCCAGATCGCTGTAGTGGG CGGCCAGAGCGCCGGCAAGAGCTCGGTTGCTGGGAGAACTTCGTGGGCCGGTGA | 7628 |
| | 3 | MARKAPPA* | 7629 | ATGGCGCGCGTGCGCCGGCCGGCGTAA | 7630 |

Figure 1 (Continued)

| | | | | | |
|---|---|---|---|---|---|
| | 4 | MTTPECLAQRLWKGVVGG* | 7631 | ATGACTACCCCTGAGTGTCTGGCACAACGGCTCTGGAAAGGGGTGGTAGGAGGGTAG | 7632 |
| | 1 | MAEQQTLSRASLTGGNSLEAMGEELFCLSGESKEEPQV STSHCQQQRRPPTNSISA* | 7633 | ATGGCTGAACAGCAGACTCTCTCTGAGCTCTCTCTGGAGCTTCCCTTACAGGGGAAACAGCTTGGAA GCCATGGGGAGGGAGGAACTTTTTGTCTGTCAGGGAGGAAGCAAGGAAGAACCCCAAGT TCTACCTCTCACTGCCAACAGCAGAGAGACGCCCCCCACCCAACAGTATTCCGCGTA G | 7634 |
| | 2 | MRLGYHLQVPPRPCHSWTDPSSWQHHQEMAKDTWSR VGFR* | 7635 | ATGCGGTTAGGTGTTCACCTCCAGGTGCCACCTCAGGCCTGCCACTCCTGGACTGAC CCATCCTCCTGGCAACATCACCAAGAGATGGCTAAGACACATGTCCAGGGTCGG CTTTTCGGTAA | 7636 |
| hsa-mir-639 | 3 | MVQRLLSVSVYSQRFKANGA* | 7637 | ATGGTCCAGGGTCGGCTTTCGGTAAGTGTTTACTCTCAACGTTTTAGGGCTAATGGT GCGTAG | 7638 |
| | 4 | MVRRKRRRKKTKINREFLNPHTLAFTATTLAQKVSSRSS PEASLNHQRAQEQKALLSLPSEAAPLSGPGRPLPPACPA GARSSLPGNYPNPAPKPTNGVGSCIHNPSPRS* | 7639 | ATGGTGCGTAGGAAGAGAAGAAGAAAAACAAAATAAATAGGAGTTTTTAAA TCCTCACACATTAGCACTTGCCACCATTCACTGCACAAAAAGTCAGCTCCAGATC AAGCCAGAAGCCAGCTGAATCATCAACGGCACAGGAACAAAAAGCCCTGCTCT CCTTACCCTCCGAGGCGCCCGGCTCTCCGGACCTGGGCGGCCGCTGCCTCTGCGT GCCCTGCCGGGGCAGGTCATCACTTCCGGAATTATCCAACCCAGCCCCAAGC CACGAACGGGTCGGCTCCGCATTCACAACCCTCACAACCCTGCCCGCAGCTGA | 7640 |
| | 1 | MKHYEYRSEKQCPCGHC* | 7641 | ATGAAGCATTACGAGTATCGGAGCGAAAACAGGGCGTGTGGCCACTCTGA | 7642 |
| | 2 | MRMCAGSIYKSATQAVLGVLFLGGLCRGWDACRFLAA PPAG* | 7643 | ATGCGCATGTGCGCAGGAAGTATTTATAAATCTGCAACCCAGGCTGTTTTGGGGTA CTTTTTCTTGGGGTCTCTGCAGGGCGTGGGACGCTTGCAGGTTCCTTGCAGCTCCC CCAGCGGGCTGA | 7644 |
| | 3 | MGATKVRDPCSQSEGVLHKSCATPPSPA* | 7645 | ATGGGAGCCACGAAGGTGCGGGACCCTTGCTCCCAATCCGAGGGAGTCTTGCACAA AATCTTGCCACGCCACCCCGCCGTCACCAGCTAG | 7646 |
| | 4 | MCLSP* | 7647 | ATGTGCTTATGCCCTAG | 7648 |
| | 1 | MLARLVSNF* | 7649 | ATGTTGGCCAGGCTGGTCTGGAACTTCTGA | 7650 |
| hsa-mir-639 | 2 | MSAFTFLRGSPTSLKCPSDWIVSFLRYTPTLPVSFFSISSG PPNALWLQFSEGSPVSPEVFPLT* | 7651 | ATGAGTGCCTTCACTTTCCTGAGGGGTCCCCACTCTTTGAAATGCCATCTGACT GGATCGTTAGTTTTCTGAGGTATACCCTACTTTACCAGTATCCTCTTTTCTATTC TTCTGCGCCCCAAATGCTCTATGGATCCTGCAGTTTCTGAGGGTCCCCAGTTTCT CCAGAGGTTTTCCCCTTAACTTGA | 7652 |
| | 3 | MLYGSCSFLRGPQFLQRFSP* | 7653 | ATGCTCTATGGATCCTGCAGTTTCTGAGAGGGTCCCAGTTTCTCAGAGGTTTTCCC CTTAA | 7654 |
| | 4 | MBPAVF* | 7655 | ATGGATCCTGCAGTTTCTGA | 7656 |
| hsa-mir-640 | 1 | MSRAVTPAPGSMCAAEFGRIIWPAARAGGRTGAASAAGP GGPTGGTSARGPASPAPPPGPAPAGDPCPAAPVTCALP* | 7657 | ATGTCCCGGGCCGTGACGCCGGCGCCCGGGTCCATGTGTGCCGAGGGGCGCAT TATCTGGCCGGCCGCCCAGGCGGAGCCGGCTCGGCCAGGCTCGCCGGCGGGC CGGGGCGGGCCCGGCGGCGGGAACGAGCGCCGCGCGCCGGCCCCGCCCCTCC GGGCCGCCCGGCTGGTAGCCCGGAGCAGCCGCCGGGACCAGCAGCCCCAAGCTGCGCGTGC CCTAG | 7658 |
| | 2 | MSVEK* | 7659 | ATGAGCGTGGAAAAGTGA | 7660 |
| | 3 | MGRAQAESLTDTWIVRTLGPRNEW* | 7661 | ATGGGCCAGGGCCCAGGCTGAGGCTGAGAGCCTGACGGACACTTGGATTGTGCGCACACTGGGG ACCCAGAAATGAATGGTGA | 7662 |
| | 4 | MNGDPSLRK* | 7663 | ATGAATGGTGATCCCTCCCTTAGGAAGTGA | 7664 |
| | 1 | MCGGRAPPERLGGCR* | 7665 | ATGGGCGGGCGGGCTAGAGCCCCGGAGCCCTGGCGCCTGCCGGTGA | 7666 |

Figure 1 (Continued)

| | | | | |
|---|---|---|---|---|
| hsa-mir-641 | 2 | MVASGPPAVPRWAVPPVPGGGTAALEPLLQELSGGGR AGAVGPASGGRGGGGGPYH* | 7667 | ATGGTCGCGTCCGGCCCCCGCGGTGCCGGGAATGGGCTGTACCACCGTGCCGG CGGGGGACCGGACCGCGGGGCCCCTCGAGCCCGCCCTCTCAGGAGGTGGCCGAG CGGGGCGGTGGGACCAGCCTCGGGGGCCGGGGCGGGGCCGGGGCCATACCA CTGA | 7668 |
| | 3 | MGCTTRARRGDRGPRAPPSGAEWGWPSGGGGTSLGGP GRWRRAIPLRRWGERCKPAGRGAQAAACAGRGLELSG AAGRSSLACAG* | 7669 | ATGGGCTGTACCACCCGTGCCCGCGCCGGGGAGACCGCGCCCTCCAGCCCCCTCTTCA GGAGCTGAGTGGGGGGCCCATACCTGAGGGCGGTTGGACCAGCCTCGGGGGGCCGG GGACGGGGACGCCAGGCGCACGGCGCCGAGCGCCGCCGGGGCGCAAGTTGCG GGACGGGGAGCGCAGAGTGAGCCTGGGCGTGCGCGGCTAA | 7670 |
| | 4 | MLPQLWLGYTTALGEPCLERRGTQIRGL* | 7671 | ATGCTTCCCAACTGTGGCTGGGTTATATCACCACGCGTTGGGAGGAGCCCTGCTTA GAACGTAGGGGACCCAAATCAGAGACTGTGA | 7672 |
| hsa-mir-642 | 1 | MSLSACFHLWLAAR* | 7673 | ATGTCTCTGTCTGCGTTTCATCTCTGTTAGCTGCTAGATAA | 7674 |
| | 2 | MHLGKGCSTYSGLYLPPAGKVL* | 7675 | ATGCTTGGGAAAGGGTTGTTGTCACTTACTCTGGGCTTTATCTACCCCAGCGGGGAAA GTTTGTAA | 7676 |
| | 3 | MCARKPFGLGEWELGWAFQVLHQAVGTQMCVSSTPL GGTENLQVFQPHEKGSRLLTVSTPSSPRRSPGSQESVGPD PGDTDTSAQRSSRATARSANTPPFHLCCPNNSQGRPGN HLRGPAHHRSSTHSACLSLPPDHHAWELRERVRCLGVP RVYGSPAVCPCV* | 7677 | ATGTGTGCTAGAAACCTTTGGGCTTGGAGAGTGGAGCTCGGATGGGGGCGTTTCA TACTGAAAACCTTCAAGTTTCAGCATGAGTGGGCGTTCAAGTACCCACTAGGGG TTTACCCCCCTCCTCTCAAGGCGGTCCCCATAGAAAAGGGCTTAGCGTGACCGT TCTCGGTGACACTGACACTTCCGCCAGCGTAGCTCAGGGCAACCGCCGGCTAGC AAACACCCCCCCCTTCCACCTTTGCTGCCCAACAACAGTCAGGGAGGCGGGGAA TCACTTAAGGACCCCGCCACCACCTCGCGTGCCTCCCT CGCGTATACGGCTCCCAGCCCTGTCCCCTGTGTGA | 7678 |
| | 4 | MGVSSSPPGCGNSDGRFKYPTRGY* | 7679 | ATGGGGGTTTCAAGTTCTCCACCAGGCTGTGGAACTCAGATGGGCGTTTCAAGTAC CCCACTAGGGGTACTGA | 7680 |
| hsa-mir-643 | 1 | MAWRYGATAAREFSV* | 7681 | ATGGCGTGTAGATATGGCGCAACTGCGGCGCGTGAGTTTTCTGTTTAG | 7682 |
| | 2 | MAQLRRVSFPLFRLSVRLAVPSRPCTRDVGGGTDLEPA PLSPPRVNSCVPSEC* | 7683 | ATGGCGCAACTGCGACGCTTCGTGTACCGGGATGTGGGGCGGTACAGACCTTGAAATCCCC GCACGGCTCTCTCCACCCCGAGTAATTCATGCGTCCGTCAGAGTGTTAA | 7684 |
| | 3 | MWGAVQTLKSPHRSLHPE* | 7685 | ATGTGGGGCGGTACAGACCTTGAAATCCCCAGCTCTCCACCCGAGTAA | 7686 |
| | 4 | MRPVRVLKSP* | 7687 | ATGCGTCCGTCAGAGTGTTAAAATCCCCTAG | 7688 |
| hsa-mir-644 | 1 | MRMFGENKGKGVGKAVRDPFKAAAAPSSRAGVCRGRG ELGLLARAGRWGWAVWTFGGISVWHRLPEAFASRAPS CERAGPFRAWVPSGPSPLSPAWGHSPAVRPTRGARRRG RRGRRGPVRGGGRVPRHPAGLLETFPSPQSLEGPSTAAA SPSLSHSPPPSIVPPAWWSRLRRPPRPPSWRRRLLQT WSCHCPSSGECPEL* | 7689 | ATGAGAATGTTCGGCGAGAACAAGGGTAGAGGAGTGGACGCGGTTCGGAGACCC CAGAGCCGCGGCTACTGGCCGCGGGTGCTCTCCAGGAGCCGGTGTCTGTGGGAGG TCGGCTACTGGCCGCCGCAGGCTTCGGAGGTTCGGAGGTTCGGAGACGTCGAACGG ATCAGTGCTCGGCAGCAGGCTTCGGCTCGCTCGGCGGTGTCCGCGCTCAAGTTGTGAA AGGGCTGCGCACTCTCAGCGGTGCCGCCGGGGTTCGCGTCACGCCGCTCAGGC CTGGGGGCCACTCTCAGCGGTGCCGCCGGGGTTCGCGTCACGCCGCTCAGGC CTTCTCGAGACTTCTCCCACTGCCTCTCTTCCCAGCGCCCAGAAGGGCCACAGCCGGCTGCC TCCCCTTCTCTCTCCCCACTGCCTCTCTTCCCATTGTCCCCCCGGCGTGGTGGTCC CCGGAGCTGTCACTGCCTGCCGCCACTGCTGTGCCGCCGACTTTGCAGA CGTGGAGCTGTCACTGCCTGCCGCCCTCTCCGGAGAGTGCCTTTCTTAG | 7690 |
| | 2 | MTFKWRTQVFQDSSRPQKRESQNLCARSRRWA* | 7691 | ATGACTTTTAAGTGGAGAACTCAAGTTTCCAAGACAGTTCCCGTTCCGCAGAAAA AGAGAATCGCAGAATTGTCGCCCGAAGTAGACGCTGGCCTAA | 7692 |

Figure 1 (Continued)

| | | | | | |
|---|---|---|---|---|---|
| | 3 | MGNCHFALKISKTLEPATHLGGFSCIFS* | 7693 | ATGGGGAATTGTGGGATTTTGCCTTGAAAATTAGTAAGACCCTGGAGCCAGCCACCCACTTAGGTGGGTTCTCCTGCATCTTTTCCTGA | 7694 |
| | 4 | MVYQLR* | 7695 | ATGGTTTATCAGTTGAGGTGA | 7696 |
| hsa-mir-645 | 1 | MVLHTSG* | 7697 | ATGGTTCTCCATACTTCAGGGTAG | 7698 |
| | 2 | MWIPMIPESLGPWRAAAGD* | 7699 | ATGTGGATTCCTATGATACCTTTCTCCCTGGGACCATGGAGGGCAGCAGCTGGTGATTGA | 7700 |
| | 3 | MEGSSW* | 7701 | ATGAGGGCAGCAGCTGGTGA | 7702 |
| | 4 | MSANYMCP* | 7703 | ATGTCTGCCAACTACATGTGTCCTTAG | 7704 |
| | 1 | MLPGSPAV* | 7705 | ATGCTCCCAGGCTCTCCCGCAGTTTAA | 7706 |
| | 2 | MGVLHDYS* | 7707 | ATGGGAGTCTTACATGATTATTCATGA | 7708 |
| hsa-mir-646 | 3 | MIHEGLGRGVAVKHVLGCLLVAHVLWLCMLVHTSHVSLAS* | 7709 | ATGATTATTCATGAAGGCTGGAAGGGTGTGCCGTGAAGCATGTTCTGGGCTGTCCCTGGTTGGCACATGTCTGTGGTTGTGCATGCTAGTACACACATCGCATGTCTCGTTAGCATCGTAA | 7710 |
| | 4 | MKGWEGVLP* | 7711 | ATGAAGGCTGGAAGGGTGTTGCCGTGA | 7712 |
| | 1 | MRAARPGPQRGLRAPWLRPRPARTLILRPRRIHLRPETHQAGRLRKARPRARTGRRGPRLHSTGEREGAADPAELGGWSVPAASPSPPLPEARRRRPVLPRAGWNPAGLKRPGGRTWPKPAGSSGLGEGVRVRTPSVDLGLCPRWVGPSASSARRAVCLLDCASWSMLSARGVALPDPRGQGLGFGGAAAHGAFGLPRTRVAPSSLCGGFARA* | 7713 | ATGCGCGCCGCCGCCGGCCAGGCCGCAAAGAGGCCTCGAGGCCATGCTGCGCCCCGGCCGCCGCGGACGCTGATCTTGGCCAGTCCGCACTCCAGGCGCCCACTCGGCAAGGCGATCACACACCAAGGCCGGACAGCTGAGAAAAGCGAGACTCGAGGCCGGTAGGCGTGGGCCTCGCCTCCACTCGCGAGCGGCGAGCTCCCACTCCCGAGATCGGCAGCTGGGCGGTGGTCGTCCGCGCGAGCCGCCCTGCCACCCGGAGCAGGCGGCCGAGTCAGGCGGCCGGCGCCCCGTTCTCCCACGCGGTCCCGGTGGAAACCCCGCGCCGGCTTGAAGCGGCGCCGGAGGAACCTGGCCAAGGAGGGTGAAGGAGGAGTGCCGGGTGCGCACCTGGGAGCCGGTGCCGCTCGCCAGCCGGTGCCAGGCAGGTCCCGGCTTCCATGGGCGCCGCCGAGTGTGGCCCTGTCGCGCACCGCGCCGCCCGGAGTCCAGGCGCGCACAGGGCGCACCGCCCCGGAAGGCCAGGGGCCGAGGGCTTGGCTGTCTATGTTGTCGGCCGGGTGTGCCACGCACAGGTCCTTCGGATTGCCTGCGGCTCCACGCCGGTGGCCAGGCTTAGGATTGGAGGTGCTGCGGGGCACGCCCACGGCCACCGGACCGCGGCTGCTCCAGCCTCTGCGGGGGCTTTGCAAGAGACATGA | 7714 |
| | 2 | MAAPPARADADPSPTSPPTARDTPGRQAEKSETACEDR* | 7715 | ATGGCTGCGCCCCGCCGCGGCGGACGCTGATCTTCGCCACGTCGCCACCTACGGCCCGAGACACCAGCCGGCAGCCGGCAGCCGGCAGCCGGCAGCCGGCAGCCGGCAGCAGCGGCAGCCGGCAGCCGGCAGCTGAGAAAGCGAGAGCGCTGTCGAAGAGACCGGTAG | 7716 |
| hsa-mir-647 | 3 | MKWGSCGGAAGGTRPHPGSSPRVAPLGAGPCAAPLGPWPSCGGGHAVPGAARGRSGRCPSLPGLKCPLLGSPRGPQEGVVPTQAPLAWVQAVTPVRNAVSQDSLRDGLRWMPQGEGCPGTGSLLSR5C* | 7717 | ATGAAGTGGAGTTGTGGGGTGCAGCGGGAGGAGAACCTGCCGCCCCGCCCGTCGTCACCCGGAGTGGGCCTGTGGCCACGCAGTGCCGGGTGCCCAAGAGGTGCTCTTGGGCCTGTGGCCCCTCCTTGGAGTCTGAAGTCTGCCTGGCTCCCAGGGATGCCTGGGGTTTCCCAGAAGGGGTTGCCCACTCAGGCGAGCAGGACTCCCTGCGCTGTCTCCAAGAGATGGCTGCGCTGGATGCCGCAGGGGGAAGGTGTCCGGGCACAGGTCCGGCACAGGTGCTCTCTCCAAGGAGTGACTAG | 7718 |
| | 4 | MGCAGCRRGKGVPAQGRSSPGAAEQKELSPGPASLQVHTLPVGSD* | 7719 | ATGGGCTGCAGCTGTGAATGCCGCTGAGCAGGAAGACGTGTCCCGGCCTGCGTCCTTCAAGGTCCACACCCTCCAGTGGGCAGTGACTAG | 7720 |
| | 1 | MRQK* | 7721 | ATGAGGCAGAGTAA | 7722 |
| hsa-mir-648 | 2 | MRGQVRRLVLSSGAAGACKRGEAARFRREAEGGGLARLWVRGRGVLFGAGFVSVFTGVRRLRAEAPPGPASAAWPSGPPRPAAPAWS* | 7723 | ATGCGTGGCCAGGTGCGCCGGCTGGTCCTGGGCAGGCGCCGGGAAGCGCGGGAGGCTGCCTGCCCGCCGGGGGCAAGAGGCGAGGGCTTAGCCGGCTCTGGGTGCGCGGGGCCGGGGGAAGGTCTCTGTCTTTACCGGAGTCCGCAGGGTCCCGGGTCCCCGGTCGCCCGCTGGCCCGAGCTAG | 7724 |

Figure 1 (Continued)

| | | | | | |
|---|---|---|---|---|---|
| | 3 | MPLPWLPSEGTALLEVSGAHGKFPAKKPS* | 7725 | ATGCCCCTTCCCTGGCTGCCTTCCGAGGGACCCTGCTGCTTTGGAGGTCTCCGGGGCA CATGGGAAATTCCAGCTAAGAAGAACCATCTTGA | 7726 |
| | 4 | MGNSQLRNHLEEPYTEPGLPGLAESQPQRDPPPGMRH W* | 7727 | ATGGGAAATTCCAGCTAGCAGAAAGCCAGCGCAGGAGACCCTCGCCTGGCATGCGGCACT GGTGA | 7728 |
| hsa-mir-648 | 1 | MIRLCVLLDYF* | 7729 | ATGACAAGGTTATGTGTTTGCTGGATGTCTCTAA | 7730 |
| | 2 | MCFAGCLLRHYLDCLWWGSVSFVTSLCFSDLRFPLNA ALSPLVGKTPSIRVSHARHPPVRMPRTTHSPEPAREQGC LPATSTPPSLCFYPAGKGRAYTPGTPEVGQVSGQPAGFW RSRVRSG* | 7731 | ATGTGTTTTGCTGGAGTCTTCTAAGAATCATTATTTAGATTGCTTATGGTGGGAA GCGTTTCCTTTGTGGACATCTTGTTCTCGGATCTATTTCGTTTCCTCTAAACGC AGCCCTCTCCCCGAGTGGGAAAGACACCTATCCGTGTCTGATCATCGCACG ACACCACCAGTCGGATGCATGTACCACACACTCCCAGATCTGCCAGAGAGC AGGGCTGTCTCCCAGCCACTCCCACCCATTTCATTGTGCTTCTATCCGGAGGCA AAGGAAGAGCGTACCAGGCACCCGAGTTAGGCCAGGTCAGGACAGCCAGCA GGCCCTTGCTGGGTCCGCTCTGGCTAG | 7732 |
| | 3 | MSSKNHLFRLLMVGKREFLCDJFVFLGSISFPSKRSPLSPS GKDTQYFCLDHRTPPTSADATYHTLPRACQRAGLSPSH VHPHFIVLLSRRQRKSVPREHPRGRPGVRTASRPLAKPGPL WLAQRGEPMSSLGAAAALRGHERRFPCGRGALHPPAAR GGGPGPVAHTLALPGCRARCAGAAPGRVQQKDGQVHS LLEAERGGAA* | 7733 | ATGTCTTCTAAGAATCATTATTTAGATTGCTTATGGTGGGAAGGCGTTTCCTTTGTG ACATCTTTGTGTTTCTGGATCTATTCGTTTCCTCTAAACGCAGCCCTCTCCCC TAGTGGGAAAGACACCTATCCAGTATGCCCCAGAGCCTGCAGAGAGCAGGCTGTCTCCCA GGATGCCAGTCACCCACACACCAGTCGCCAGCTCTCCAGAGAGCAGGCTCTCCCA GCCACGTCCACCCCATTTCATTGTCCTTCTATCCGCAGGCAAGGAAGACGTAC CCAGGGCTAGGCCAGGTGTCAGGACGCCAGCCATGAGCAGCCAGCCCTGCGAAG CCGGGTGCTCGTGGCCTAGTCAGCGCGTGAAACCGAGTCTCAGGAGCAGC CGCGCGCGGCGCTGCCCGGCGACTTCCCTGCCGCAGGTGCGGCCCTGCACCCGC TGCAGGGCGCGCTGCACCCGCCGGCGTGCAACAAAGGACGGCCA AGTTCATTCCCTCCTGGAAGCAGAGGCCGGGGCCGCATGA | 7734 |
| | 4 | MTSGGCMCLRIKWL* | 7735 | ATGACTTCTGGAGGCTGCATCGTCTTAGAATGCTTATGA | 7736 |
| hsa-mir-649 | 1 | MSKDQLFPSPGMASVTSTSHDGCDIH* | 7737 | ATGTCAAAGATCAATTATTTCCTCTCTGGCATGCCTCTGTGACATCCACTAGTC ATGATGGCTGTGACATCCACTAG | 7738 |
| | 2 | MMAVTSTSASARPMTQPQPLPVPSNIFHYCPCHACMRL WPPRRPLDAPLASSLLGAHHTAAKLNPHTRHHESLQP LFLPSGGPPPMVATHPS* | 7739 | ATGATGGCTGTGACATCCACTAGTGCTTCAGCCAGACCCATGACTCAGCCTCAACCC CTTCCTGTCCCTCAACATTTTCACTACTGCCCATGCCATGCCTGCATGCTGAGACTAT GGCTCCTAGAAGGCCTTAGATGCCTCTCGCCTACTGCTACTCGTTGGTGCAC ACCACAGCAGCAGCCAAGTGAACTTTCACACGCAAGCATCATGAGAGCCTGCAGCCCC TGTTTCTACCCTCAGGAGGCCCAATGATAGTGGCCACCCATCCTCCTAA | 7740 |
| | 3 | MPCLHEIMAS* | 7741 | ATGCCATGCCTGCATGAGACTATGCTCTAG | 7742 |
| | 4 | MPLSPPPYCLVHTTQPS* | 7743 | ATGCCCCTCTGCCTCCTCATGGTCCACACCACACAGCAGCCAAGTGA | 7744 |
| hsa-mir-650 | 1 | MAWTALLLSLLAHPTGAAPSVPATYPAPRLWVQPGLTV ISAGPCLWCAGCS* | 7745 | ATGGCCTGGACCGCTCTCCTTCTCTCTTGCTCACTTACAGGTGCTGCCCCA GTGTCCAGCCACCTACCCTGCCTTGGGTCTGGGTCAGCGGCCTGACAGTGA TCTCAGCAGGGCCCTGCCTGTGGTGCAGAATGCTCATGA | 7746 |
| | 2 | MLMILLQGEGLLEVKSPHTVLLCSWSPEDTSIPETQARQ VGRHCWVEPLSFKSRLFSPLFLQVLWPPMS* | 7747 | ATGCTCATGATCCTGCTGCAGGGGGAGGGCTGCTGGAGGTGAAATCCCCACAC TGTTCTCTGTGTCCATGGTCCCCTGAGACACTCTATTCTGAAACTCAGGCAG GCAGGTGGGAAGGCATTGTTGGGTTGAGCCCTCTCAGTTTCAAGTTCTATTCTC TCCCCTTTTCTTGCAGGTTCGTGTGGCCTCTATGAGCTGA | 7748 |
| | 3 | MCTGTSRSQARPLCWSSIGHATGPGLSDSLAPTRGTR PP* | 7749 | ATGTGCACTGGTACCAGCAGAAGCCAGGCCAGGCCCTGTGCTGGTCATCTATAGG GATAGCAACCGGCCCTGCTGGAATCCTGGGACATCCCTGAGGCGATTCCTGGCTCCAACTCGGGAAC ACGGCCACCCTGA | 7750 |

Figure 1 (Continued)

| | | | | | |
|---|---|---|---|---|---|
| | 4 | MRLTITVRCGTAALHTVTQADEEVRHKPERHLCHPLSLI QGGL* | 7751 | ATGAGGCTGACTATTACTGTCAGGTGTGGCGACAAGCAGCACTGCACAGTAACACA GGCAGATGAAGAAGTGAGACAACCCTTTGCCCATCTATGTCACCCTCTTTCTCT AATTCAAGGAGGACTATGA | 7752 |
| hsa-mir-651 | 1 | MKQKHRDRIKFQMNRTFVLGKCIRRFQIQEPTPLPNFYC EHPCFYERQYNYSVTQ* | 7753 | ATGAAACAGAAAATTATTAGAGACCGTATCAAATTCAAATGAACAATACAATTGTT CTTGGTAAGTGTATCAGAAGATTTCAAATACAGTTCCCTACCCCTCCAATTCT ATTGTGAGCACCCATGCTTTTATGAACGCCAATACAATTACTCAGTAACGCAATAA | 7754 |
| | 2 | MNANTITQ* | 7755 | ATGAACGCCAATACAATTACTCAGTAA | 7756 |
| | 3 | MQYISLPSISTQTEVMPGEGNLRLYEMSATPLYTWNTS KYKJTCPPMPQCAQFAQVNEIVPPQGCPP* | 7757 | ATGCAATACATTCTTGCCAAGTATCTCAACAACAACTGAGGTCATGCCTGGTGAA GGCAGATGTCTATGAAATGTCAGCCACGCCACTTATACTGTGAACACATCT AAATACAAAATTACATGTTTTCTATGCCTCAGTGGCACAATTTGCCCAAGTGAAT GAAATTGTGCCTCACAAGGCTGTCCATTCTGA | 7758 |
| | 4 | MKCQPRHFLGTHLNTKLHVFLCLSAFNLJK* | 7759 | ATGAAATGTCAGCCACGCCACTTTATACTTGGAACACATCTAAATACAAATTACAT GTTTTCCTATGCCTCAGTGCGCACAATTTGCCCAAGTGA | 7760 |
| | 1 | MVHHPGNPLGLCSISLLLPVLWSRGTTASCPGIATRVSW TGSMGAWTPVLQAMGAPTVLPSSLGSSGCWKVWWS* | 7761 | ATGGTCCACCACCGGGCAACCCTCTGGGCTTGTGTTCCATCTCACTCTTGCTTCTG TACTGTGGTCAAGGGAACCACTGCATCATGTCCCGTATAGCTACCAGAGTCCT GGACTGGCTCATGGGGGCTGGACCCCAGTTTGCAGGCAATGGGGCCCCGACT GTGCTGCCTTCCTCTCTTGGCAGCAGCGGCTGCTGGAAAGTGTGGTGGTCCTGA | 7762 |
| hsa-mir-652 | 2 | MSRYSYQSLLDWLYGGVDPSFAGNGGPDCAAFLSWQQ RLLESVVVLTLALLEHVALRHLRQTKEDGRGSPGSQP EQVTQRPEEGCKESLSKNLLLVALCLIFGVEVGFKFATKT VIYLLNPCHLVTMMHVSLLTPSWAS* | 7763 | ATGTCCCGGTATAGCTACCAGAGTCTCCTGGACTGGCTCTATGGGGGCTGGAGCCCC AGTTTTGCAGGCAATGTGGGCAGGCAGACGCTTAGTGTTGGGTAGCCTGGCAGCCTG CTGCTGGAACATCTGAGGCAGCAGAAGAAGGACGGGTAGGGGTAGCCTGGCAGCAGGCGAGCTG CGGCACACATCCTGAGGCAGCAGAAGAGGACGGGCAAGGAGGAGCCTGGCAGCCAGCCAGCCAGCCAGCCTG GCAGCAGGTGACCCAGCCCGTGACCTGCTCAACCCTGTCACCTGGTCACCATGACAGTGAGT CTCTTAGTAGCCTGCCATCTACCTGCTCAACCCTGTCACCTGGTCACCATGACAGTGAGT AAGACCCGTACATCTACCTGCTCAACCCTGTCACCTGGTCACCATGACAGTGAGT CTGTTGACTTTTTCCTGGGCATCCTAA | 7764 |
| | 3 | MCSGHSIVYSTSSRRAGGPLKMIPQRVAAFVPISGLAFF HLCTVRQPHSGGEEPCA* | 7765 | ATGTGCTCAGGACGCACTCCATAGTCTACAGCAGCCTCATCCCGGCGGCAGGGACC TTTAAAAATGATTTTCCAACGAGTGCTGCTTGTGCCGATTCAGTTTGGCTTC TTTCACCTTTGCACAGTGGCTGCAGCCCCACAGTGAGGTGAGGAAACCCTTGCCTGA | 7766 |
| | 4 | MTQLPCLLW* | 7767 | ATGACCCAGCTGCCTTGTGGTAG | 7768 |
| hsa-mir-653 | 1 | MGAEA* | 7769 | ATGGGCGCTGAAGCTTGA | 7770 |
| | 2 | MSG† | 7771 | ATGAGCGGGACTTAA | 7772 |
| | 3 | MFNSAGAIGTLLFDYRNVV* | 7773 | ATGTTTAACAGTGCAGGTGCTATAGGCACCTTGCTTTTTGATTATAGAAATGTGGTTTGA | 7774 |
| | 4 | MWFDCGACGSHVGSARS* | 7775 | ATGTGGTTTGATTGCGGTGCGTCGCATGTTGGTTCTGCCAGGTCTAG | 7776 |
| hsa-mir-654 | 1 | MDQGVEGGGCGPGVGRQSACSL* | 7777 | ATGGACCAGGGGGTAGAGGGAGGGCTACAGAGATAGGCGAAAGAGTGGGGCTGAGGATAG CTTGCAGCTATGA | 7778 |
| | 2 | MKDGKEGYRDRGRVGLRIARAAWHTVLG* | 7779 | ATGAAGGACGGGAAAGGGAATACAGAGGGCTGTCTTCAAGGTCTTCTTCAAGCGTGTCTAATGGGAGACAGC CCAGAGCGGGCTTGGCACACAGTTTTAGGGTAA | 7780 |
| | 3 | MTEPYTPGSSFKACLMGDSVVPVTKLGPESQGRAHQV AALP* | 7781 | ATGACTGAGCCGGTCACTCCAGTAACCAAATTGGGACCAGAGTCCCAGGGAAGTCCCAGGGAAGGGCTCATCAGGTGGC CGCTCTGCCTTGA | 7782 |
| | 4 | MILFPLDPAPLVPFSL* | 7783 | ATGATTCTCTTCCCTCTGGATCCAGCCCCTCTAGTTCCCTTTGA | 7784 |

Figure 1 (Continued)

| | | | | | |
|---|---|---|---|---|---|
| hsa-mir-655 | 1 | MDQGVEGGGCGPGVGRQSACSL* | 7785 | ATGGACCAGGGGGGTAGAGGGAGGTGGGTGGACCTGGGGTCGCGCCAGTCAGCTTGCAGCCTATGA | 7786 |
| | 2 | MKDGKEGYRDRGRVGLRIARAAWHTVLG* | 7787 | ATGAAGGACGGGAAAGGAGGGCTACAGAGATAGGGGAAGAGTAGGGCTGAGGATAGCCAGAGCGGCTTGGCACACAGTTTAGGGTAA | 7788 |
| | 3 | MTEPVTPGSSPKACLMGDSVVPVTKLGPESQGRAHQVAALP* | 7789 | ATGACTGAGCCGGTCACTCAGGGTCTTCCTTCAAAGCGTGTCTAATGGAGACAGCGTTGTCCCAGTAACCAAATTGGGACCAGAGTCCCAGGGAAGGGCTCATCAGGTGGCCGCTCTGCCTTGA | 7790 |
| | 4 | MILFPLDPAPLVPFSL* | 7791 | ATGATTCTTCCCTCTGGATCCAGCCCCTAGTTCCTTTTCACTTTGA | 7792 |
| hsa-mir-656 | 1 | MDQGVEGGGCGPGVGRQSACSL* | 7793 | ATGGACCAGGGGGGTAGAGGGAGGTGGGTGTGGACCTGGGGTCGCGCCAGTCAGCTTGCAGCCTATGA | 7794 |
| | 2 | MKDGKEGYRDRGRVGLRIARAAWHTVLG* | 7795 | ATGAAGGACGGAAAGGAGGGCTACAGAGATAGGGGAAGAGTGGGGCTGAGGATAGCCAGAGCGGCTTGGCACACAGTTTAGGGTAA | 7796 |
| | 3 | MTEPVTPGSSPKACLMGDSVVPVTKLGPESQGRAHQVAALP* | 7797 | ATGACTGAGCCGGTCACTCAGGGTCTTCCTTCAAAGCGTGTCTAATGGAGACAGCGTTGTCCCAGTAACCAAATTGGGACCAGAGTCCCAGGGAAGGGCTCATCAGGTGGCCGCTCTGCCTTGA | 7798 |
| | 4 | MILFPLDPAPLVPFSL* | 7799 | ATGATTCTTCCCTCTGGATCCAGCCCCTAGTTCCTTTTCACTTTGA | 7800 |
| hsa-mir-657 | 1 | MGDPGRNIGEGMAPQRPGQPAALSTWYSPRQVETQPGSSFMAVAARYRSRPVCKASHPHSTSTGATQRAWGGGAAASRLETCK* | 7801 | ATGGGGGATCCTGCCCTAAGCACCTGGTACAGTCCAGCGCCCAGCCAACCTGCTGCCCTAAGCACCTGGTACAGTCCAGCGCCCAGCCAGTTCTTCCTTCATGGCTGTCGCAGCACGGTACAGGAGCAGGCTGTGCAAAGCCAGCCACCCCACTCACCAGCACCAGGTGCCACCCAAAGGGCATGGGTGCGGGGGGCGCTGCCAGCCGCCTCGCCTCGAAAACCTGCAAGTGA | 7802 |
| | 2 | MGWGGGCQPPRNLQVRRGPLSTKTRPGCAPGFPHLSP* | 7803 | ATGGGGTGGGGGGGGCCGCTGCCAGCGCCTGCAAGCTGCAAGTGAGGCGAGGCCCTGAGCACCAAGAACCCGCCCTGGGTGTGCCCACCGTGTCCCCTG | 7804 |
| | 3 | MPPLRVPPPSPLLCPPLRAPLCLPLRVPLSVLPPCHPGRGGPPPPPRRSARAPARVFGLHQRSPAAPGPGGAPRLSPPPPPVRALRLRRGARGAGAGALRTCGGRWVMRRLGPGPRAS* | 7805 | ATGCCTCCTCGTCCCCCTCCGTCTCCCTGCTCCTCCTGCTCCTCGTGTCTCCTGTCTCCCTGCTCTGGAGGGCCCCCCCCGCCGCCGAGCCCGCGCGCTCCCGCGCGTCCGCAAGGCCGACTGCACCAGCCGGGCCGCGAGCAGTTCCGGACTGCACCAGCCGGGCCGCGAGCAGCGCCTCGTCTGTCGCGCGGGCGCGCCCGGGCGCGGGGCGCGGCTCCGGCGCCCACCAGAGGGCGCCAGCGGCCTCCGCGCCGCTCA | 7806 |
| | 4 | MPPRPRRAPPSPAPLRARSRPRFRTAPAEPRGARAGRSASSVAAAPTGAGSAAAGGAGRGGRRAPHLRRPLGDAAARAGAAGVLSAAPSRDARRPLARPCRRPSSTPASPSARTSTPVSPWRPGLRAAASLRCGRDAPGPHGSRFAWKLTLSPPRAQQQKQPDPLAAPDLGGAGPGPQHKPASACGLASPAWS* | 7807 | ATGCCACCCCGGCCACGGCGCGGAGGGCCCCCCTCCCCGCCCGCCGCTCCCGCCCCCGGTTTCGGACTGCACCAGCAGCTGGACTGCGGCTGCAAGGCCGGGGCGGAGGCGGCTCGTCGTGCGCTGGCGCCGGGGATGCGGGCGGCTCGGAGCCCCGCCGCCTCCGAGGCTCGCCGCAGCCTCCGCGCCTTCTTCAACCCAGCTTCGCCTTCAGCTCCGCACTTCGACCCGACCCGGTGAGTCCCTGGGTCCTCCTGGGCCCCACGGCTGCCCGGGTTGCATGGAAATTAACCCTTTCCCGCGCCCGATGCCCGCAGCAGCACCGGAGCCGGACCGCGACCTGACCGACAGCCGCCCAGATCTCGGAGGGCCCTGGCGCCTGGATGCGCCAGCACAAACCGGCCTGCTGCGGCCTGCCGCGTCCCCGCGTGGTCGTGA | 7808 |

Figure 1 (Continued)

| | | | | |
|---|---|---|---|---|
| hsa-mir-658 | 1 | MAAAAGDADDEPRSGHSSSEGECAVAPEPLTDAEGLFS FADPGSALGGGGAGLSGRASGGAQSPLRYLHVLWQQD AEPRDELRCKIPAGRLRRAARPHRRLGPTGKEVHGERR ERRGPGRGJSPGEGRGLRGPVAALWSPPTLSRGPPTSA LRATLTLESPFSNDGDDGFFRKSSCSEPVTPVFSHWVISE WKLPMTRNAYW* | 7809 | ATGGCAGCGCCGCGGGACGCGGACGACGAGCCGCGCTCAGCGCACTCGAGCTC GGAGGGCGAGTCTGCGGCGGCGCGGAGCGCGCCGAGCGCGTGACGGCTGAGGGCTCTCT CCTTCGCCTGACTTCGGGTCGCGGTGCCCAGTCGCCGCCGCTGCTCACTGCTCGGCCGG GGGTCCGGGGCGCGCGAGCTGCGCTGCAAGATACCGCTTGGCCGGCTGAGGCGCG TGCCGGAGCCGCCGCCGACGAGCTGCGCTGCAAGATACCGCTTGGCCGGCTGAGGCGCG CTGCCAGGGCCACCGGCGCTCGCTGCGGCCCACCGGCAAGGAGGTCACGGTGAGGCGG CAGGACCAGTGCGCCCGCGGTGGCGCAGCCGGGCAGCCGGACCCTCAGCCGGGTCCCCGACGT CTGCGCTGAGGGCCACACTGACCTCTGAGTCCTTCAGTAACATGGTGATGATG GTTTTTTAGAAAGTCTTCCTGCTCGAGCCAGTCACCCCAGTCTTCTCTCACTGGGT AATTTCTCAATGGAAACTTCCCATGACTCGGAACGCTTATTGGTGA |
| | 2 | MRSRATSCAARYPLAG* | 7811 | ATGCGGAGCCGCGCACGAGCTGCGTCAAGATACCGCTGGCCGGCTGA | 7810 |
| | | | | | 7812 |
| | 3 | MVMMVFLESLPALSQSPQSSLLTG* | 7813 | ATGGTGATGATGGTTTTTTAGAAAGTCTTCCTGCTCGAGCCAGTCACCCCAGTCTT CTCTCACTGGGTAA | 7814 |
| | 4 | METSHDSERLLVNNKMRYWGTLLLSWRGEARACSQV VPACLNARTWTPLPQLDLKANDRPFQP* | 7815 | ATGGAAACTTCCCATGACTCGGAACGCTTATTGGTGAATAATAAAATGAGGTACTGG GGAACACTTCTTATTATCATGGAGAGGGAGGCGAGACCTGCAGCCAAGTCGTACC AGCTTGTTTAAATGCACGGACTTGGACTCCTTTACCACCAGTTAGAACCTTAGGGCAAA TGATAGACCCTTTCAACCTTAG | 7816 |
| hsa-mir-659 | 1 | MARPPQKLNSGLRKIPF* | 7817 | ATGGCAAGACACCCCAGAAACTAAACTCAGGTCTGCGTAAAATTCCTTTGA | 7818 |
| | 2 | MNNCHLLNI* | 7819 | ATGAATAACTGTCACCTTTTAAATATATGA | 7820 |
| | 3 | MTYPSYY* | 7821 | ATGACTGTCCAAGTTACTACTAA | 7822 |
| | 4 | MDNTDY* | 7823 | ATGGATAACACTGACTACTAA | 7824 |
| hsa-mir-660 | 1 | MSRAPASLPLLPGWAV* | 7825 | ATGAAGCTGCGCGCTACGTCGCCTCCCCTCCCGCTGGGCTGTGTGA | 7826 |
| | 2 | MKLCRLRGALTQLGVLDARADRARCFPAADTGSAAPD LGDR* | 7827 | ATGAAGCTGCGCGAGCCGGCTACGTCGGGGCTGCTCACTCAACTTGGTGTCCTGGACGCCAGA GCCGACCGAGCGCGTGCTGCCACCGGCGGCGACAGCGTGCTCCGCCGCTCCGGACCT CGGCGACAGGTAA | 7828 |
| | 3 | MGLPRARRWQPGA* | 7829 | ATGGGGCTTCCCCGGGCTCGGAGGCGTTGGCAGCCCGGCTTAG | 7830 |
| | 4 | MVPGLPERSFLAERRQARPAPESECLAACVPFPGLG* | 7831 | ATGGTCCCTGGGTTGCCCGAGAGCTTCCTTGCGAGCGGCGCCAAGCCCGCCCC GCTTTGAATCGGAGTTGTTTAGCGCGCGCCTTTCCCGGACTGGGTAG | 7832 |
| hsa-mir-661 | 1 | MDPSRAIQNEISSLKGAVLGPGPSRGARTTQ* | 7833 | ATGGACCCCTCGGAGCAATCCAGAACGAGATCAGCTCCCTCAAAGGTGCGGTCCTG GGGCCGGCCGAGCCGGCGGACCACAGTGA | 7834 |
| | 2 | MPQCGVCGAGRVGGEHSAPGSSLRLPFPPAGPWLVGG RGLPPSPAPSLLEEATALSCPEPAWGRRGWLGGGPAGV SPGTPAGLCRREPRSTCF* | 7835 | ATGCCGCAGTGCGGGGTGTGTGGAGCTGGCAGGGTGGGCCAGGAACATTCTGCTCC GGCTCCTCCCTGCCGGTTCCCTCGCTTCCTGCCAGGCCCTGCAGGCCCTGCTGGTGGGAGGAG GGGACTTCCTGCCGGCTTGGGGAGGCGGTTGGGTGCCAGCCGTACCGCCCTTCCTG CCCGAGCCGGCTTGGGGAGGCGGTTGGGTGCCAGCAGGAAGCTACCGCCCTTCCTG GTCCTGGCACCCTGCAGGCCTGTGTAGAGAGAACTAGGTCCACGTGCTTTTAA | 7836 |
| | 3 | MRSACRECRRSVWGGALRDWPRG* | 7837 | ATGCGGTCGGCCTGCCGGGAGTGCCGGAGTGCAGGGAGTTCAGTGTGGGGGTGCGTGAGGTA CTGGCCAAGAGGGTAG | 7838 |
| | 4 | MPQRAGPARGLWEPWLCLRSFPATIPLCTQACACACV CARVCVCVCVFGACTVAPWRRPHKPAPTSCLLAAC RLLASASHLGPPLSHSPPPYL* | 7839 | ATGCCGCAGCGCGCCGGCCCTGCCCGGGAGTGCTGGGAACCGTGGCTATGCCTTCG GAGTTTCCCGCGCCACCATCCCGTATACCAGCGTGCCGTGCAGGTGGTGTGTG TGCGCGCGTGTGTGTGTGTGCCCCATAAACCCGCCACAACCGCCCTCTGCCCGGCTCG ATGGCGAGCCAGCGCTCCACCGTCCCCCTTGTTGGGGCGTCCTGCTGGCT GCTGGCCAGCAGCCACCTCGGGATCCCCCCCCTCCTCCCCACCGCCC TATTATAA | 7840 |

Figure 1 (Continued)

| | | | | | |
|---|---|---|---|---|---|
| hsa-mir-661 | 1 | MSGEDAEVRAVSEDVSNGSSGSPSPGDTLPWNLGKTQR SRRSGGGAGSNGSVLDPAERAVIRIAGNCAGPCLCTSLA REVD* | 7841 | ATGTCGGGTGAGGACGCTGAGGTCCGGGCAGTTCTGAAGATGTCTCAATGGAAG CAGTGGCTCGCCCAGCCTGCGGGACACACTGCCCTGGAACCTTGGGAAACGCAGC GGAGCCGGCGCATGGGGGTGGCGCTGGAGCAACGGAGTGTCTGGACCCAGCT GAGCGGGCGGCGTCATTGCATGCAGGTAACTGCGCAGGGCCTTGCCTGTGCACCTCC TTGGCACGCGAGGTTGACTGA | 7842 |
| | 2 | MSPMEAVARPALGTHCPGTLGKRSEiAGAAGVALGATG VSWTQLSGRSFASQVTAQGLACAPPWHARLTEFPLRAR RWSGDWVGEA* | 7843 | ATGTCTCCAATGGAAGCAGTGGCTCGCCCAGCCTGGCACACACTGCCCTGGAACC TTGGGAAAACGCAGTGGGAGCCGGCAGCGGCACCGGGAGGGTGGCGCTGGAGCAACGGAGG TGTCCTTGGACCCAGCTGAGCGGGCGGTCATTGCATGCAGGTAACTGCAGGGC CTTGCCTGTGCACCTCCTTGGCACGCGAGGTTGACTGAGTTCCCGCTGCAGGGCTAG CGCTGGAGCGGGGACTGGGTGGGGAGGCTAG | 7844 |
| | 3 | MRPGVGLLAAASILDFNTVQCPDATRIHFWVPHQALGL GCHRNGGQVGMYRSSY* | 7845 | ATGAGGCCTGGGGTTGGACTTCTTGCCGCGGCGTCCATCCTTGATTTAACACGGTC CAGTGCCCAGATGCAACAAGGATAATTTTTGGGTTCCACCAGGCCCTGGTCTT GGCTGCCACAATGCGGTCCAGGTGGAATGTACAGGAGCAGTGTATAG | 7846 |
| | 4 | MQQG* | 7847 | ATGCAACAAGGATAA | 7848 |
| hsa-mir-662 | 1 | MLIPGGQSRTVRCCQLWRGQASSIKSLFFFNTESHSVA QAGVQWCDRSSLHATSASQVQPPG* | 7849 | ATGCTGATTCCTGGTGGCCAGAGCCGCACGGTGAGATGCTGTAGCTGTGGAGAGG GCAGGCCAGCTCCATCAAGAGCTCTTTTTTTCTTTAACACAGAGTCTCACTCTGTT GCCCAGGCTGGAGTGCAGTGGTTGCCATCGAGCTCACTGCAACCTCCGCCTCC CAGGTTCAGCTCCTGGGTAG | 7850 |
| | 2 | MLSAVERAGQLHQESFFF* | 7851 | ATGCTGTCAGCTGTGGAGAGAGGGCAGGCCAGCTCCATCAAGAGCTCTTCTGGTGATAGAATGGGATTACAGGCGTGAA | 7852 |
| | 3 | MQPPPPRFSLLGRWDYRREPPCLAKGHVFF* | 7853 | ATGCAACCTCCGCCTCCAGGTTCAGCTCCTGGCCAGGTGTATCGTGTTTTTTTGA | 7854 |
| | 4 | MGLQA* | 7855 | ATGGGATTACAGGCGTGA | 7856 |
| hsa-mir-665 | 1 | MVNPILCT* | 7857 | ATGGTTAATCCAATTCTGTGCACCTGA | 7858 |
| | 2 | MTERMNGHMND* | 7859 | ATGACAGAAAGAATGAATGGACACATGAACGACTGA | 7860 |
| | 3 | MEMPGTARKELPMGLSFISLWAPEVHKREKRQEEKCQ GVKDRAKERQK* | 7861 | ATGGAAATGCCTGGCACAGCTCGGAAGGAGCTGCCCATGGGATTGTCATTCATTCA CTCTGGGCACCTGAGGTCCATAAGCGTGAAAAGAGGCAGGAAGAAGTGTCAGGG AGTCAAAGATAGAGCTAAGGAAAGGCAAAATGA | 7862 |
| | 4 | MKLNESERENKEKPIKKRITNTWVYL* | 7863 | ATGAAACTAAATGAAAGCGAAAGGAAAATAAAGAAAAACCAATAAAAAGAGAA CGAATACGTGGGTGTATCTGTAA | 7864 |
| | 1 | MRSP* | 7865 | ATGCGGTCACCATAG | 7866 |
| hsa-mir-671 | 2 | MLSLARPPLPFPTGLRTRSVPQSPSRDLRFPRLAERPELVSR APFSAAR* | 7867 | ATGCTGTCTCTGGCGCGGCCTCCGCTCCCGCTCCCGACTGGCCTGAGAACGAGGTCTGTG CCCGAGCTCCCAGCCGGCGACCTCCGACCCGCTCGCAGAACGACCCGGAGCTGGTC TCCCGAGCCGCCCTTCTCAGCAGCCGGTGA | 7868 |
| | 3 | MPCKMAPSAMALLRGCQC* | 7869 | ATGCCCTGCAAGATGGCTCCATGGCGCTCCTGAGAGGCTGTCAGTGCTGA | 7870 |
| | 4 | MCAMRVAPDRS* | 7871 | ATGTGTGCCATGCGAGTGGCTCCGGACCGCTCCTGA | 7872 |
| hsa-mir-708 | 1 | MRPQLLALCNFRGARLSSPGARPRY* | 7873 | ATGCGACCTCAGCTCCTGGCCCTGTGCAACCGCGGGGCCCGCCTCTCCTCATCG GGCGCCGGCCGGTATTGA | 7874 |
| | 2 | MDAWRAPGCECDCMTTLTPSFGKCALG* | 7875 | ATGGACGCTTGGAGGGCTCCGGTTGCGAGTGTGACTGTATGACTACTCTCACCCCC AGCTTCGGGAAATGTGCTCTGGGTTGA | 7876 |
| | 3 | MCSGLKCDHRAPQSF* | 7877 | ATGTGCTCTGGGTTGAAATGTGATCACCGAGCTCCTCAGTCATTTTAA | 7878 |
| | 4 | MRSLHWRSRLEGSGAACVCVCVCGHTHATEEYTTN YLGEGRGVHLVSPSWRGGRAS* | 7879 | ATGCGGTCGTTACATTGGAGGAGCAGACTGGAAGGTAGTGGGCGGCGTGTGTGTG TGTGTGTGGTTGAAGGCGGGGGGTTCACCCATGCAGAGGAATACAACCAACT ACTTCGGTGAAGGCGGGGGGTTCACCTAGTGAGTCCTTCTTGGCGGGGGTCGG GCGAGTTAG | 7880 |

Figure 1 (Continued)

| | | | | |
|---|---|---|---|---|
| hsa-mir-7-1 | 1 | MSWSYVALGTRDLVEERRPVRGEGRAAALFV* | 7881 | ATGAGCTGGAGCTATGTGGCACTGGGAACTAGGGACCTCGTGGAGGAAAGGAGGCCGGTGCGGGGAGAAGGTCGCCGCGCTCTTGTGTGA | 7882 |
| | 2 | MWHWELGTSWRKGGRCGEKVAPPLSLCEPRLTLGLPARGRSWSGGDGTVRAASMALSRAVGGGCGG* | 7883 | ATGTGGCACTGGGAACTAGGGACCTCGTGTGAGCCCCGCCTCACCTTGGGTCGCGGTGAGGTCGCCGCCCGCCTGAGCTCGAGCTGGAGCGCTGGAGCGGCTGGAGCGCGGGGTCGGGCAGTGGGGGAGGATGCGGGGGATGA | 7884 |
| | 3 | MERSGLPRWLCLGQWGEDAGDETSGPRGGWGRGSALGSA* | 7885 | ATGGAACGGTCAGGGCTGCCTCGATGGCTTGTCTCGGGCAGTGGGGGGAGGATGCGGGGGATGAGAGACCTCGGGACCGCGGTGGGGACCGCGTGGTGGGTGGGGGAGGCGGTCGGCGCTCGGCTCCGCCTAG | 7886 |
| | 4 | MRGMRPRDRVVGGGGRRSAPPSST* | 7887 | ATGCGGGGATGAGACCTCGGGACCGCGTGGTGGGTGGGGGAGGCGGTCGGCGCTCGGCTCCGCCTAGTAGCACGTAG | 7888 |
| | 1 | MLAFSLSPANTIDVGRLSKSiVKEL* | 7889 | ATGTTGCTTTCTCTCTCCAGCAACATACCGATGTAGGCAGACTGAGCAAGTCAATCGTAAAGGAACTTTAG | 7890 |
| | 2 | MSGVQPCAPTVGRGPSYLPCCLTVTQSWILTKHTPRlSAGVMQDSLWLTPLVPRFPLLLAAVLVCKAELISFSPWRRV* | 7891 | ATGTCAGGAGTGCAACCATGTGCTCCACTGTGGGCAGAGCGCCTCAGTACTACCGGTGTTGTCTGACAGTTACACAGTTGGATACTTCACAAAAACACTCCTCGTATCAGTGCTGGGTCATGCAGGATGCACTGACTATGGTTGACACCTGTTGACCTCTGCTCTTGCCGCTGTCCTGTCCTAGTCGTGAAAGCAGAGCTAATAAGCCCAGCCCTGGAGAAGGGTGTAA | 7892 |
| hsa-mir-7-2 | 3 | MCSHCGQRALSTTVLSDSYTVLDTHKTHSSYQCWGHAGLTMVDTSCAQTSALGRCPSL* | 7893 | ATGTGCTCCACTGTGGCAGAGGGCCCTCAGTACTACCGTGTTGTCTGACAGTTACACTGGATACTCACAAAACACTCCTCGTATCAGTGCTGGGTCATGCAGGACTCACTATGGTTGACACCTGTTGCCCAGACTCTGCTCTGCCAGCTCTGCTCTTGGACCCTGGAGAAGGGTGTAA | 7894 |
| | 4 | MQSTWHTMGVHPVPTPSSLLPFDIDKLC* | 7895 | ATGCAAAGTACCTGGCACACAATGGGTGTTCACCCAGTGCCAACGCCCTCCTCTCCTCCCCTTTGACGACAAGCTGTGCTAA | 7896 |
| | 1 | MPGMRLVCRLAHGHPPRKGQRRRSLTVWKAETSRADCLGGKFWGHGTG* | 7897 | ATGCCGGGAATGAGAGCTGGTTGCAGGTGGCGCATGGACATTTTCCAGAAAGGACAGAGACGGCGAAGTTGACGGTCTGAAAGCAGAGACCAGCAGGGCTGACTGCTTGGGAGGTAAGTTCTGGGGACATGGTACAGGGTGA | 7898 |
| | 2 | MDIFPERDRDGEV* | 7899 | ATGGACATTTTCCAGAAAGGAGACAGAGACGGCGAAGTTTGA | 7900 |
| hsa-mir-7-3 | 3 | MVQGEEQVSVLVATPLCLPPATPLPF* | 7901 | ATGGTACAGGGTGAGGAGCAAGTATCAGTGTCAGTTGCGACCCCTCTGTGTCTCCCCGCCGCCACCCCAGCCATTGCCATTCTGA | 7902 |
| | 4 | MLFISAPNIRTAPLGRSEKRTAICFSTGAQDSSQRAPPRLQNPGQLLQVTGEPFDPFAGGRERVV* | 7903 | ATGCTATTTATTTCAGCACCAAATATCCGACAGCACCCTGTTTTCAGCAGCGCTCCTCGGACAGGCGCTCTCGGAGAGTCCGAGAAGAGAACCGATCTGTTTCAGCACCGGTCTCAGGACAGTCTCCAGCAGCCCTTTGACCCTGATTCGTCCAGAACCCTGGACAGCTCCTCCAGTAAGGAGAGCCCTTTGACCCTGATTTTGCAGGGGGAGGACGAGAGGGTGGTCTGA | 7904 |
| | 1 | MAAPSPSGGGSGGGSGGSGTPGPVGSPAPGHPAVSSMQGKERGRAEIPAP* | 7905 | ATGGCGGCTCCAGCCCTGAGCCTGGAGGCGGCGCGCCGGGCAGCGGCAGCGGCAGCGGCGCACCCCGGCCCCGTAGGGGTCCCGGCCCCGGCGCCACCCGGCCGTCAGCAGCATGCAGGGGTAAGGAAGCGGCCGCGAGATCCCAGCCCCTAG | 7906 |
| hsa-mir-744 | 2 | MGVGGLPRPVPPVR* | 7907 | ATGGGGGTGGGGGGCCTGCCAGGCCTGTTGCCTAAGTAG | 7908 |
| | 3 | MERYRK* | 7909 | ATGGAGAGATACAGGAAATAG | 7910 |
| | 4 | MTPFTGNAY* | 7911 | ATGACTTTTCCCACTGGGAATGCTTATTAG | 7912 |
| hsa-mir-758 | 1 | MDQGIVEGGGCGPGVGRQSACSL* | 7913 | ATGGACCAGGGGATAGAGGGTGGTGTTGACCTGGGGTCGGGCGCCAGTCAGCTTGCAGCCTATGA | 7914 |
| | 2 | MKIDGKEGYRDRGRVGLRIARAAWHTVLG* | 7915 | ATGAAGGACGGAAAGGAGGGCTACAGAGATAGGGGAAGAGTTGGGCTGAGGATAGCCAGAGCGGCTTGGCACACAGTTTTAGGGTAA | 7916 |

Figure 1 (Continued)

| | | | | | |
|---|---|---|---|---|---|
| | 3 | MTEPVTPGSSFKACLMGDSVVPVTKLGPESQGRAHQV AALP* | 7917 | ATGACTGAGCCGGTCACTCCAGGGTCTTCCTTCAAAGCGTGTCTAATGGGAGACAGC GTTGTCCCAGTAACCAAATTGGGACCAGAGTCCCAGGGAAGGGCTCATCAGGTGGC CGCTCTGCCTGA | 7918 |
| hsa-mir-760 | 4 | MILFPLDPAPLVPFSL* | 7919 | ATGATTCTTCCTCCTGGATCCAGCCCCTCAGTTCCTTTCACTTTGA | 7920 |
| | 1 | MTKDVKNADMGIK* | 7921 | ATGACAAAGATGTTAAAATGCTGATATGGGCATAA | 7922 |
| | 2 | MLKMLIWA* | 7923 | ATGTTAAAAATGCTGATATGGGCATAA | 7924 |
| | 3 | MACGENCKAGL* | 7925 | ATGGCTTGTGGAGAATGCAAGCTGACTATAG | 7926 |
| | 4 | MDYYFSLYLF* | 7927 | ATGGATGTTACTTTCCTGTATCTTTTGA | 7928 |
| | 1 | MVAPHLCT* | 7929 | ATGGTTAATCAATTCTTGCACTGA | 7930 |
| | 2 | MTERMNGHMND* | 7931 | ATGACAAGAAGAATGAATGAACATGAACGACTGA | 7932 |
| hsa-mir-770 | 3 | MEMPGTARKELPMGLSFISLWAPEVHKREKRQEEKCQ GVKDRAKERQK* | 7933 | ATGGAAATGCCTGGCACAGCCAGGAAGGAGCTGCCATGGATGTTCATTCATTCTCA CCTGGGCACCTGAAGTCCATAAGCGTGAAAAGGACCAGGAAGAGAAGTGTCAGGG AGTCAAAGATAGAGCTAAGGAAAGGCAAAAATGA | 7934 |
| | 4 | MKLNESERENKEKPKKRTNTWVYL* | 7935 | ATGAAACTAAATGAAAGCGAAAGGGAAATAAAGAAAGAAAAACCAATAAAAAGAGAA CGAATACGTGGGTATCTGTAA | 7936 |
| | 1 | MTSMC* | 7937 | ATGACATCAATGTGCTAG | 7938 |
| hsa-mir-802 | 2 | MHTSWL* | 7939 | ATGCATACATCATGGCTTTGA | 7940 |
| | 3 | MALKKIGLRTRQSKTKQTDKNSNQT* | 7941 | ATGGCTTTGAAAAAAATAGTCTGAGAACGAGGCAAAGTAAAACTAAGCAAACAGA TAAGAATAGCAACCTGA | 7942 |
| | 4 | MTTILSFYIAYLETYD* | 7943 | ATGACAACAATTCTAAGTTTTACATTGCTACCTGAAACCTATGATTGA | 7944 |
| | 1 | MGAGEGVGASISRASIDELPDSLQPRQRRQEPQGRANRL GWGCLGRCRGSWKGGSAPGSLELPPFLGDQGAASLRG RGSKWVAAFSS* | 7945 | ATGGGAGCCAGGGAGGGTGTAGGGGCCAGTATTTCTCGGGCTAGTGACGAACTGCC TGATTCTTTGCAGCCTCAGACAGAGGAGGGCAGGAGCCCAGGGCGGCGCTAATGCC TGGGCTGGGATGCCTGGCACAGCAGGGATGCAGAGGAAGTGGAAAGTGGCAGTGCACCT GGTGCTCTGGAGCTCGCCGCGCGTTCCTAGGAGACCAAGGAGCAGCAAGCTGCGGCG GAGGGGAGCAAGTGGGTTGCTGCTTTTAGCAGCTGA | 7946 |
| hsa-mir-874 | 2 | MPGQMQRKLERWQCTWVAGAAAVPRRPRSSKPAGEG EQVGCCF* | 7947 | ATGCCTGGGCAGATGCAGAGGAAGTGGAAAGTTGCACCTGGGTCGCTGG AGCTGCGCCGCCGTTCCTAGGAGACCAAGGAGCAGCAAGCTGCGGCGGAGGGGAGC AAGTGGGTTGCTGCTTTTAG | 7948 |
| | 3 | MLNHCC* | 7949 | ATGCTGAATCACTGTTGCTGA | 7950 |
| | 4 | MEGERYVCISVCCVVCVCKCMCACGAATSFCVCIG* | 7951 | ATGGAGGGTGAAAGGTATGTATGTATCAGTGTGCTGTCGTGTGTGTGTATGTAAG TGTATGTGTCGCTGTTGCGTGACCACCAGCTTGTGTCACCAGCTTCAGCGGCCATAA | 7952 |
| | 1 | MIKTYNH* | 7953 | ATGATAAAAACATATAATCATTAG | 7954 |
| hsa-mir-875 | 2 | MVFL* | 7955 | ATGGTGTTTCTCTAA | 7956 |
| | 3 | MMPLRSVFDCVY* | 7957 | ATGATGTTTTTGCACAGTTGTTTTGACTGTGTTTATTAA | 7958 |
| | 4 | MQJHNKCKLLRF* | 7959 | ATGCAGATTCACATAACAAGTGCAAATTGTTGAGGTTTAA | 7960 |
| | 1 | MMGHRLPVRGVGLFLSPLPAPAAAVGTGAQPILKPCGE GPVTPVLASSQGP* | 7961 | ATGATGGGGTCACAGACTCCCGTCGAGGTGTCGTTCCTTCGCTCGCTCCCG GCTCCGCTGCGCTGCCGGCTGTTGGAACTGGAGCGCAGCCATCTGAAGCCCTGCGGGA GGGCCGTGGACGGTGACGCAGTGCTGCCACGTTCAGCGGCCATAA | 7962 |
| hsa-mir-877 | 2 | MFSPPRHPIWTDPPGCAWGESLLQGAVGTAPRASWRDSP PPTLHPSPFLPDVGGVGDPLRDRPRGLTRSHDPLPRSPE VQRAHPSFQMCGSPSPAPSSRSRTDLSSAPVCPATASSS ASR* | 7963 | ATGTTCAGTCCTCACAGACTCCCCAGAACACCCTATTTGGGACCCTGCCGGATGTGCGTGGCGGGAG TCAACTCTCGATCCTCATCCTCCCACCCTCCAGATGGAGCGGCCCGTAGCTGGAGGATTCCCT CCCCAACTCTGCATCTCCCTCGCGCTTGACGCGGTCAGATGTGCGGAAGGCCGAGCCGCCGCA GAGGTGCAGCGGGCACCACCCTCCTTCAGATGTGCGGAAGCCGAGCCCGCCGCCCTC CTCCTCCCGCTCCCCAGTCCCCCACTGACCTCTTCCGCTTGTCTGCTGCAACTGCTTCT TCTTCTCTGCTTCACGCTGA | 7964 |

Figure 1 (Continued)

| | | | | | |
|---|---|---|---|---|---|
| | 3 | MCVGGVTPSGSSGDGAPC* | 7965 | ATGTGCGTCGGGGTGAGTCACTCCTTCAGGGAGCAGTGGGGACGGCGGGCCCGTGCTAG | 7966 |
| | 4 | MASSSAWPGPVTWPALRRAPAASTDCPPGQPPPQPGT LEEAGLAGDVSGRARQNYRRGGDRRTGEI* | 7967 | ATGGCTTCTTCCGCATGGGCCCGGACCAGTCACCTGGCCGCCCGCGGCCCTCCGCGAGCT CCGGGCCGCCTCAACTGACCTGCCCCGGGGCAGCGCCGCCGCGGCCAGGGGCCGGAC CCTAGAGGAGGCGGGCGTAGCAGGTGACGTCAGGTGCGCTCAGGGCCCGACAGAATTACC GCCGGCGGCGATGGAAGGCGGACGGGGAGATATAG | 7968 |
| hsa-mir-877 | 1 | MSIISQ* | 7969 | ATGTCAATTATATCTCAGTAA | 7970 |
| | 2 | MNRSSTAP* | 7971 | ATGAACCGAAGCTCCACTGCACCCGTGA | 7972 |
| | 3 | MLGSSSLFTVHFGIL* | 7973 | ATGTTGGGCTCCAGTTCCCTGTTTACAATTGTACACTTGGATTTTGTGA | 7974 |
| | 4 | MTQSVSRPMTLS* | 7975 | ATGACCCAGTCAGTCTCGCGCCCATGACCCTCTCTAA | 7976 |
| hsa-mir-885 | 1 | MWPPVPGLCHSLCACPTGATPDHVDASSREQHGPH* | 7977 | ATGTGGCCTCCAGTGCCTGGCCTTTGTCACTCACTCGTGCTTGTCCCACAGGAGCC ACCACCCTGACCATGTAGATGCCAGTTCAGGGAGCAGCATGGGCCCACTGA | 7978 |
| | 2 | MPVGSSMGPTEWRLLGLQP* | 7979 | ATGCCAGTTCCAGGGAGCAGCATGGGCCCACTGAATGGAGACTCCTGGGTCTACA GCCCTGA | 7980 |
| | 3 | METPGSTALSPSGPWTSSHTGGHLLELTTVTSPPRPPPP PGTRSRPPGATADQ* | 7981 | ATGGAGACTCCTGGGTCTACAGCCCTGAGCCCCTGGCCCTGGACCCTCGTCCAC ACCGGAGGACACCTTGGAGCTCACCACCGTCACCAGCCGCCTCGGCCACCC CACCCCCCGGGACCGGAGTCGCGGCCGCTGGTGCCACAGTCGACCAGTGA | 7982 |
| | 4 | MGDMTNSDFYSKNQRNESSHGGHFGCTMEELRSLMEL RGTEAVVKIKETYGDTEAICRRLKTSPVEGKCSRLEPRA AA* | 7983 | ATGGGTGACATGACCAACAGCGACTTTTACTCCAAGAACCAAAGAAATGAGTCGAG CCATGGGGGCGAGTTCGGGTGCACAATGGAGGAGCTCCGCTCCCTCATGGAGCTGC GGGCACTGAGGCTGTGGTCAAGATCAAGGAGACTTATGGGGACACCGAAGCCATC TGCCGCCGCCTCAAAACCTCACCTGTGGAAGGTAAGTGTCAAGACTTGAACCCAGG GCTGCAGCCTAG | 7984 |
| | 1 | MGTRRRRGEPLGGPGARAVRGAAPAGPQRGL* | 7985 | ATGGGGACCCGGCGGCGGCGGCGGCGGGAGCCTCTGGGCGGCCCGGGCGGCGCGG CTGTGCGCGGCGCTCCGGGAGACGCGGGCATGA | 7986 |
| | 2 | MECPGRKRA* | 7987 | ATGGAGTGTCCGGGAGACGCGGCCATGA | 7988 |
| hsa-mir-887 | 3 | MTATGWARTMANSTAVRVSGPPVLRLPDRVPPPLSLAL PTGKGGSRPRP* | 7989 | ATGACGGCTACAGGATGGGCGCGAACAATGGCAAACAGTACGGCAGTGAGGGTGAG TGGGCGCGCGGTCCTCAGACTCGGATCGTCCCGGTCCTCCGCCCTTTCCCTCGCCCTC CCGACTGGGAAGGGAGGTTCTGCGCCGCGGCCGTGA | 7990 |
| | 4 | MGANNGKQYGEGEWAARPQTTPGSRPSSPFPRPPDWE GRFSPAAVTHPIWHPVWVTTFSFGSE* | 7991 | ATGGGCGCGAACAATGGCAAACAGTACGGCGAGGGTGAGTGGGCGCGACCCGTCC TCAGACTCCGGATCGCGTCCTCCTCCTTCCCTCCGCCTCCGACTGGGAAGG GAGGTTCTCGCGCCGGCCGTGACGACCCCATTTGGCACCCGTCTGGGTCACCAC CTTCTTCTTTGCAGTGAGTGA | 7992 |
| | 1 | MDQGVEGGGCGPGVGRQSACSL* | 7993 | ATGGACCAGGGGGTAGAGGAGGAGGTGGGGTGGACCTGGGGTCGGGGCCAGTCAG CTTTGCACCTATGA | 7994 |
| hsa-mir-889 | 2 | MKDGKEGYRDRGRVGLRLARAAWHTYLG* | 7995 | ATGAAGGACGGAAAGGAGGGCTACAGAGATAGGGGAAGAGTGGGGCTGAGGATAG CCAGAGCGGCTGGCACACAGTTTTAGGGTAA | 7996 |
| | 3 | MTEPVTPGSSFKACLMGDSVVPVTKLGPESQGRAHQV AALP* | 7997 | ATGACTGAGCCGGTCACTCCAGGGTCTCCTTCAAAGCGTGTCTAATGGAGACAGC GTTGTCCCAGTAACAAATTGGGACCCAGAGTCCCAGGGAAGGGCTCATCAGGTGGC CGCTCTGCCTGA | 7998 |
| | 4 | MILFPLDPAPLVPFSL* | 7999 | ATGATTCTCTTCCCTCTGGATCCAGCCCCTCTAGTTCCTTTCACTTGA | 8000 |
| | 1 | MGTILPDLFPGGVSAVSPSP* | 8001 | ATGGGTACTCTCCCCGGATCTCTTCCCGGGTGGGTCTGCTGTTCCTTCCTCTCTTGA | 8002 |

Figure 1 (Continued)

| | | Protein | SEQ ID | Nucleotide | SEQ ID |
|---|---|---|---|---|---|
| hsa-mir-9-1 | 2 | MRPRSSREGQWRPGEAGEASAWVAAVFPGGTKSPRYPSTWDQKNSCSWPEWESGKWGTRMPLGLDRGQLPDFDATGHRVLSTPFSVSVVSVSPCLRFLLLFCLGLHFSLHPPFQLESCPFFPTPADGRPGSCGGAGGGGREAAWKRRQQPGGGVGCYLWLSSCMSGVESS* | 8003 | ATGCGCCCTCGACTTCCAGAGAAGGGCAGTGAGACCCGGCGAGGCTGGGAGGCCTTGCCTGGGCTGCCTGCTGAGCGGAACTCCTGCTCCTGGGTCTCCGGGTGGCACGAAAAGCCCGCGAGGCCCTTCCACCTGGACCAGGAACTTTTGGGTCTGGATCGGGGTCAACTCCCCGACTTCGACGCCACGGGCACCAGAAACTTTTGGGTCTGGATCGGGGTCAACTCCCCGACTTCGACGCCACGGGTCATCGCGTCCTTCCACGCGTCCTTCTGTTTGTTTGTTTGCGGTTCTGTGTCTCTATCTCCGTGTCTGAGGTTTTGTTGTTTGTCCGACTTCATTTCTCTTCCAACCCTCCCCTCAACTCCACTCGTCCTTCCCTTCCCTGACCTCCTCCCGCCGGGCAGCTGGCGGAAGCTGCGAGGTGTGGCGGCGGCCGGGCGCCGGAGGCGCGTGGAAGAGCGCGCGAGCAGCCAGGAGGCGGGGTGGTTTGGTGTATCTTGGTTATCTGAGTGTGAGTGGTGTGGAGTCTTCATAA | 8004 |
| | 3 | MGEREMGHQKLFGSGSGSTPRLRRHGSSRPFHAFFGLCRVCJSVSEVFVVVLSRTSFLSSPSPSTPLVSLPSYSR* | 8005 | ATGGGAGAGCGGGAAATGGGGCACCAGAAACTTTTTGGGTCTGGATCGGGGTCAACTCCCCGACTTCGACGCCACGGGTCCATCGCGCTCCGTCTGAGGTTTTGTTGTTTGTCCGACTTCATTTCGTGTCTGTATCCCGTGTCTGAGGTTTTGTTGTTTGTCCTCCTCCCGCCGCCATCTCTTCACCTCCACTCGTGTCCTTCCCTGTCCCTACTCCGCTGATAA | 8006 |
| | 4 | MGPFLAVWVTAWEADLREKSVEI* | 8007 | ATGGGCCTTTTCTGCAGTCTGGGTCACGTCGGTGATCTAAGGGAGAAATCAGTTGAAATCTAG | 8008 |
| | 1 | MDRQMLRHRSCILHSTRG* | 8009 | ATGGATAGACAGATGCTACGTCATCGAGCTGCATCTCCACTCCACAAGAGGCTAG | 8010 |
| | 2 | MEAGAKSSQKEKADKRFRGVPKMDEACV* | 8011 | ATGGAGGCTGGTGCAAATCATCACAGAAGAAAAGGCTGATAAAAGATTTAGGGGGGTCCCCAAATGGATGAGGCATGTGTAG | 8012 |
| hsa-mir-9-1 | 3 | MRHVCRGGVGSKALTSSLLGTYR* | 8013 | ATGAGGCATGTGTAGAGAGCCCAAGGCAGTGGCAGCAAGGCTCTCACTTGCCACCGGCTCCAGCGCTCGAGCCTCTGGGCACCTATCGCTGA | 8014 |
| | 4 | MCVEYELAARLSPPASWAPIAEPKAVALPTRPRVSPGSPPSPSPCRLETAH* | 8015 | ATGTGTGTAGAGGTGGAGTTGGCAGCAACAAAGGCTCTCACTTGCCAGCGCTCTCTGGGCACCTATCGCTGAGCCCAAGGCAGTGGCAGTGGCTCTGCCACCGCCCAGAGTGTCTCTGGTTCCCCTCCTTCCCCCAGCGCCATGCAGGCTGGAGACAGCTCACTAA | 8016 |
| | 1 | MKIDV* | 8017 | ATGAAAATTGATGTTTAA | 8018 |
| | 2 | MFKTIDKGSGFFSLQQSCVQH* | 8019 | ATGTTTAAAACAATAGACAAAGGCTCAGGATTTTCATTACAGCAGAGTTGTGTACAGCATTAG | 8020 |
| | 3 | MKSACLEHSVRTYRTKYAALSPWYIDTKHD* | 8021 | ATGAAAGTCCGCTTGCTTAGAGCATTCAGTTCAGATTCGAACTTACAGAACAAAATATGCTGCCTATCGCCATGTACATAGATACAAAACATGACTGA | 8022 |
| | 4 | MLPYRHGT* | 8023 | ATGCTGCCTATCGCCATGTACATAG | 8024 |
| | 1 | MLLGHHLPGPRSR* | 8025 | ATGCTTCTGGGCCACCATTTGCCAGGCCTCGAGGTAA | 8026 |
| hsa-mir-9-2 | 2 | MGTLTWAQIMIKMERGWDAGEGVLQPEGPGPRG* | 8027 | ATGGGCACCCTTACCTGGGCTATTCAAATAATGATCAAATGAACCGGGATGGGATGGGAGGGGTGAGGGAGTGGTCCAGGCCGGAGGGCCCGGGGCCCCAGAGGATGA | 8028 |
| | 3 | MGCG* | 8029 | ATGGGATGCGGGTGA | 8030 |
| hsa-mir-9-2 | 4 | MRVRECSSRRARGPEDDVRLEAWTPGSCPWAPCASSQGSERLRGAPAIRFPFLSRAFDSSLLYTPACK* | 8031 | ATGCGGGTGAGGGAGTGCTCCAGCCGGAGGGCCCGGGGCCCCGAGGATGTGCGCCTGGAAGCTTGGACCCCTGGGTCCTGCCCATGGGCCCCTTGCCAGCTATCCGATTTCCCTTCCTAAGTCGCGCGTTCGACAGCAGCCTCCTTTACACACCGCGTGCAAATGA | 8032 |

Figure 1 (Continued)

| | | | | |
|---|---|---|---|---|
| | 1 | MVAATPPCESARPSEDGGKPVVCGPGLAGGAERPGAD WPGAAWRRRGRGESRPLAAPACGSRIWLPPRSFPAGRR RGAGPGREGGBGRBRARGGRRARDPRRPCLGRPEGGWAD GEHRNGPSGRGRARPVPSPGPGARAGRGVSG* | 8033 | ATGGTGGCGGCTACTCCTCCTGGTGAGTCTGCCGCCCTCTGCCGCCCTCCGGCACGAGGGAA ACCTGTTGTGCGGACCGTGGCGGACGGGCTGGGCGGGGCGGGAGGGCGGCGGGCGGACT GGCCCGGAGCAGGTGGCAGCGTGTGCAGCCGCATCTGGCTGCCCCTCGCCCTGCGCGGTTGGCC GCCCGGCGGTGTGGCAGCCGCATGGCTGCCCCTCGCGGGGCGGGCGAGGAGGCGGGCG GAGGAGGCCAGGGCGGATGGGAGGTGGCGAGAGGGAGCGGCCGTGCGGGTGCGTGGCGGC CGGGGCCCCGGGACCCCAGACCCTGCCTGGCCGCAGACCCCGAAGGGCGGGGTGGGCGGA CGGCGAACACAATGGCCTGCGCGGGAGGACGTGGAGAGCCCTGTGCCTTCTCCGG GCGCCCGGGGGGTGCGCGGGGTGGGTCTCGGGTAG | 8034 |
| hsa-mir-92a-1 | 2 | MAPRGEDVRGPCLLRGPGRARGIVGSLGRKVSPEGES* | 8035 | ATGGCCCCTCGGGAGGAGACGTGCGAGGCCCTGTGCTTCTCCGGGCCCGGGGCG CGCGCGGACGTGGGTCTCTGCGTAGGAAAGTTCTCCCGAGGGCGAGAGTTAA | 8036 |
| | 3 | MGQAAGREGARPRGTCAPAGGVAWAGARGSPNFVRA RVGGGAPRSARPGRHPRSAWALLARVGSLGAGPATSPP GRCTTTGTTAGCCCGGTGGGGCAGCCTCGGGGCGGCCTGAGCTCGCAACTTCCCGCTGTG WPSEEAAVGLSRGVEPPAPGRLLGVWRGRASPARRERR PRRHVPAGRAARG* | 8037 | ATGGGGCAGGCCGCTGGCCGGGAGGGGCGCCCGCGAGTAGTTACTGCGCTCAG GTGGGCGGGAGGCCGCGAGATCGGGCGCGCCTGGGCGCGACAACTTGTAGCGCGCAGG GGCTTGTTAGCCCGGTGGGCAGCCTCGGGGCGGCCTGAGCTCGCAACTTCCCGCTGTG CCCTCGGAGGAGGCCGCAGTCGATCTCAACCGCGCGTGAGCCGCGCGCTGCCGGCG GCGCTTCGTGCTGGAGTGCGCCGCGGAGGCCAGCCGGCTCGGCGGGAGCGGCGT CCCCGGCGCTCATGTCCCTGCGGGCGCGGCTGCACGGGGGTGA | 8038 |
| | 4 | MFLRGGLHGGEGGHGGGGIDEAPPIVPGLGLGPRATGTA AAEPPPLWAGLGGAGGHKGGAARPRRTRASAPPVA ARLPGNGLGGLPRPAGPDSDPHPPGGYAENRRAALPL VRHVLPARAP* | 8039 | ATGTTCCTGCGGGGCGGCTGCACGGGGGGGTGCACGGGGGGACATGCGGCGACTG CGGCGGCGGCGATTGTTCCCGGCTTGGGCTCGGGGGGGCCCTCGGGGGGACACCG GCGGCGCGGAAGCCCCCGCCCTCTGGGCGTGGCGTGGGGACTCTGGCACACAAA GGAGGGGCGGCTGGCAGGGAAAACGGGTTGGGCCGCGCCCGCGGCTG CGGCGCGGCTGCCGCCGCCGCCCCTGGGCGCTGGGCTACGGGGAGAATGCCAGGGCGCGGCTG ACTCTGACCGCATGTCCTCCGCCGCCCCTGGCCGCTGGGCCGGGCTGCATGA TTGTGCGACATGTGCTGCGGTCCATGA | 8040 |
| | 1 | MGGGE* | 8041 | ATGGGGGGTGGCGAATAG | 8042 |
| | 2 | MSCLMNC* | 8043 | ATGTCTTGTTTAATGAACTGTAA | 8044 |
| hsa-mir-92a-2 | 3 | MSLLGSYFVLFPLIG* | 8045 | ATGTCACTCTTGGAGAGTTACTTCTACTTGTTCCTTTAATAGGATGA | 8046 |
| | 4 | MRSSFPTRFCLSNQDT* | 8047 | ATGATTTCATCTTTTCAACCTTTCTTCTGTCTCTTCAACCAAGACACATAG | 8048 |
| | 1 | MVVVKWVGRGQNRFRQALAA* | 8049 | ATGGTGGTTGTTGAAATGGGTGGGAGGGGCAGAACAGATTCAGGCAGGCGCTGG CTGCTTGA | 8050 |
| hsa-mir-92b | 2 | MGGBGAEQIQAGAGCLRGGAGTGAYRFHPVPPLPARPP* | 8051 | ATGGGTGGTGGAGGGGGCAGAACAGATTCAGGCAGGCGCTGCTCTTGAGAGGTG GAGGGGGACACAGGCGGCCTACGGTGCCCCCCACTCCCGCCCCGCGCCC CCTAG | 8052 |
| | 3 | MGNKAS* | 8053 | ATGGGGAACAAAGCCAGTAG | 8054 |
| | 4 | MSGLGASFGLPPFTTSRNSPTLLTAPCPVPHAVLP* | 8055 | ATGAGTGGACTAGGTGCTAGTTTTGGGCTCCCCCCACCACTTCCCGGAATAGC CCCACCCCTTCTAACCGCTCCCTGTCCCGTTCCACACGCAGTTCTACCCTGA | 8056 |
| | 1 | MSGSPLEDRMKNWEIMAVLESRQEDGESRACPALRPR NKRTRVRWPFKSDSPPAPARTAGNPAPALPRPEIPFRRP HRLPVTHSRPAR* | 8057 | ATGAGCGGGTCCCCTTGGAGGACAAGAAGACGGACAAGAATGGGATGCCGTTCT GGAGAGTAGAACAAGAAGACGGGAGAGCTGGCCGTCTCCTTAAGAGCGATTCTGCCGGAA ACAAAAGAACCGGGGAGTGTGCCCTGGCCTTAAAGAGCGATTCTGCCGCCAG CTCGGACCGCCACCGGGAAACCCGGCCTGCACTAACCCGCGAGATTCCCTTCGAC GCCCGCACCGCCGTCACTCATTCTAGGCCCACGGTGA | 8058 |
| hsa-mir-93 | 2 | MALKDYALEKGTGLRAREGVLRGPPGEHLLV* | 8059 | ATGGCACTGAAGGACTACGCGCTAGAGAAGGGTACGGGTTCTACGAGCCGGGAGGG CGTCCTGCGCGGGGAGCCTCCCGGGAAGCACCTGTTGGTGTGA | 8060 |
| | 3 | MLKKS* | 8061 | ATGTTGAAGAAAAGCTAG | 8062 |
| | 4 | MANGWTGSRPQRRNPEL* | 8063 | ATGGCCAATGGCTGGACTGGCTCCGCGCCTGGGCGGAGGAATCCGAGCTGTGA | 8064 |

Figure 1 (Continued)

| | | | | | |
|---|---|---|---|---|---|
| hsa-mir-9-3 | 1 | MSATEFS* | 8665 | ATGAGTGCCACAGAGCCGTCATAA | 8666 |
| | 2 | MILTTSACERPPHRPPRPGPQEPEEPRGAQRRPSGLQLD GAAAPRPGT* | 8667 | ATGATTCTCACAACTTCTGCGTGCGAGCGCCCGCCTCATGACGCCCGGCCGGC CCGCAAGAGCCAGAGGAGCCGAGAGGAGCCCAGCGCCCAGCGGACTCCAGCT CGACGGAGCGGCCGCGCCCCGGACCAGGTACCTGA | 8668 |
| | 3 | MQMRWERDSGR* | 8669 | ATGCAAATGCGATGGGAGAGAGACAGCGGTCGGTAG | 8670 |
| | 4 | MGERQRSVGGGWRE* | 8671 | ATGGAGAGACAGCGGTCGGTAGGGGTGGTGGAGGGAGTGA | 8672 |
| | 1 | MSAGGCWGPRDQRVPALARGAARAGWHSEAAPATPG KTQRLHPTFAPGCFSPEGPERSPLPCARSA* | 8673 | ATGAGTGCAGTGGGGTGCTGGGACCAGAGGGACCAACGGGTCCCGCGCTGGCTCG CGGCCGCCAAGGCTGGAGCATTCGAAGGAGCTGCAACGCTCGGGGAAAA TCACCCAGCGCCTCCACCCAACTTTGCTCCAGGATTTTGCAGCCCGCAGGGGCCAG AGCGCAGCCCTTCTGCCTGCCGCCCGAGCGCGTAG | 8674 |
| hsa-mir-95 | 2 | MSGRRPFFASHGGPGCSRLQKAVRVRAGAWGPGEGPG PQQT* | 8675 | ATGTCTGAAGGCGCCCTTCTTTGCTTCTACGGGGTCCGGTTGTTCAGCTG CAGAAAGCGGTCAGGTGTCCGCGGGGGCCTGGGTCCGGGCGAAGGGCCGGGC CCCAGCAGACCTAG | 8676 |
| | 3 | MIGGALQLGAPPLRRSGSAAWVGGVRPTLGAQDSPQQIW GPGARMCQTRFRPDLCASPAPRPCASHPCLSRRTHPPGS DSLCAGLEKSHSAGAQPRLVLLGRKLRPRTGALGGEPWR RPEDARJ* | 8677 | ATGATAGGGCGGGGTCTTTGCAGCTGGGCGCCCCTTGCGCCGCTCTGGCAGCGC CTGGGTTGGGCGGCGTCAGCGCCACCTTCGGCGCCCAGGACTCTCCGCAGCAGATCT GGCCCGGAGCCCGCATGGTCAGACCCGGCTGTCAGACCCGGCTCTCCGCGCTCC CAGGGCCCCTCGCGCCCTGCGGTCACCACCCGGCACCACCCTCCGG GATCTGACAGCCTCTGTGCGCGGTGGGAAAACTCCACAGCGCTGGAGCCAGCCG CGCCTTGTGCTGTGGGAAACTAGAACTGGAGCCCTTGGGGGTGAGCC CTGAGGGCGGCCTGAGGATGCCCGGATCTGA | 8678 |
| | 4 | MPGSESLLGPAPG* | 8679 | ATGCCTGGATCTGAGAGCCTCCTTGGGGCCCGCACCGGGCTGA | 8680 |
| hsa-mir-96 | 1 | MCIFFHPRGASHSAHFANGKLRLREVE* | 8681 | ATGTGCATTTTCTTCATCCCAGAGGGTGCGAGTCATTCTGCCATTTGCAAATGGG AAACTGAGGCTTAGAGAGGTGAAGTGA | 8682 |
| | 2 | MPWGQG* | 8683 | ATGCCATGGGGCCAGGGTTAG | 8684 |
| | 3 | MGPGLAGEPHRSERGQWQNHGRISGSA* | 8685 | ATGGGGCCAGGGTTAGCAGGAGAACCTCACCATTCGAGAGGGGCCAATGGCAGAA CCACCGCCGCATCAGTGGGTCTGCGTGA | 8686 |
| | 4 | MAEPRFHQWVCVRGLYPGHLSP* | 8687 | ATGGCTGAACCACGGCGCATCAGTGGGTCTGCGTGAGGGCCTTGTATCCCGGGCA CCTTTCCCCCTAG | 8688 |
| hsa-mir-98 | 1 | MKVDRTKLKKTPTEAVSIQKFTLLIFSSLKMKKIFVNSSS MLFKSHHPYIQKAVKQQLV* | 8689 | ATGAAAGTGAGACAGGACTAAACTGAAGAAGACACCTACTGAGGCTGTAAGTATCCA AAAGTTTACTTTGCTTCAAATCTCCAGTCAAAATATTGTGAACAGTT TCATCCATGCTCTTCAAATCCATCACCATATACAAAAGGCAGTAAAAACAACAA CTTGTCTAG | 8690 |
| | 2 | MDSQETSGK* | 8691 | ATGGATAGCCAAGAGACCAGTGGAAAGTGA | 8692 |
| | 3 | MQKGCVV* | 8693 | ATGCAGAAAGGATGTGTGGTATAA | 8694 |
| | 4 | MCGHMERADMGSDF* | 8695 | ATGTGTGGTATAATGGAAAGAGCAGATATGGTCAGATTTTAA | 8696 |
| hsa-mir-99a | 1 | MHLLCPCCRKEPADWPLSAAHSTGWL* | 8697 | ATGCACCTATTGTGTCCGTGCTGCAGAAGGAGCCTGCCGATTGGCCACTGTCTGCA GCACATAGCACTGGCTGTATAA | 8698 |
| | 2 | MTAFFLQCGWRESGEGGGVSSTVKAAQIFFLSLSLPLHR LLFLHALSHFA* | 8699 | ATGACTGCATTCTTTTTGCAAGGGGGTGGAGGGAGGGAGCGGAAGGAGGGGTGT CAGTCAACTGCTAAAAGCTGCACAGATTTTTTTCTCTCCGCCTCTCCAT AGATTGTTTCTTGCATGCCCTGTCATTCGCATAG | 8700 |
| | 3 | MPCLISHS* | 8701 | ATGCCCTGTCTCATTTCGCATAGTAA | 8702 |
| | 4 | MLRIPCLNLKNNDSAVIRNLVRV* | 8703 | ATGCTAATTAAGATCCTTGTCTTAACCTGAAAATAATGACTCGGCTGTAATTAGA AATCTGGTGAGAGTTAA | 8704 |
| | 1 | MVCERISVCLGRKLFLDLQKSQKTSR* | 8705 | ATGGTTTGTGAAAGAATATCTGTGCTTAGGGAGGAAACTTTTGATCTGCAGAAA AGCCAGAAGACATCTAGGTAA | 8706 |

Figure 1 (Continued)

| | | | | | |
|---|---|---|---|---|---|
| hsa-mir-99a | 2 | MFIFVEVQNVLITVCLFFVCLFKS* | 8107 | ATGTTCACTTTTGTAGAAGTTCAAAATGTACTGACGATTGTTTGCTTATTTTTGTTTGTTTGTTTAAATCTTAA | 8108 |
| | 3 | MLLWKEY* | 8109 | ATGTTGCTTTGGAAGGAATATTAA | 8110 |
| | 4 | MRPLCT* | 8111 | ATGAGGCCCTTTGCACATGA | 8112 |
| hsa-mir-99a | 1 | MLLLDSSCLFFLLLWLF* | 8113 | ATGCTCCTCCTAGACAGCAGTTGTTCTGATATTCTCCTTTGTGTGTTTTAG | 8114 |
| | 2 | MDMKSEESDHRRKPFQVKIKNKEQIRFTVFKEKQHSFDCVLL* | 8115 | ATGGATATGAAAAGTGAAGAAAGTGATCATAGGAGAAAACCATTCAGGTAAAAT AAAAACAAAGAGCAAATAAGATTTACTGTTTTAAAGAAAAACAACATTCTTTTGA CTGTGTTTTGTTATAA | 8116 |
| | 3 | MSVTVEILLMVFI* | 8117 | ATGAGTGTAACTGTTGAAATTTTTATTGATGGTTTCATTTGA | 8118 |
| | 4 | MCAMTYLCEKFLVVNWAVCYPLMICLCIHTLKIGAIRFTRKLYRKRKKLYFLICCTI* | 8119 | ATGTGTGCTATGACCTACCTTTGTGAAAATTTCTTGGTCAATTGGGCAGTTTGT GTCCCATTGAATATATGTCTGTGTATCCATACGCTTAAGATAGGTGCAATACGTTT ACTAGAAAGCTTTATAGGAAAAGAAAAATTATATTTCTTATTTGTTGTACCATA TAA | 8120 |
| hsa-mir-99b | 1 | MGDTDNAPQAEKEDGDREREAKGRTDVQRQGGQTER DYTERQQKQPRMTGAERRRERGRERERREGGREG ERERESTHRARRRRREEGGRPARDRTGRRCGGELGKA GEERDWPRRAGERERRPRRLPASFVPSLLCYRLLWPG LPLPLPPPRGWMEFFLDLGQLRGRGEARPDWAGRW GGAGACGPLGRGLVRRPRSRRGPGSPGPQSRGGGD GRRESGRREGGWRGRREEGERRPCGEGGERMESARRR WGPACCGPGAAEKTPSLRRGSRGSRESAEREGGGH.GPAL LGP* | 8121 | ATGGGAGACACAGATAATGCCCCACAGCCAGAGACAGAAGAGGATGGAGATAGGGAGA GGGCGAAAGGAAGGAGCAGCAAAAGAAGACAGCAACCAAGAGTGGAGGAGCACAGGAAAAGAGA CACAGAGGAGGCAGCAAACAAGACAACAAGAGAATGACAGGAGCAGAGAGGAGGAGGGAA GAGAGGAGGAGGCGAGAGAGCACGCACAGAGCGAGGAGGAGGAGGCGAGGAGAGAGAG GGAGAGGAGGCCAGCGAGGGACAGGACTGGCCGAGAGGAGCCGAGAGGGAGCTAGGG AAAGCCGGGAGGAGCGCTCCCGGCCTCCCGGCCTCTTTGTCCTTCCCCTCTCCCGGGCTCAGCTTCTG GCCCCCGCGCCTCCCCCTCCCCGCTCCCCCGGCCTCTGGCGCAGGCTCGCAGCCTTCTG CTGGACCTGGGCCAGCTCCCGACCAGGGCGGAAGCCAGGTCGACGACGGGAGGCTGAGCC GGCGCTCGCGGAGCCCCCCCCGGCGGGAGAAGCAGAGTCGCTGCCGGGCCGAGGAGGA GGCAGCGCGGCGGGGTCCAGGGAGTCGGGCCGCCGTGCCGCCGCCGGCGAGAGCGCTCG GGAACCGGCGGAGAGCCCCGCGGAGCCGTGAGTCTGCGGAAAGGAGGGTGGGGCTGGG GCCCGCACTCTGGGTCCCTGA | 8122 |
| | 2 | MPHRQRKRMEJGRGRKEGQMCRDRREDRRKETQRGSK SNQE* | 8123 | ATGCCCCACAGGCAGAGGAAGAGAATGGAGATAGGGAGAGGGCGAAAGGAAGGAC AGATGTGCAGAGACAGAGGAGGGAGGATGGGAGAGAGACGAAAGAGACACAGAGAGGGCAGCAA AAGCAACCAAGAATGA | 8124 |
| | 3 | MAGTAGGRGEAAVRRRGEDGERSAAVGPGLRARGG GEDPFPATREPREP* | 8125 | ATGGCCGTGGACGGCGGAGGAGGCGTGAGGAGGAGGCCGCGTGCGCGAAGGCGGGGAG AGGATGGAGAGCGCTCCGGGGTGGACCGCGGGGGACCGGAGCCGGGCCGGGGCGG AGAAGACCCCTTCCTCCTGACGCCGGAGGCCGCGGAGCCGTGA | 8126 |
| | 4 | MGAGAGRIVAGRD* | 8127 | ATGGGGCTGGCGTGGTGTAGGAATCGGCGTGCTGGAAGAGACTAG | 8128 |
| hsa-let-7a-1 | 2 | MKFGR* | 8129 | ATGAAGAGGAAGTAG | 8130 |
| | 3 | MPLLPAAKCSLPS* | 8131 | ATGCCCCTGCTCGCGGCCAAGTGCAGCCTCCCTGA | 8132 |
| | 4 | MSLASNALRSFNFLQ* | 8133 | ATGTCTCAGTAATGCCTCTTCAACTTTTACAGTAG | 8134 |
| hsa-let-7a-2 | 1 | MPFGLSTPYSRFCVRGNGMYSSTYRPLKN* | 8135 | ATGCCCTTCAACTTACGGTTTTACACTAGATTCGTGTCAGAGGTAATGTATGT ATTCTTAAACTTACCGGTTTTAAAAATTGA | 8136 |
| | | MATAVQISATALLLQVHDPYRGTSVNMPVTRLGYKJW EEQRRSFPLYFSFSVLPSSLSISTTPPPIQRPCNSN* | 8137 | ATGGCTACAGCTGTGCAGATTTCTGCCACAGCCTTGCTGCTTCAAGTGCACGATCCT GTGCGTGGCACAAGTGTAAATATGCCTGTTACACGCCTGGGTTATAAAATCTGGAG GAACAACGGCGCTCCTTCCCTCTCTACTTTTCTTTTTCGTCTGCTCCCTCCCCTTTC TATTCCTCTACCACCCCCCAACAACAAAGACCCTGTAATTCTAATTAG | 8138 |

Figure 1 (Continued)

| | | | | | |
|---|---|---|---|---|---|
| hsa-let-7c | 2 | MNIKLLGKNPDF* | 8139 | ATGAATATAAAGCTATTAGGAAAAATCTGACTTTTAG | 8140 |
| | 3 | MLDFMWLGLLQQKRP* | 8141 | ATGTTGGATTTTATGTGGCTGGGTTGCTGCAGGGAGACGACCATAA | 8142 |
| | 4 | MLPHWSRC* | 8143 | ATGCTGCCTCATTGGAGCCGATGTGA | 8144 |
| | 1 | MLPQLMYHQLSLA* | 8145 | ATGCTGCCTCAGCTAATGTACCACCATTTCACTGCTTAA | 8146 |
| | 2 | MFQDPFKNHLMVIESSH* | 8147 | ATGTTTCAAGATCCGTTTAAAAACATTATTTAAATGTTATTTTAGCAGCCATTAA | 8148 |
| | 3 | MLFLAAPLYTLNYLRLHAKSKSLFSFRYFIVQNLVASLTAIYLSLSKLLL* | 8149 | ATGTTATTTTTAGCAGCCATTAAGTCTCTACACTCTTAATTATCTTATTAAGCTCCATGCCAAATCCAAATCTCTTTCAGCTTCGTCACTTCATTGTCACTACTTGCAAACCTAGTCGCTTCTTTAACAGCCATCGTCCTTCACTTTCAAAACCTAGTGTGA | 8150 |
| | 4 | MPNPNLFSAFATSLCKT* | 8151 | ATGCAAATCAAATCTCTTTTCAGCTTTGCTACTTCATTGTCAAAACCTAG | 8152 |
| hsa-let-7d | 1 | MKEGR* | 8153 | ATGAAGGAGGAAGGTAG | 8154 |
| | 2 | MPLLPAAKCSLPS* | 8155 | ATGCCCCTGCTCCCGGCCAAGTGCAGCCTCCCTTCTGA | 8156 |
| | 3 | MSLASNALRSFNFLQ* | 8157 | ATGTCCTTGGCCAGTAATGCCTTCCGTCTTTCAACTTTTTACAGTAG | 8158 |
| | 4 | MPFGLSTFYSRFCVRGNGMYSSTYRFLKN* | 8159 | ATGCCCTTCGGTCTCTTCAACTTTTACAGTAGAGGTCGTGTCAGAGGTAATGGTATGT ATTCTTCAACTTACCGGTTTTTAAAAAATTGA | 8160 |
| | 1 | MAGTAGGRGEAAVRRRGEDGERSAAVGPGLRARGGGEDPFPATREPREP* | 8161 | ATGGCGGGACGGCGGAGGGAAGGGAGAAGCCGCCGTCGGCGAAGCGGGGAGAGGATGGAGAGCGCTCGGGAGAGCCGCCGGCGCGGGGAGCCGTGA | 8162 |
| | 2 | MESARRRWGPACGPGAAEKTPSLRRGSRGSRESAEREGGGLGPALLGP* | 8163 | ATGGAGAGCGCTGGCGCGGCGCCTCCTGCACGCGGAGCCCGGCGAAGCCGCCGTGATCCTGGAAGGGAGGGAGGAGACCGCTGGCGCTCCTGGTCCCTGA | 8164 |
| | 3 | MGAGAGRIVAGRD* | 8165 | ATGGGCGCTGGCGCTGGTAGGATTGTGGCTGGAAGAGACTAG | 8166 |
| | 4 | MGLRGFEGSRVSRASGRGPRRRGRLSGLPDRPGSAAGAGDVWRRRGPASMLPRGPGIPGPRPLLPQIWEYTIQSPTHSRIRAPSPLFSRIQESEPPVCSLRPGNPHSSP* | 8167 | ATGGGGCTGCGGGGCTTTGAGGGTCAAGGTGAGCCGTGCCAGTGGGAGCGGGCCGAGGAGGAGGGGAGGTTGTCGGGCTGCCAGACAGGCAGGCAGGCCAGGGGCGGGGGCAGGAGAGATTCTGGAGGCGCATCGGCAGCGATCGGCTGCAGATGCTACCGCGACCCCGGCACCCATTCCAGGAATCCGAGCCTCCCAGCGGCGAGTACTACCACCAGTCGCCGCCAGTAGTTCGCAGGATCGTCAGAGTCCGAGCCGTAGCCGAGGAGTCTGAGTCCCCCAGTCTTTTCTCTCAGACACAGGAATCCACACTCCAGCCCTAA | 8168 |
| hsa-let-7e | 1 | MKEGR* | 8169 | ATGAAGGAGGAAGGTAG | 8170 |
| | 2 | MPLLPAAKCSLPS* | 8171 | ATGCCCCTGCTCCCGGCCAAGTGCAGCCTCCCTTCTGA | 8172 |
| | 3 | MSLASNALRSFNFLQ* | 8173 | ATGTCCTTGGCCAGTAATGCCTTGCGGTCTTTCAACTTTTTACAGTAG | 8174 |
| | 4 | MPFGLSTFYSRPCVRGNGMYSSTYRFLKN* | 8175 | ATGCCCTTCGGTCTCTTCAACTTTTACAGATTCGTGTCAGAGGTAATGGTATGTATTCTTCAACTTACCGGTTTTTAAAAAATTGA | 8176 |
| hsa-let-7f-1 | 1 | MFTTLGIASPTLLLYCRGELQRSVGFIGALVRIFTVL* | 8177 | ATGTTCACTACCCTGGGAATCGCCAGCCCAACCCTCCTCTTATACTGCAGAGGTGAGTTACAGAGATCTGTTGGATTCATCGGAGCTCTTGTAAGAATTTCACTGTCTTTAG | 8178 |
| | 2 | MFLSYTQIRYLPHFFVDYMCSLLGSAAFWGHPNYVNSSAHVFSNY* | 8179 | ATGTTCTTGTCATACACACAAATAAGGTATTTGTTCCATTTCTTTGTGGATTACATGTGTAGCCTTTTGGGGAGTGCAGCCTTTTGGGGGAATACACAAATTATGTCAATAGTTCTGCACATGTATTTAGCAATTATTAA | 8180 |
| | 3 | MSIVLRMYLAHKCLMPST* | 8181 | ATGTCAATAGTTCTGCGCATGTATTTAGCACATAAGTGTCATGCCAAGCACTTAA | 8182 |
| | 4 | MVGVQTTERV* | 8183 | ATGGTTGGTGTACAGACGACAGAGAGGGTGTAG | 8184 |
| hsa-let-7f-2 | 1 | MKLTDSVLRSFRVAKVFRENSDKINCFDFSPNGETVISSSDDDSFVLYDCQEGK* | 8185 | ATGAAGCTTGACCGACAGCGTGTTGCGGAGCTTCCGGTTGCTAAGGTGTTCCGGAAAACTCGGACAAGATTAACTGCTTCAGCCGCCAACGGCGAGACGGTCATCTCGAGTAGCGACGACGACTCCATCGTGCTCTATGACTGCCAGGAGGGCAAGTGA | 8186 |

Figure 1 (Continued)

| | | | | |
|---|---|---|---|---|
| hsa-let-7g | 2 | MTARRASECGGGPGPESQCLPPVAQHRSLGLPSVPTSAPSLFCTRSCQGRLHPAAVQEFFYFHLKKKR* | 8187 | ATGACTGCCAGGAGGGCAAGTGAGTGCGGTGGAGGCCCTGGCCCGAGTCTCAGTGCCTCCCTCCGGTGGCCCAGCACAGGTCCTGGCCTCGGCCTCGCCTCCGACTTCAGCCCCAGCCTATTTGCACGGGTTCCTGCCAGGGTCCCGTCCCACCCCAGCCGTCCAGGAGACCTTTTATTTTTTCTTGAGCGCTATGCATCACTTGCCAAACCCACCTGACCTTGGGAGACCTTTTATTTTTTCTTTAAAAAAAAGATAA | 8188 |
| | 3 | MSSVSFERYASLAKPHLDLDL* | 8189 | ATGTCTTCGGTCTCCTTTGAGCGCTATGCATCACTTGCCAAACCCACCTGACCTTGACCTTTAA | 8190 |
| | 4 | MHHLPNPTLTLTFKRPVPFWAHQVAFSAPQAVKGAGLLRPRRTAGAAFLPPSAASALSCALSTVTSIPPWHSAHPLPLSFPRPFCRQTAWVALLSCQDLFVVPL* | 8191 | ATGCATCACTTACTTGCCAAACCCACCACCTTGACCTTGACTTTTAAACGCCGGTCCGCCACCCTTGGGCCCACCAGCTAGGGTTTCAGCCTCCTCAGCGTGTCAAAGGTGTGGTCTGCTCGGACGCACGAGGACTGCAGGAGCTCTCCACTGTGACCTGCAGTCCGCCCATCGCTCTCTGTGTGCCGGCGTGACCTTTCTCGCCCTGGCACTCCGCCCATCCCTGCCCCTCAGCTTCCGGTCACGCTCAGCCTGTAGCTGGGGTTGCACTTCTTAGCTGTCAGGATTTATTTGTTGTCCCCTTTGA | 8192 |
| | 5 | MPWLLFGGAGGSLCGMPAGDYRRERAGGGFDSAARVGARVPDSAAAQPPPGTRSREGRERRSSGRGGSS* | 8193 | CGATTATCGCCGCGAGAGCGGCCGCGGCGGCCGGTCGACAGCCGGCGCGGGTGGGGGCCGGTACCGGACTCCGCGCCGCAGCCGCCAGCCCAGCTCGGGAGGACTCGGAGCAGGGAGGGGCGCGAGCGGCAGCGGCGGCAGCTCGGGACGTGGGCAGCTCCTAG | 8194 |
| hsa-let-7i | 2 | MALAEVVYCAVGRVVTLPAVEITAQATALLVLVMLSAAEDNGWESPLFSGALPGDSPRSLGARPARPPRKPLVSHFPRRN* | 8195 | ATGGCCCTGGCTGAAGGTAGTAGTTTGTCGTTGTCGGTTGTGACATTGCCGCTGTGGAGATAACTGCCAAGCTACTGCCTTGCTAGTGCGTGGTGATGCTCAGCGCCGCGAGGACAATGGCTGGGAATCCCTTGTTTTCGGGCGCTGCCTGCGGACAGGCCGAAGCCTCGGCGCCGGCGCCATCACGGAAACCGTTAGTTTCACATTTTCCTAGAAGGAATTGA | 8196 |
| | 3 | MAGNPLCFPGRCLGFAREASAPGRRGHHGNR* | 8197 | ATGGCTGGGAATCCCTTGTTTTCGGGCGCTGCCTGCGGACAGGCCGAAGCCTCGGCGCCGCGGCGCCATCACGGAAACCGTAG | 8198 |
| | 4 | MHFKGWERAKPLDSFS* | 8199 | ATGCATTTTAAAGGTTGGGAAAGAGCTAAGCCATTGGATTCCTTTCTTGA | 8200 |
| hsa-mir-101-1 | 1 | MATAVQISATALLLQYHDPVRGTSVNMPVTRLGYKJWBEQRRSFPLYFSFSVLPSSLSISTTPPTQRPCNSN* | 8201 | ATGGCTACAGCTGTGCAGATTTCGCAGCCCTGCTCGTTCAAGTCACGATCCTGTCGTTGGCACAAGTGAAATATGCCTGTTACACGCCTGGGTTATAAAATCTGGAGGAACAACGGCGCTCCTTCCCTCTATTTTCCTCTCATTCTGTTTCTGTTCTTTACCCTCTCCCTTTCTATCCTCTACCACCCCCAACACAACAAGACCCTGTAATTCTAATTAG | 8202 |
| | 2 | MNIKLLGKNPDF* | 8203 | ATGAATATAAAGCTATTAGGAAAAATCTGACTTTAG | 8204 |
| | 3 | MLDFMWLGLLQGRRP* | 8205 | ATGTTGGATTTTATGTGGCTGGGCTTGCTGCAGGGAGACGACCATAA | 8206 |
| | 4 | MLPHWSRC* | 8207 | ATGCTCCTCATTGGAGCCGATGCTGA | 8208 |
| hsa-mir-101-2 | 1 | MGISAVLRGPRWGVSGNAGSPGRLARPHEGSGAEGRGVCVNVAHSLFPRPRPRPGCWRGSLAVRRRL* | 8209 | ATGGGCATTTCCGCGGTTTTGCGCGGCCTGCGCTGGGGTGTCAGTGGCAACGGCGGGGAGCCCCGGCTGGCTCGCCACCCGAGGGAGGGCTCCGGCGCGGAGGGGGCGGGTGTGTGTAAATGTTGCGCACTCGCTTTCCGCCGCTCCTCGGGGCGAGGGGCCGTCAGGGGTGCTGGCGTGGGTCCCTTGCCGCCGGCGACTGTAA | 8210 |
| | 2 | MLRTRFSPAPARVQGAGVGPLPSGGDCK* | 8211 | ATGTTGCGCACTCGCTTTCCGCCGCTCCTCGGGGCGAGGGCTCCGGCGCCGGCGACTGTAAATAG | 8212 |
| | 3 | MLFT* | 8213 | ATGTTGTTTACATGA | 8214 |
| | 4 | MKDPACKGY* | 8215 | ATGAAGGATCCGGCKGGGGAGAGTCTAA | 8216 |
| hsa-mir-103-1 | 1 | MKIKDAKKPCKTGAGARQVGRAPLGPV* | 8217 | ATGAAGATCAAAGATGCAAGAAACCCTGTAAGACCGGGCTGGGGCCCGCCAGGT | 8218 |
| | 2 | MPRNPVRRGLGPARLGGHPWAPSESPLAGRSASKPVAPRRRFVRYGGGGTJ* | 8219 | ATGCCAAGAAACCCTGTAAGACGGGCTGGGGCCGGGCCTGGGCTGGGCCCCAGGTTGGGGCCCGGTCGAAGCCCGTCGCTCCAAGCCCGTCGCTCCGAGGCCACCCCTTGGCTCCGGTGCGGCGGCGCTTCGTCCGGTATGGGGGGAGGGACCATTTGA | 8220 |
| | 3 | MGAEGPFEPFRVRGRPRPRPHHAW* | 8221 | ATGGGGGCGGAAGGACCATTTGAGCCACGAGTTCGAGGCTTCCGTCCTCCCCATCCCCCTATTCATGCATGCGTGA | 8222 |

Figure 1 (Continued)

| | | | | | |
|---|---|---|---|---|---|
| | 4 | MHGECLPPPSLSSHFLFEHWEVPEGISDSDFCQTRLVSSP SSP* | 8223 | ATGCATGGTGAATGCCTGCCGCGCCCCTAGCCTTTCCTCCCACTTTCTTCTTCGAGATCT GGGAGGTGCCAGAGGGAATTTCTGATTTCTGATTTTGTCAAACCAGACTAGTCTCCT CTCCCAGCTCCCCTGA | 8224 |
| hsa-mir-106a | 1 | MVEREGSGFILHPFPPSLPPACLPGLSSSDPACSLVSDL* | 8225 | ATGGTGGAAAGGGAGGGGTCCGGCTTCATTTGCACCCTTCCTCCTTCCTGCCC CCGGCTTGCCTTCCAGGCTTCCTTCCTGACCCAGGCGTGCTCACTGGTCTCTGATT TGTAA | 8226 |
| | 2 | MLNSLIVRLKLRHHFILQSAVGLWP* | 8227 | ATGCTTAATTCATTTGATTGTGCTCTTAAACTAAGACATCATTTTATTCTACAGA GCGCTGTCGGGCTTTGGCTTGA | 8228 |
| | 3 | MRGESKIIAPYLPHCACIRWLLPLTPAKKP* | 8229 | ATGAGAGGAGAAAGCAAGATAATTGCACGTATCTCCGCACATTTGCGCGTGTATT CGGTGGCTACGCGTTAACGATACCTGCCAAGAAACCCTGA | 8230 |
| | 4 | MCRE* | 8231 | ATGTGCAGAGAGTAA | 8232 |
| hsa-mir-106b | 1 | MANGWTGSRPGRRNPEL* | 8233 | ATGGCCAATGCTGGACTGGCTCCCGCCCTGGGCGAGGAATCCGAGCTGTGA | 8234 |
| | 2 | MAGLAPALGGGIPSCEAAGIRAHVLLCLLRAEAMAGAG VGCGCGVRWRRSR* | 8235 | AATGGCTGGACTGGCTCCCGCCCTGGGCGGACGGAATCCGAGCTGTGAAGCGGCTGG AATCCGGGCCATGTGTCTTCTTTGTTTACTAAGAGCGGAAGCGATGCGGGAGCGG GGGTGGGTGCGTGCGGGTGCGTGCGGAGGTCCCGGTGA | 8236 |
| | 3 | MCPFYY* | 8237 | ATGTGCTTCTTTGTTTACTAA | 8238 |
| | 4 | MLDGPVHCHGSLFILRWLETDL* | 8239 | ATGTTGGATGGCCCGTGCACTGCCACGGGCTCTTTATTCTTCGCTGGTTAGAAACA GACTTGTGA | 8240 |
| | 1 | MHRSLQYPLASPPRKQFPVCEAALWTASPLVDPG* | 8241 | ATGCACTCTCTGCAGTATCCTCTAGCTTCTCCTCCCGGAAACAGTTCCAGTCTCCG AGGCCGCCCTCTGGACTGCCTCCCCTAGTGGATCCGGGCTGA | 8242 |
| hsa-mir-10a | 2 | MHLGRKGTSQAPDHPALPKDPCQLERWGVRTERHT* | 8243 | ATGCATCTAGGGAGGAAAGGTACTCGTCAGGCCCCAGACCATTTGCCTTACCAAAA GATGACCCAGCCAGTGGAAAGGTGGAGTCAGGAGTCAGGACGACGGAAAGGCACACCTAG | 8244 |
| | 3 | MTQASWKGGESGRKGTPRGEVEGKCQPVWGVAS* | 8245 | ATGACCCAGGCCAGTGGAAAGGTGGGAGGGAAAGTGCCAGCTGTGTGTGGGGCGTGCGCTCTGA | 8246 |
| | 4 | MIEDTLFRGSCRLVLRCMHLSNSPSFLFSESQGIPRREKG NPSQGVEVGVWEAIFGRKGNRKRTGCPHRRCSGPEAEAV TSRSCQ* | 8247 | ATGATAGAGATACCTATTTCGGAGGGATCCTGTCCTTAGGTGCATGCAT CTCTCTAATTCGTTTTCTTTCTGTTTTCTGAATCCAAGGGATCCAAGGAGGGAGA AGGAAAATCCTTCCCAGGAGAGGAGAGGTGGGGTCTGGGAGGCGATATTTGGGCGAAG GGCTGTAACATCCGGAGCTGCGCCAGTAG | 8248 |
| | 1 | MPPRSLGRRPPWAAQSGCSPTFPGEVGGRCLSPFPQSLR S* | 8249 | ATGCCACCAAGAGCCTGGGCGCCGACCCCTTGGCAGTCAGTCGGCTGCTCC CCTACATTTCCCGGGAAGTGGGGGGTCGTGTCTAAGCCCCTTCCCCAATCACTT CGTTCCTAG | 8250 |
| hsa-mir-10b | 2 | MESPSILP* | 8251 | ATGGAGAGCCCCTCAATCTACCCTAG | 8252 |
| | 3 | MCLYFESRL* | 8253 | ATGTGTCTTGGTGTTTGAATCTAGGCTTTAG | 8254 |
| | 4 | MLVNF* | 8255 | ATGCTGGTTAATTTCTAG | 8256 |
| hsa-mir-125a | 1 | MAGTAGGRGEAAVRRRRGEDGERSAAVGPGLRARGG GEDPFPATREPREP* | 8257 | ATGGCGGGGACGGCGGGGAGGAAGGAGAGGCGCCGTGCGGCGAAGGCGGGGAG AGATGGAGAGCGCTCGCGGCGTGGGGCCGGCCCGGGGCCCCGGCCCGGGGCCGG AGAAGACCCCTTCCCTGCGACGGCAGAGCCGGAGCCGTGA | 8258 |
| | 2 | MESARRRWGPACGPGAAEKTPSLRRGSRGSRESAEREG GGLGPALLGP* | 8259 | ATGGAGAGCGCTCGCGGCGCCGTGGGCCCGGCCTGCGGGCCGGGGGCCGGGGA AGACCCCTTCCCTGCGACGCGGAGCCGGAGCCGTGAGCGGAGCGTGAAGGCGGG GGGCTGGGGCCGGCCCGCACTCTCGGTCCTGA | 8260 |
| | 3 | MGAGAGRIVAGRD* | 8261 | ATGGGGGCTGGGGCTGGTAGGATCGTGGCTGAAGAGACTAG | 8262 |

Figure 1 (Continued)

| | | | | | |
|---|---|---|---|---|---|
| | 4 | MGLRGFFEGSRVSRASGRGPRRRGRLSGLPDRPGSAAGA GDVWRRRGPASMLPRGPGIPGPRPLLPQJWEYTTQSPIJH SRIRAPSPLFSRIQESEPPVCSLRPGNPHSSP* | 8263 | ATGGGGCTGCCGGGGCTTTGAGGGGTCAAGGGTGAGCCGTGCCAGTGGGAGGGGAGGCC GAGGAGGAGGGGAGGGAGGTTGTCTGGAGGAGCAGGCCAGGGTCAGGGACCGG GCAGGAGATGTCTGAGGAGGAGGAGGAGCCCAGCAGCCATCCAGGCCCCTGGAGGACCCG GATTCCAGTTCCCAGACGTCCAGACCCCTCCTCCCTCAGATCTGGAGTACACCACCAGTCCA CACCCATTCCAGTCTGTCTCTCAGAATCCAGCCCGGGAATCCACACTCCAGCCCTAA GCCCCCAGTCTGTTCTTCTCAGAATCCACCAGGGAATCCACACTCCAGCCCTAA | 8264 |
| hsa-mir-125b-2 | 1 | MYSLRRMGLRDGGGHMLMSFLWRGEIFHSDNWLNAM VKNCKAIFSFREKHGLRSKGCFHFSLFVSAAFLFFWFLFF NYLF* | 8265 | ATGTATTCCCTAAGGAGGATGGGTCTCCGTGATGGGGTGGTATAATTATTGTTAATG TCATTTTTATGGAGGGGTGAGATTTTCATTCTGATAATTGGTTGAATGCTATGTCA AAAATTGTAAAGCATATTCAGTTTTAGGGAAAAGCATGGACTTAAGGACTAAGGGCT GTTTTATTTTTCGCTTTTCGCTTTTATTTTTCGCTTTTGTTTTGTTTTGTTTTTTA ACTATTTATTTTAA | 8266 |
| | 2 | MGVV* | 8267 | ATGGGGGTGGTATAA | 8268 |
| | 3 | MLWSKIVKPYSVLGKSMDLDLRAVLFFRFL* | 8269 | ATGCTATGGTCAAAAATTGTAAAGCCATATCAGTTTAGGGAAAAGCATGGACTTA GATCTAAGGGCTGTTTTATTTTTCGCTTTGTGA | 8270 |
| | 4 | MGNQMINRKRSYIMMHYIMEQNI* | 8271 | ATGGGAAATCAAATGATAAACAGAAGGATCTTATATATGATGCATTACATCATG GAGCAGAATATTTAA | 8272 |
| hsa-mir-128-2 | 1 | MPYTYS* | 8273 | ATGCCTGTGACCTACAGCTGA | 8274 |
| | 2 | MHFDLYLSM* | 8275 | ATGCATTTTGACCTTATCTTTCTATGTAG | 8276 |
| | 3 | MHQLFKVIGLRK* | 8277 | ATGCATCAGTTGTTCAAAGTTATAGGGCTCAGAAAGTGA | 8278 |
| | 4 | MKLIQLPMKTTGEYPIFQAAGTIETIRKHSLPCDIQLRGLP RKEKPWGRERSAPRRLSILSCCCPK*NAFPPFLSILKHFLG LHCCSRQELLYEYKGGR* | 8279 | ATGAAACTGATCAACTACAGACCACATGAAAAACAACAGGGGAATATCCATTTCCAGGCT GCTGGTACAGAGCGTGGGTGGGGAACGTTTCCAAAGGCGGTGTTGCAAACACAACGCGATT TTGCACGAGGGTGGGTGGGGAACGTTGGGAAGGGTATGGATGATTTTTTTTTTCCTCAT AATACTCTCTTGCTGCTGCCCAAAATGCATTCTTCCTTCCTTATCAATTCTCAAG CATTTTCTCTGGGGCTAATCTGTCCAGGCAGGAGCTCCTCTATGAATATAAAGGA GGAAGGTAA | 8280 |
| | 1 | MSLFSPAPS* | 8281 | ATGAGTCTATTTCCCAGCCCCTCGTAG | 8282 |
| | 2 | MQLSKYTFPKAVCCKRNAILQSVGGKRGKGMDDFFFP HLGISIVDSNRF* | 8283 | ATGCAGCTTTCAAAATATACATTTCCAAAGGCGGTGTGTTGCAAACACAACGCGATT TTGCACGAGGGTGGGTGGGGAACGTGGAAGGGTATGGATGATTTTTTTTTTCCTCAT CTGGGAAATCTCCATCGTGGATAGCAATCGTCTAG | 8284 |
| | 3 | MIFFFLIWESPSWIAIASRALLGSSSGEGAMPPHPLLSSA CRESDQWRHAALRIQPLQRLLLGETARSLQQAETDGS* | 8285 | ATGATTTTTTTTCGGAAAGCTCTCTACATCTGGGAATCCATCGTGGATAGCAATCGCTTCTAGAG CTCCTCTGGGAAAGCTCTCTACATCTGGGGAGCTATGCCCCCACCCCTACTTTCCT CAGCATGTAGGGAATCTGATCAATGCAGACTGAGACGCTCAGCTCTAAGAATACAACCACTCC AACGCCTTCTGCTCCGGGGAGACTGCGAGAGCTTGCAACAGGACAGAGACAGATGGG AGTTAA | 8286 |
| | 4 | METCSSKNTTTPTPSARGDCEELATGRDRWELTGGREN HRNTWVFF* | 8287 | ATGGAGACATGCAGCTGCAACAGCTGCAACAGCAGATACAACCACTCAACGCCTTCTGCTCCGGGAGAC TGCGAGGAGCTTGCAACAGGACAGATGGGAGTTAACGGAGCGGAGGGAGAGA ATATAAGAAATATTTGGGTATTTTTCTGA | 8288 |
| | 1 | MAGILFRLTLRVLTGPWAEGMSA* | 8289 | ATGGCCGGGATCCTCTTCCGTCTAACCCTCCGCGTCCTGACCGGGCCCTGGGCGAA GGGATGTCTGCGTGA | 8290 |
| hsa-mir-130b | 2 | MLEKNPECP* | 8291 | ATGTTAGAAAAGAATCCAGAGTGTATCTAG | 8292 |
| | 3 | MESSARRGASSRGGAALFLLEPRAESGRRVVGLYPPRS GR* | 8293 | ATGGAGTCGTCAGCTAGAAGGGGCGCGTCGTCCCGGGGTGGGGCCGCCCTTTTCTC CTGGAGCCCCGGGCCGAGTCAGGCGCCAGGGTCGTCGGGGCTGTACCCACCCCGGTC CGGGCGCTAG | 8294 |
| | 4 | MDWTGALPRPPHG* | 8295 | ATGGACTGGACGGCGGGCTCTGCCCCACCCACCATGCATGGTTGA | 8296 |

Figure 1 (Continued)

| | | | | | |
|---|---|---|---|---|---|
| hsa-mir-138-2 | 1 | MPSFFTHELGGLIKEQEVPILHWGQDADPAPVLRELTV* | 8297 | ATGCCTTCCTTTTTCACTCACGAGCTGGCGGGCTCATCAAAGAGCAGGAAGTGCCC ATTTTACACTGGGGCCAGGATGCAGGACCCAGCTCCTGTCCTCCGCGAACTTACAGTC TAA | 8298 |
| | 2 | MQTQLLSSANLQSN* | 8299 | ATGCAGACTCAGCTCCTGTCTCCGGAACTACAGTCTAATTAG | 8300 |
| | 3 | MHHLNPRTGSFKAKNYRLFRSVQHLLTKKNLRVIFLSL NFYPCLRLARTLNTREAVICSSANAFLL* | 8301 | ATGCATCATTTAAATCCTAGAACAGGCAGCTTTAAGCAAAGAACTACAGACTTTTC CGCAGTGTCCAGCATTTGCTGACCTAGCAGAACCCTTAATACTAAATTTCTCTCTTG AATTTTATACCCTGCCTGCCTCGACTAGCAGAACCCTTAATACTAAATTTGCAGTTATAT GCAGCTCTGCCAACGCCTTCCTGCTTTAG | 8302 |
| | 4 | MQLCQRLPALDWISTILFLY* | 8303 | ATGCAGCTCTGCCAACGCCTTCCTGCCTTTAGACTGGATCTCTACTATCTTTTTCTCT ACTAG | 8304 |
| hsa-mir-141 | 1 | MGARDLQLFRRDPGPEAA* | 8305 | ATGGGAGCCAGGGATCTGCAGCTTTCCGCAGGGATCCTGGGCCTGAAGCTGCCTGA | 8306 |
| | 2 | MMEAPVPVSATSIASGPQPLAGCSPLPTSHAPRKPLVLS* | 8307 | ATGATGGAGGCCCCTGTCCCTGTCAGCAACATCATCGCTCAGGTCCCAGGCC TTAGCTGGCTGCAGCCCCCCCCACTTCCCACGCACCCGGAAGCCCCTGTCTTG AGCTGA | 8308 |
| | 3 | MGPSPSSHPVRFVTWWIQNPQSTLSLGLARPLSRDLTW PVARVPCSNW* | 8309 | ATGGGCCCCAGCCCTCCTCCCACCCAGTGCGATTGTCACCTGGTGGATCCAGAAC CCACAGTGACCTTGAGCTTGGGTTGGCTCGCCCCTCTCAAGAGACCTCACCTGG CCTGTGGCCAGGGTCCCTGTAGCAACTGTGA | 8310 |
| | 4 | MAFGWVLSAVTFREP* | 8311 | ATGGCTCCGGTGGGTTCTCGGCAGTAACCTTCAGGGAGCCCTGA | 8312 |
| hsa-mir-142 | 1 | MSLGNQLEAGRHQSLLLLRD* | 8313 | ATGTCCCTGGGGAATCAGTCGGAGGCAGGCATCAGTCTCTTCTGCTTTGCTT AGGGACTAA | 8314 |
| | 2 | MISLQRDRL* | 8315 | ATGATATCTTTGCAAAGGATCGTTTATAG | 8316 |
| | 3 | MAISRFKMGHLYYCI* | 8317 | ATGCAATTTCCAGTTCAAATGCCACTCTTATTATTGCATTGA | 8318 |
| | 4 | MRKLSFHYSRPQSVAW* | 8319 | ATGAGAAACTGAGTTTCCATTACATCTCTCGCCCAGAGTCAGTCGCCTGGTGA | 8320 |
| hsa-mir-146a | 1 | MQIGLSCLPLPQQIRVSPERCSFSKTLDRSSFPGWHQQG RLEW* | 8321 | ATGCAAATAGGCCTCTTAGCTGCCTTCCTCCACCCAGCAAATAAGAGTCTCCAGAA AGATGCTCTTTTCTCCAAGACGCTCTTGACCGCTCTTCCTGGATGGCACCAGCAG GCCGATTGGAGTGGTAA | 8322 |
| | 2 | MLFLQDA* | 8323 | ATGCTTCTTTCTCCAAGACGCTTGA | 8324 |
| | 3 | MAPAGPLGVVNPGPEGMPKGGQDGQETVAQRGGGEQR LNWK* | 8325 | ATGGCACCAGCAGGGCCGATTGGAGTGGTAAACCCTGGCGCCGGAAGGCATGCAAA GGGTGGACAGGATGGACAGGAGACAGTAGCACGAGGAGGRGGAGAACAGCGG CTGAATTGGAAATGA | 8326 |
| | 4 | MDRKQ* | 8327 | ATGGACAGGAAGACAGTAG | 8328 |
| | 1 | MGCP* | 8329 | ATGGGGTGCCCCTGA | 8330 |
| | 2 | MKVCFRELFLLHSTIPGTSNLYSGFWGDFWGARTPGLG SYLGDPYLGDSL* | 8331 | ATGAAAGTGTGTTTCAGGGAACTCTTTCTCCTCCACTCCACTATCCCAGGTACTTCAA ATCTTTATTCAGGGTTTTGGGGAGAATTTCTGGGAGCTACTAGGACTCTGGGCT CCTATCTTGGGATCCATATCTTGGGGACTTCCTTAG | 8332 |
| hsa-mir-146b | 3 | MPFSVCVFWLFPQPLTPPAPHQAPPGTHLGRKRQMDPC HGPEPPPLLTYSNSCWNLWNSCPPP* | 8333 | ATGCCCTTCTCAGTGTGCGTGTTCTGGCTCTTCCCCAGCCCCTCACCCCTCCAGCC CACATCAGCCCCACCAGGAACACATCTGGCAGGAAGGCACAGATGGATCCTGC CATGGCCCTGAACCTCCCCCCTCTAACCTACTCCAATTCCGAATTTATGGA ACTCCTGTCGTTCCTTAG | 8334 |
| | 4 | MALSPLPS* | 8335 | ATGGCCCTGAGCCCTCCCCCCTCTAA | 8336 |
| | 1 | MERWRGVWGKMGKHFPDLLHARNSCSGAVCGRGSA RMGDRVVAYAAGKRGCREGEKSSLGDCVQGCARTGS AGSTA* | 8337 | ATGGAACGGTGGCGAGGGTGTGGGGGAAGATGGGAAAGCACTTCCAGACCTGTT GCACGCGCGCAACAGCTGTTCAGGTGCGTATGTGGGGGAGGGGTCGTGCTAGGA TGGGGGACAGAGTGGTTGGTCGTTATGCTGCAGGGAAAAGGGGTGCCGGAGGGGA GAAGAGCAGTCTTGGGGACTCTTGGGCGAACGGGGTGCGAACGGGGTCCGCGGGAA GCACTGCCTAA | 8338 |

Figure 1 (Continued)

| | | | | |
|---|---|---|---|---|
| hsa-mir-148a | 2 | MWGEGVC* | 8339 | ATGTGGGAGAGGGGTCTGCTAG | 8340 |
| | 3 | MLQGKGGAGRGRRAVLGTVCKYVRERGPREALPNGAGRIPKSGWYERRGWDDFDPSSRGWARAAGRPGHEYWEWLGKGVSGEAPQSGSFLGRPILGAFPGPVFVPHRLTLSAPNIRPRAAPPPPAFQMCGR* | 8341 | ATGCTGCAGGGAAAAGGGGAGGGTGCCGGAGGGGAGAAGAGCAGTCTTGGGGACTGTGTGCAAGGTTGTCGCGAACGGGATCCGCGGAGGAGAAGCACTGCCTAATCGGGGCAGGGAGAATCCAAAGAGTGGGTGGGTGAGTGGCCGGCTGAACGGGATGGGACGACTTCGACCGAGTTCCCGGGTGCTGGCCGCCACGGCTGAAGACCGGGAATAGAGTACTGGGAATGGCTGGGGAAGGGGTCTCAGGGAGGAGCCCCGCAAAGCGGGTCTTTCTTGGGTCTGCTCATCTTAGGGGCTTTTCCCGGGCCTGTATTTGTTCCCACCGTTTAACTCTTTCAGCTCCGAATATTCGTCCTGCAGCGCCCCAGCTTTCCAGATGGGAAGGTAA | 8342 |
| | 4 | MGQGESQRVYGGWNGGDGTTSTRVPGAGRGRLEDRE* | 8343 | ATGGGGCAGGGAGAATCCAAAGAGTGGTGGTGGAACGGAGGGGATGGGACGACTTCGACCGAGTTCCCGGGCTGGGCGCTGGGAAGACCGGGAATAG | 8344 |
| hsa-mir-148b | 1 | MGNRRSDC* | 8345 | ATGGGGAACAGAAGAAGCGATTGTTAA | 8346 |
| | 2 | MHSVASPSLMLAQVTSASSQKVCTTIE* | 8347 | ATGATCTCTGTGGCTAGCCCTTCCCTCATGTTGCTCAGGTCACTTCAGCATCCTACAGAAAGCTGCACAACCATAGAGTAG | 8348 |
| | 3 | MLIT* | 8349 | ATGTTAACTACATAA | 8350 |
| | 4 | MRSQFVKANLSST* | 8351 | ATGAGAAGTCAGTTTGTAAAGGCAAACTTGAGCTCAACGTGA | 8352 |
| hsa-mir-149 | 1 | MELRARGWWLLCAAAALVACARGEPASKSRSCGEVRQIYGAKGFSLSDVPQAEESGE* | 8353 | ATGGAGCTCCGGGCCTGGTGGCTGCTATGTGCGGCGGCAGCGCTGGTCGCCTGCGCCGCGGACCCGGCCAGCAGAGCCGGAAGTCGCCAGATCTACGGAGCCAAGGGCTTCAGCCTGAGCGACGTGCCCCAGGCCGAGGAGATCTCCGGTGAGTGA | 8354 |
| | 2 | MCGRSAGRLRPRGPGQEPELRRGPPDLRSQGLQPERRAPGDLG* | 8355 | ATGTGTGGCCGCAGCGTGGTTCGCCAGGCGACCCTGCCAGGAAGACCGGAGCTGCGGCGAGATCGCGGAGAGCTACCGGAGCCAAGGGCTTCAGCCTGAGCGACGTGCCCCAGGCGGAGATCTCGGGTGA | 8356 |
| | 3 | MAPCAAAPLQPHGPRLQAPRRTPSPGSPPPRSVVLRPSPPFARRLLPCGADLAGLRARGAPPGPRLELGVFCPPLGPARLQAGSPSPGAGCRGAVOLGVAGLSGRR* | 8357 | ATGGCTCCTGCGGCCGCTCCGCTCCAGCCTCATGGCCCTCGGCTCCAGGCCCCGCGCCGCACTCCGTCTCCCGGCTCGTCCTCCGCCCCGGTCGGTTCTCCGCCGGTTGGGCACTGGCTGCGGCGCTCTCTCCGGCTGCCAGCGTGCGGCCGCCACCGGGAGCCGCCCGAGAGCTCGCTGCCTCTGCCGGTCCGCGAGTCCAAGCCCCGCCGCTCCGGCCCAGGTGTGCGGGCGCTGCTGTG | 8358 |
| | 4 | MGTQRRNAHGPGDSEQEGSVHLGEGGLWPCLAAGGGVVGGGSRALDPCPSRRNRTHROPLALGGSPDAPSLRFL* | 8359 | ATGGGGACTCAAGGCAGAAATGCCATGGTCCTGGGGATTCTGAGCAAGAAGGATCCGTGCATCTGGTGAAGGGGTGGAGGGCAGTGCAGTCTCTGGAGGACCCCTGCCCTCCAGGAGGAACAGAACCCAGAACAGCCCCTTGCCTGGTGGATCTCCAGCCCCAGCTGAGGTTCTTGTAA | 8360 |
| hsa-mir-152 | 1 | MQRPEAGHVRTRGRGPRRQAGGRRRLLEPGSPRGCGYGAGRGRGDPGRRELGRDRAGLGGAANSELARPAAGNFVSPLTGPRTREEKFVPAPTGEEACPESVGAGLKFWVRLEWGWRVSCDSAGRVRSGLSVPDSAPITGG* | 8361 | ATGCAGCGGCCGGAGGCTGGCCATGTCCGCACGCGGGCCGGGGGGCCCGGCGGAGGCGGCGGCTGCTGGAGCCCGGGAGCCCGCGGGGCTGCGGGTACGGTTAGGGGAGGGGAGCAGCCAATCAGAACTCGAGACCCGGAGGAGGGGACGGGGCCGCGGCTGGGAACTTTGTGTCACCCTGACTGGCCTCGCCCCAGGACCCGGGGAGGAAAAGTTCGTCCCAGCGACCGGAGAGGCCTGTCCGGTGAGTTGGGCTGAAGTTTCGGTCGTTTGGAGTGGGGTGGGGTGAGTTGCAGTTCGCGGGAGTCCGGGAGGGGTAAGGAGGGGCCTGTCCGTCCCAGACTCCGGTCCATCACCGGGGTGA | 8362 |
| | 2 | MGMLLESTRARAWGRADSAGPARPGISWKKEARPAVPPGPGSVIHSDSGSGAVSA* | 8363 | ATGGGCATGCTTCTGGAGTCTACCCGGGCACGCGGTGGGGCCGCTGATAGCGCAGGTCAGCGCCCCGCCACCGGGAATCACTGGAAGAAGGAGGCTCGGCCCGCTGTCCCCCGCGCCCAGGTTCTTGTGATACACTCCGACTCGGGCTCTGGAGCAGTGCATGA | 8364 |

Figure 1 (Continued)

| | | | | | |
|---|---|---|---|---|---|
| | 3 | MTELGPGPRTFCTQRAQRPLGACSGTSAAWEWSGHLGWP MWHRAGQNQLWTLRTGVAGA* | 8365 | ATGACAGAACTTGGCCCGGAAGGACTTCTGCACCCAACGGGCACAGGCCCACT CGGGGCCTGCAGTGGAACATTCCTGGGAGTGGAGTGGGCACCTGGGTTGGCCCA TGTGGCACCAGGGCTGGGCAGAACCAGCTGTTGGACCTTGAGGACTGGGGTTGCTGGG GCCTGA | 8366 |
| | 4 | MYPRASRSHRHRVSTSSQGPNGTLLSGVSGRNLPSTPSR LFSS* | 8367 | ATGTATCCTAGGGGCCAGCAGATCCATAGACACAGGGTGTCCACTCAGTCAGGG GCCAAACGGAACTTCCTCCGGTGTCAGTTGCAGGAACCTTCCCTCTACACATC AAGGCTGTTTTCATCCTAG | 8368 |
| hsa-mir-153-1 | 1 | MGGKGAGVRPPLGLEPRVGPGASASDFWPPAPDPTLPP LKAGLRLRLCPSPSLHHPRGPAPRRPHLLCSLPLTLPGLA PSPPPASSRGPSAFCLPSLSRTPASFLLPVPSCPAVSRPCT ALPCCPLRLSLPPARLPSFIPLRPSFIPLRLFASFFCVFHSF SFPLSSSSLSPSLSHSYSASPFPSLSISPSPRFSSFLSALSPV PLRLPLSASFSLLCPSLPLPPAACLSSLCPSLSLLPSFSL SLTAASFVFVFCS* | 8369 | ATGGGGGCGGGAGCGGGCCCCGCCCGGCCCTGCCCTCGCCCTCGGAGCCCGGGTCGG GCCTGGACTCTGCCTCTGCCGCCTCGCGCCGCGCCCAGACCCCACGCTCCCACC CCTAAAAGCAGGGCTGGAGGCTCTGGAGCCTGTGCGCTGTCTGCTCCACCACCGG TGGGCCAGCTCCGCGCCGCCCACCTGCTTCCTCCAGAGGGCCCTCTTCTGTCTCCCC ACTGGCTCCTTCTCCAGGACCCCTGCCTCGCCCCTCCTCCTCCACCCGTCCGTCT CCAGGCCCTGCACTGCGCTGCCTCTCCTCCTCCATCCCTCCCTCTCCGCCTGCCGG TCTCCCCTCGTCACTGCACTGCCTCTCGCCTCCATTCTCTCCCATCTC TTTCTGTCTCTTTCATTCTTCTTTCCTCGCCTCACTCCTCCTCTCCCCATCTC TCTCTCACTCTGTCTCTGCCTGCCTCCTCCGCCCTGTTTTCTCCACTCCTCCTGTCTGC CAGTTTCTCTGCCTTCTCCTCGCCTCCTCCTCGGGACCCACCCGAGCTGGGAGCAAGGGTAC AGGGAAAGGCAAAGACTGTCGAAAGGAGTGTGGAGGATCTCGGAATTCTGGGG GCTCAGTGGAGCAGGTGGGACTAGACAGGGGCTACCTGAGGGACTTACCCTTTC CAACACTGA | 8370 |
| | 2 | MDRQDMWPGDHPELGARGTGKRQRLSKGVWEDLWL GGSVEQVGTRQGLPEGLTLFQH* | 8371 | ATGGACACAGAGACAGTGGCCGGGACTGCCACCCGAGCTGGGAGCAAGGGTAC AGGGAAAGGCAAAGACTGTCGAAAGGAGTGTGGAGGATCTCGGAATTCTGGGG GCTCAGTGGAGCAGGTGGGACTAGACAGGGGCTACCTGAGGGACTTACCCTTTC | 8372 |
| | 3 | MSLGTGQRSRAGGGDMGVSEPQDSSF* | 8373 | ATGTCTCTAGGTACTGGACAGAGAGGAGCAGAGAGCTGGGGTGGGGGACATGGGTATAGT TCTGAACCTTCAAGGACAGCAGTTTCTAA | 8374 |
| | 4 | MDLF* | 8375 | ATGGATCTGTTTAA | 8376 |
| hsa-mir-155 | 1 | MDSRGQRQGFGGVFET* | 8377 | ATGGATTCCCGCGGCAGAGGCAGGGAAGGAGGGGTCGTTCGAAACCTAA | 8378 |
| | 2 | MVGDVPV* | 8379 | ATGGTTGGGGACGTACTGTATAA | 8380 |
| | 3 | MALDLPCWSGQRSV* | 8381 | ATGGCCCTTGGACCAGCTTCCTGTTGGAGTGGCCAGGAAGTGTGTAA | 8382 |
| | 4 | MSSFNRSEDGANAQSASVFIRSCCARVFCRAVAFLYSQ NPLDVCPPRFTRESRIF* | 8383 | ATGTCTTCATTTAACAGAAGTGAAGATGGAGCAAACGCTCAATCAGGCGTCTGTATTT ATTCGCTCTGTTGTGCCAGGGTGCGTTTTGCCAGGGTTGCCTTCTTTACTCAC AAAACCCCCTTGATGTCTGTCCTCCACGTTTACGAGGGAGAGCCGGATCTTTGA | 8384 |
| hsa-mir-15b | 1 | MAFFPKSRCL* | 8385 | ATGGCTTCCTTCCGAAGTCCGCTGCCTAA | 8386 |
| | 2 | MPRKGTQPSTARRREEGPPPPSPDGASSDAEPEPPSGRT ESPATAAGE* | 8387 | ATGCCCCGTAAAGCACCCAGCCTCCACTGCCGGCCAGAGAGGAAGGGCCGGCC GCCACCCCCTGACCGCGCAGCGACGCCGGAGCCTGAGCCGCCGTCCGGCC GCACGGAGGAGCCAGCAAACGGGTTCAGTTGTGA | 8388 |
| | 3 | MGASKRVQL* | 8389 | ATGGGCGAGCAAACGGGTTCAGTTGTGA | 8390 |
| | 4 | MVQVTNKNSISLLYSR* | 8391 | ATGGTACAGGTCACAAACAAAATTCAATATCTTTATTGTATTCCGCTAA | 8392 |
| hsa-mir-16-2 | 1 | MAFFPKSRCL* | 8393 | ATGGCTTCCTTCCGAAGTCCGCTGCCTAA | 8394 |
| | 2 | MPRKGTQPSTARRREEGPPPPSPDGASSDAEPEPPSGRT ESPATAAGE* | 8395 | ATGCCCCGTAAAGCACCCAGCCTCCACTGCCGGCCAGAGAGGAAGGGCCGGCC GCCACCCCCTGACCGCGCAGCGACGCCGGAGCCTGAGCCGCCGTCCGGCC GCACGGAGGAGCCAGCAAACGGGTTCAGTTGTGA | 8396 |
| | 3 | MGASKRVQL* | 8397 | ATGGGCGAGCAAACGGGTTCAGTTGTGA | 8398 |

Figure 1 (Continued)

| | | | | |
|---|---|---|---|---|
| | 4 | MVQYTNKNSISLLYSR* | 8399 | ATGGTACAGGTCACAAACAAAAATTCAATATCTTTATTGTATTCCGCTAA | 8400 |
| | 1 | MYLIAKDESTLFSYVFFNCKLLGP* | 8401 | ATGTATCTGATAGCTAAGGATTTTCAACTTTATTCTCTACGTATTTTCAACTGTAAATTATTGGGCTTTTAA | 8402 |
| hsa-mir-17 | 2 | MDGlNCC* | 8403 | ATGGATGGAATTAATTGCTGTTAA | 8404 |
| | 3 | MELIAVRRLENSKYRFGRW* | 8405 | ATGGAATTAATTGCTGTTAAGGAGGTTGGAAAAATAGCAAATATAGATTTGACGGTGGTAA | 8406 |
| | 4 | MFYLFFPYFSLFQSYTWT* | 8407 | ATGTTTTATCTTTTTTCCTTATTTTCCTATTCCAGTCATACACGTGACCTAA | 8408 |
| | 1 | METPKITRYTQTYSTPINTQSKVMLTHTYSPHNNTATCVDTSPTRARTSRDSAH* | 8409 | ATGGAGACCCCAAAATTACACGTATACAGAGACATACAGCACCCGATTAATACGCAGTCGAAAGTGATGCTGACACACAGTCACCAATAACACTGCCACGTGTGTAGACACGTCGGACACTCCAGGGATAGTGCCATTGA | 8410 |
| | 2 | MEPPTKAATT* | 8411 | ATGGAGCCACCAACGAAGGCAGCTACAACATAG | 8412 |
| | 3 | MSLRVAMTNADP* | 8413 | ATGTCACTCAGGTAGCAATGACAAACGAGATCCTAA | 8414 |
| hsa-mir-181c | 4 | MCPPNQVHTCTLTVTHSHPHTHTHTHRRYKACRNTSDSRSHHFFHFYLFILRWSLSWLPRLECRGTTSRIQAHLPQPPE* | 8415 | ATGTGTCCTCCAACCAAGTTCACACTGCACCACTCACAGTCACCACAGTCACCCCCACCACACACAAGTCACACATACAAGACGGTACAAGGCCTGCAGAAACACATCTGACAGCAGGTCTCTCTGCCTCCCAGGTTGAATCTTTTATTTTTATTTACTTATTTATTTTGAGATGGAGTCTCTCTTGCCTGCCCAGGTTGAATGCCGTGGCACGATCTCCCGGATTCAAGCAATTCTCTTCGCCTCAGCCTCTGAGTAG | 8416 |
| | 1 | METPKITRYTQTYSTPINTQSKVMLTHTYSPHNNTATCVDTSPTRARTSRDSAH* | 8417 | ATGGAGACCCCCAAAATTACACGCTATACACAGAGACATACAGCACCCGATTAATACGCAGTCGAAAGTGATGCTGACACACAGTCACCCCAATAACACTGCCACGTGTGTAGACACGTCACCCACAAGGCTCGGACATCCAGGGATAGTGCCATGA | 8418 |
| | 2 | MEPPTKAATT* | 8419 | ATGGAGCCACCAACGAAGGCAGCTACAACATAG | 8420 |
| | 3 | MSLRVAMTNADP* | 8421 | ATGTCACTCAGGTAGCAATGACAAACGAGATCCTAA | 8422 |
| hsa-mir-181d | 4 | MCPPNQVHTCTLTVTHSHPHTHTHTHRRYKACRNTSDSRSHHFFHFYLFILRWSLSWLPRLECRGTTSRIQAHLPQPPE* | 8423 | ATGTGTCCTCCAACCAAGTTCACACTGCACCACTCACAGTCACCACAGTCACCCCCACCACACACAAGTCACACATACAAGACCTGCAGAAACACATCTGACAGCAGGTCACACATACAAGACGGTACAAGGCCTGCAGAAACACATCTGACAGCAGGTCTCTCTGCCTCCCAGGTTGAATCTTTTATTTTTATTTACTTATTTATTTTGAGATGGAGTCTCTCTTGCCTGCCCAGGTTGAATGCCGTGGCACGATCTCCCGGATTCCCGAGTAGGCAATTCTCTTCGCCTCAGCCTCTGAGTAG | 8424 |
| | 1 | MPRALLEGVFDNPRWHGMRGTLAGGTRLAAGRLRSAGLGAAWSLQGVWAARPWPASGTALAPGHSAPYPRPAAGRQQGDS* | 8425 | ATGCCCCGCGCGTTACTGGAAGGTGTTTTGATAATCCGCTGGCACGGATGCGAGGGACTCTGGCAGGTGGGACCCAGAGTCCGTCGCGGGAGGCTGAGATCGGCAGGGTTGGGAGCTGCGTGGTGCCTCGCAGGGTGTTGGGGCTTGTGGCTTGCCAGCATCAGAGCACAGCTGCGTGGCGCCCGGTCACTCTGGGCACAGTGCCTCCACCCGCGGCCTCGTCGGGCGCAGCAGGGTGACAGCTAA | 8426 |
| | 2 | MRPSWGGHLGS* | 8427 | ATGCGGCCTTCCTGGGGAGGTTTGGGTAGTTAG | 8428 |
| hsa-mir-185 | 3 | MSHALPWPGLFALSCGSRPADHCFAATLGTVPSSMRQM* | 8429 | ATGTCACATGCCCTGCCTGGCCAGGCTGTTTGCACTCTGGCACAGTGCCCTTCCATGAGGCAGATGTGA | 8430 |
| | 4 | MPCPGQACLHCRVALDLLTTVLLPLWAQCPLP* | 8431 | ATGCCCTGCCCTGGCCAGGCCTGTTTGCACTGTGTGTGTGGGCTCTAGACCTACTGTTTTGCTGCCACTCTGGGCACAGTGCCCTCCATGA | 8432 |
| | 1 | MSTKNFRVSDGIDWICPDKK* | 8433 | ATGTCGACCAAGAATTCCGAGTCAGTGACGGGACTGGATTGCCCTGACAAAAAGTGA | 8434 |

Figure 1 (Continued)

| | | | | |
|---|---|---|---|---|
| hsa-mir-186 | 2 | MIFCALRRVEAANRQFPGGKKAPNLLTREVPPGAFVLD MSSAFPRHYLRKVASLFRVRDGLPFCPHPPPPRPGFSD RKPLQSGQLGVGSPPRDFSLQNFTLVHGKYCFLALVLLP LIVHLVLYFYSNFSSILPSPFPEALPSSVWEILTFSLWISP QELGFSPP* | 8435 | ATGATTTTCTGTGCCTTAAGACGGGTGAGGCGGCGAACCGCCAGTTCCTGCGGGG AAGAAGGCTCCAATCTCCTCGACATTACCTCCGCAAGGTAGCCTCTCTTTGTTCTAGAT ATGTCTTCAGCGTTTCCTTTTGCCCCCACCCCCGCTTGCCCCGCCCAGGTTTAGCG GAGATGGCCTACCTTCTCCAGTCAAGACCAAGCTTGTGTTGGATCTCCGCACGTGACTTTT CTCTGCAGAAACCTTCACTCTTGTTCACGGAAATATGCTTTCTCGCACTCGTCCTTT GCCTCTTATAGTTCACCTTGTTTTGTATTTTACTCAAACTTTCCTCCATACTATTT CCCCTTTTCCGGAAGCTCTACCCTCTTCCGTTTCGGAAATTCTGACATTTCTTTGTG GATCATTTCTCCACAAGAATTGGGCTTTTGCCCTCTAG | 8436 |
| | 3 | MAYLFAPTPLPRPGQVLAIGNLSSQASLVLDLPHVTFLC RTLLLFTENIAFSHSSFCLL* | 8437 | ATGGCCTACCTTTTGCCCACCCACCTGCCTCCGCTCGGCCAGGTTTAGGATAG GAAACCTCTCCAGTCAGCCAGCCAGCTTGGTCTTGGATCTCCCCAGTGACTTTCTCT GCAGAACTTTACTCTTGTTCACGGAAATATTGCTTTCTCGCACTCGTCCTTTTGCCT CTATAG | 8438 |
| | 4 | MPAAEKHVC* | 8439 | ATGCCTGCAGCAGAGAAGCACGTGTGTAG | 8440 |
| hsa-mir-18a | 1 | MYLIAKDFSTLFSYVFFNCKLLGF* | 8441 | ATGTATCTGAAATAGCTAAGGATTTTCAACTTTATTCTTACGTATTTTCAACTGTA AATTATTGGGCTTTTAA | 8442 |
| | 2 | MDGNCC* | 8443 | ATGGATGGAATTAATTGCTGTGTAG | 8444 |
| | 3 | MELJAVRRLENSKYRFGRW* | 8445 | ATGGAATTAATTGCTGTGTTAGGAGGTTGGAAAATAGCAAATATAGATTGGACGGTG GTAG | 8446 |
| | 4 | MFYLFPPYFSLLFQSYTWT* | 8447 | ATGTTTTATCTTTTTTTCCTATTTTCCTATTCCAGTCATACACGTGGACTTAA | 8448 |
| hsa-mir-18b | 1 | MYEREGSGFILHPFPSLPFACLPGLSSSDPACSLVSDL* | 8449 | ATGGTGGAAAGGAGGGGTCCGGCTTCATTTTGCACCCTTCCTCCCTTCCCTTGCCC CCGCTTGCCTGCCTGCCAGGGCTTCCTGCGACCCAGCGTGCTCACTGGTCTCTGATT TGTAA | 8450 |
| | 2 | MLNSILIVRLKLRHHFILQSAVGLWP* | 8451 | ATGCTTAATTCCATTTGATTGTCGTCTTAAACTAAGACATCATTTATTCTACAGA GCGCTTCGGCGTTGGCTTAA | 8452 |
| | 3 | MRGESKHAPYLPHCACIRWLLPLTHPAKKP* | 8453 | ATGAGAGGAGAAAGCAAAGATAATTGCACCGTATCTTCCGCACATTTGCGCGTGTATT CGGTTGGCTGCTACCGTTAACGATAACCTGCCAAGAAACCCTGA | 8454 |
| | 4 | MCRE* | 8455 | ATGTGCAGAGAGTAA | 8456 |
| hsa-mir-191 | 1 | MGGF* | 8457 | ATGGGGGGGTTCTGA | 8458 |
| | 2 | MWPQGE* | 8459 | ATGTGGCCCCAGGGCGAGTGA | 8460 |
| | 3 | MGCP* | 8461 | ATGGGGTGCCCTGA | 8462 |
| | 4 | MGVDVGEPRLVAISGTLGRIGEGGWTQDLWVGLQW* | 8463 | ATGGGTGTAGACGTGGAGGCGGAGAGCGAGGCTGGTGCCATCTCTGGAACCCTGGGGAG GATTGGCGAGGGAGGGTGGACCCAGGACCTCTGGGTAGGGCTGCAATGGTAG | 8464 |
| hsa-mir-193a | 1 | MGAEGWVPAGEMRVSDQLAYKVPVLGPRDQRLLPGPR PRPASSRAGVRSGQAASQVHAGEGVVRCARPGCVR* | 8465 | ATGGGAGCTGAGGCTGGGGTCCAGTTCTGGGAGAGCCAGTCGTCTCCCGGTCCTGCCC CAGGGCCGTCTCCAGGCCTAGAGGGGACCCAGGACCAGCGTCTTCTCCCCAGGTCTCAGGTCA CCGTGGAAGGAAGAGTGGTGAGGTGCTCTGCCCCCGGCTGCTGGTGCGGTGA | 8466 |
| | 2 | MGQALPLTEACPAVLSRAATLSLGVGRTGPDF* | 8467 | ATGGGTCAAGCCCTGCCACTTACCGAGGCCTGCCCTGCTGTGCTTCCAGGGCA ACCTTGAGCTTTGGGATGGGGAGAACGGGCCGGTCTTTGTTCCCTAG | 8468 |
| | 3 | MDLCGCVPNGRSFVP* | 8469 | ATGGATCTTTGTGGATGTGTCCAATGGCCGGTCTTTGTTCCCTGACCGATGCAACATAA | 8470 |
| | 4 | MCSQWPVFCSLLIDAT* | 8471 | ATGTGTTCCCAATTGCCGGTCTTTGTTCCCTGACCGATGCAACATAA | 8472 |
| | 1 | MDVSSEDISGAPQRSAWWGLEAKRNQKRHSPHPQJKM PFSFFF* | 8473 | ATGGATGTGTCCTCAGAGGACATAAGCGGCGCATTCAAGCGGTCAGGGAAACCAGAAAACGCCACTCCCCACCCCCAAATGC CTTTTCTTTTTTTCTAA | 8474 |
| | 2 | MCPQRT* | 8475 | ATGTGTCCTCAGAGGACATAA | 8476 |

Figure 1 (Continued)

| | | | | | |
|---|---|---|---|---|---|
| hsa-mir-193b | 3 | MPAGLGRTWSGGRGRPAPRAALRSGSRSESVSRAGFPG WGRGRGRSTASSHSKPRH* | 8477 | ATGCCAGCGGGGCTCGGGCGCACGTGGAGGCGGCGGCGGCGGCCTGCTCGCG CCCGGCATTGAGATCGGGGTCACGCAGCGAGTCAGTTTCCGAGCGGGCTTTCCGG GGTGGGGCGGGGACGCCGGAACGCTCCACCGCTCAATTTCCAAGCCCAGGCAC TAG | 8478 |
| | 4 | MGGERRKSFSAESAQPTGLHPASTVRCRHKAAPPPPTP QRPMAGPGRGLGRPGVGRAGEAAAAAQAAAGRLLPGQ AERARAWKPSAPARVGVGVGVGVGAGAGVGGRLP RNARQI* | 8479 | ATGGGCGGGGAGCGTCCAAGGAGCGAAATCCTTTCTGCAGAGACGGCGGGGCT GCACCCGGCCTCCACGGTCCGCTGCCACAAAGCGCGCGCCGCCCGCCCCAAC CCCCAGCGCCCTATGGCCGGCGGGGCTGGGCGGGGCTGTTGGCC GCGGTGGGAGGGCGGCGAGAGCCTGAAGCTAGAGGCGGGGCTCCTCCCCGGC CAGGGCAGAGAGGCGCGTGCGGGTGCGGGTGCGGGTGGCGGCGGGGCTGG GGTGGGGTGCGGGTGCGGGTGCGGGTGCGGGGTGCAGGAGAGGGCGCTTCC TAGAAACGCTCGCCAAATATAG | 8480 |
| hsa-mir-195 | 1 | MRIRLGALPLASGWSH* | 8481 | ATGAGAATTAGACTAGGGCTCTCCCTTTGCATCAGGATGGAGTATTATTGA | 8482 |
| | 2 | MEYYLISCGVSVSYYGVLI* | 8483 | ATGGAGTATTATTTGATCAGTTGTGGGGTGTCAGTTATGTGGTGTTGATTTGA | 8484 |
| | 3 | MVSFRYGADLEVTLVLGVLTPTIWRLCSPVSSWTISRTK VLMLIWGCSLFWGAI* | 8485 | ATGGTAAGTTTCAGGTATGGGGCTGACTTGGAAGTTACATTAGTTCTGGGGGTTCTG ACACCCACAATTTGGAGATTGTGTCCACCTGTCATCTTGGACTATCAGCAGAACC AAAGTACTCATGCTGATTTGGGGTGCAGTCTATTTGGCGGTGCCATCTAA | 8486 |
| | 4 | MGLTWKLH* | 8487 | ATGGGGCTGACTTGAAGTTACATTAG | 8488 |
| hsa-mir-196a-2 | 1 | MGVGVWLVCVSSPHSPTHSHTAFCSPCKVKIESIRL* | 8489 | ATGGGGGTGGGAGTTGTGGCTGTGTGTCCAAGCCCTCACTCACCCACGCACTCA CACACAGCATTCTGTTCTCCATGCAAGTTAAGATCGAATCATCCGCTGTAG | 8490 |
| | 2 | MSLPPSRSKNLLEVSYLYCFLLFSHPS* | 8491 | ATGTCTTTACCTCCCAGTCGCTCTAAGAATCTGCTTGAAGTCTCGTATTTGTACTGCT TTCTGCTTTTCTCCCACCCCTCTAG | 8492 |
| | 3 | MPPPPNIVLSLSGSCVF* | 8493 | ATGCCCCCCCCCAATATGTCTGTCCGTGTCGGAGTTGTGTTATTTAA | 8494 |
| | 4 | MLYLLHVASLMEKKFPNKFFES* | 8495 | ATGTTGTATCTTTTGCATGAGTCATCTCTAATGGAGAAAAAAACCTAATAAATTT CCAGAATCATAA | 8496 |
| hsa-mir-19b-1 | 1 | MYLIAKDFSTLFSYVFFNCKLLGF* | 8497 | ATGTATCTGATAGCTAAGGATTTTCAACTTTATTCTTACGTATTTTCAACTGTA AATTATTGGGCTTTAA | 8498 |
| | 2 | MDGINCC* | 8499 | ATGGATGGAATTAATTGCTGTTAA | 8500 |
| | 3 | MELJAVRRLENSKYRPGRW* | 8501 | ATGGAATTAATTGCTGTTAGGAGGTTGGAAAATAGCAAATATAGAATTGGACGGTG GTAA | 8502 |
| | 4 | MFYLFFPYFSLFQSYTWT* | 8503 | ATGTTTTATCTTTTTCCTATTTGTGGAATTAATCCAGTCATACACGTGGACCTAA | 8504 |
| hsa-mir-19b-2 | 1 | MYLIAKDFSTLFSYVFFNCKLLGF* | 8505 | ATGTATCTGATAGCTAAGGATTTTCAACTTTATTCTCTACGTATTTTCAACTGTA AATTATTGGGCTTTAA | 8506 |
| | 2 | MDGINCC* | 8507 | ATGGATGGAATTAATTGCTGTAA | 8508 |
| | 3 | MELJAVRRLENSKYRFGRW* | 8509 | ATGGAATTAATTGCTGTTAGGAGGTTGGAAAATAGCAAATATAGATTGGACGGTG GTAA | 8510 |
| | 4 | MFYLFFPYFSLFQSYTWT* | 8511 | ATGTTTTATCTTTTTCCTATTTGTCACCCTCATTTGCACCCCTTCCTCCTTGCCC CCGGTTGCCTTCCTCCAGCGGCTTCCCTCCCGACCCAGCGTGCTCACTGGTCTCTGATT TGTAA | 8512 |
| | 1 | MVEREGSGFILHPFPPSLPPACLPGLSSSDPACSLVSDL* | 8513 | ATGGTGGAAAGGGAGGGGGTCCGGCTTCCATTTCCAGTCACCCCTCCCTTGCCC CCGGTTGCCTTCCTCCAGCGGCTTCCCTCCCGACCCAGCGTGCTCACTGGTCTCTGATT TGTAA | 8514 |
| hsa-mir-19b-2 | 2 | MLNSILIVRLKLRHHFHLQSAVGLWP* | 8515 | ATGCTTAATTCCATTTGATTGTGCGTCTTAAACTAAGACATCATTTATTCTACAGA GCGCTGTCGGGCTTTGGCCTTGA | 8516 |
| | 3 | MRGESKHAPYLFHCACIRWLLPLTIPAKKP* | 8517 | ATGAGAGGAGAAAGCAAGATAATTGCACCGTATCTTCCGCACATTGCGCCGTGATT CGGTTGGCTGCTACCGTTAACGATACGTGCCAAGAAACCCTGA | 8518 |
| | 4 | MCRF* | 8519 | ATGTGCAGAGAGTAA | 8520 |

Figure 1 (Continued)

| | | | | |
|---|---|---|---|---|
| hsa-mir-200c | 1 | MGARDLQLPRRDPGIPEAA* | 8521 | ATGGGAGCAGGGATCGCAGTTTTCCGCAGGGATCCTGGCCTGAAGCTGCCTGA | 8522 |
| | 2 | MMEAPVPVSATSIASGPQPLAGCSPLPTSHAPRKPLVLS* | 8523 | ATGATGGAGGCCGTGCCAGCCCCATCGATCCATCGCCTCAGGTCCAGGCCCTTAGCTGGCTGCCAGCCCCCACGCACCCCGAAGCCCCCTGTCTTGAGCTGA | 8524 |
| | 3 | MGFSPSSHPVRFVTWWIQMPQSTLSLGLARPLSRDLTWPVARVPCSNW* | 8525 | ATGGGGCCAGCCTCTCCAGCCCTCTCCACCAGTGTGCGATTTGTCACCTGGATCCAGATGCCACAGTCGACTCAGGTGGGGTTGCTGCCCCCTCAAGAGACCTCACCTGGCCTGTGGCCAGGGTCCCGTAGCAACTGGTGA | 8526 |
| | 4 | MAPGWVLSAVTPREP* | 8527 | ATGGCTCCCGGGTGGGTTCTCTCGGCAGTAACCTTCAGGGAGCCCTGA | 8528 |
| hsa-mir-20a | 1 | MYLIAKDFSTLFSYVFFNCKLLGF* | 8529 | ATGTATCTGATAGCTAAGGATTTTTCAACTTTATTCTCTTATGTATTTTTCAACTGTAAATTATTGGGCTTTTAA | 8530 |
| | 2 | MDGIMCC* | 8531 | ATGGATGAATTAATTGCTGTTAG | 8532 |
| | 3 | MELIAVRRLENSKYRFGRW* | 8533 | ATGGAATTAATTGCTGTTAGGAGGTTGGAAATAGCAAATATAGATTTGGACGGTGGTAG | 8534 |
| | 4 | MFYLFFPYFSLPQSYTWT* | 8535 | ATGTTTTATCTTTTTTTCCTTATTTCCTATTCGAGTCAATACACGTGGACCTAA | 8536 |
| hsa-mir-20b | 1 | MVEREGSGFILHPFPPSLPFACLPGLSSSDPACSLVSDL* | 8537 | ATGGTGGAAAGGGAGGGTCGGCTTCCTCCCCAGGGCTTCCTCCTCGACCCAGCGTGCTCACTGGTCTCGATTTGTAA | 8538 |
| | 2 | MLNSILIVRLKLRHHFILQSAVGLWP* | 8539 | ATGCTTAATTCCATTTGATTGTCGTCTTAAACTAAGACATCATTTTATTCTACAGAGCGCTGTCGGCTTTGGCCTGA | 8540 |
| | 3 | MRGESKHAPYLPHCACJRWLLPLTHPAKKP* | 8541 | ATGAGAGGAGAAAGCAAGATAATTGCACCGTATCTTCCGCACATTTGCCGTGTATTCGGTGCTGCTACCGTTAACGATACCTGCCAAGAAACCCTGA | 8542 |
| | 4 | MCRE* | 8543 | ATGTGCAGAGAGTAA | 8544 |
| hsa-mir-21 | 1 | MCLFLWATVPCFQCCPRHRSISAFAIASGVPGGSTAEAASPQKRMGHTTGKTLIRFLLPSGKFRAEITPTALTHFRQISEVGLPVFLDRS* | 8545 | ATGTGTCTTTTTCTTGGCTACGTGCCTTGCTTCCAGTGCTGTCCCGGCATAGGTCATTCTGCAGAAGCCATTTCAGGAGTACCTGGAGGCTCAACGGCAGAAGCTTCACCACAAAAGCGAAATGGTCACACACCACACCACAGGTCACGTAAGACTTTAATCCGGTTTCTCTCCCTCTGGGAAGTTTCGGCCTGAAATTACATTCACAGCTCTACTCACTTTTAGGCAAATAAGTGAAGTTGGCCAGGTGTTCTTGACAGAGTTAA | 8546 |
| | 2 | MGTPQYRL* | 8547 | ATGGGCACCACCAGGTAAGACTTTAA | 8548 |
| | 3 | MLYWEICLCLRLESVTSVHLLLKTRVEPMESNGSVT* | 8549 | ATGCTCTACTGGGAAATTGTCTTGTCTTAGACTAGAAAGTGTAACTTCTGTACATCTTCTCCTAAAAACAAGGTAGAGCCAATGGAAAGTAATGGTCTGTACATAG | 8550 |
| | 4 | MVLLFHRMSCCLDLK* | 8551 | ATGGTTCTGTTACATAGAATGAGTTGTTGCCTTGATCTTAAATGA | 8552 |
| | 1 | MCGIRGGGJD* | 8553 | ATGGGAATTAGGGATTAGGGAGGGGGCCAGGATTAG | 8554 |
| hsa-mir-219-1 | 2 | MNQPMKGAGESRREGAGKRRRRKGRGVCANRLWRPHKDWPRTEGEDREVGGNWGGGRGHPLLPCPRDRPPPGSRSPSPGASARAGTRCPSGSLTAPHPLALYPSHSLHRSMGIALPLPLLFPPHPLRLL* | 8555 | ATGAACCAGCCATGAAAGGCGATGGAGAAGGGACTGGAGAAGGAGAAAGGAGAGGAGTGGAAGAGTGGCAGAAGGCGCTGAAGGAGGAACTGGCGCCCACATAAGGACTGGCCACGGACTGAAGGAGCAGGAGGAGCAGGGAACTGGGGTGGGGGCGAGGGGCACCACTGTCCCAGGGACAGGCCACAGCGGCAGCCAAGTGCGGAGCCCACCCCTGTCCAGGGAGCCGGGGACAAGCCCATCAATGCCATCCTCTAACCTGCCCCCACCCTCCTCCCCATCCCCTTGTTACTTAG | 8556 |
| | 3 | MPIRVSNCPPHPRPVSLSFPTLNGDRSAPSSSLSSPSPSFTLESSKRLLPTSHSRHSAPVPYHTRTPPSQWELHLVYVPVSAWCLHSPFPPVRLPPFPAPCRGS* | 8557 | ATGCCCATCAGGGTCTCTAACTGCCCACCCCTCACCGCCCTCGTATCCTCTCATTCCTACACTCAATGGGGATCCTGGTCTGCTCCAGCCCAGTCTCTCCTGCCACTCCATGAGTCCTCACACGCGCACACATTCTGCCCTGTACCCACCCACATGGGAGTCCATCTTGTGTATGTCCCTGTTTCCCGGTGGTGTCCCAGGTCCATTCCAGGATCGGTCAATGGGGATGCTAACTGCCCCTCCTCCCCATCCCCTTGTTACTTAG | 8558 |

Figure 1 (Continued)

| | | | | | |
|---|---|---|---|---|---|
| | 4 | MGAPSCVCPCFRVVSPFPLSSRAPPSLPRPGPRLLIVQTQ FSSLWLRPRVESGRPEPPPPNLERESCSEGLGRAKAEGG GSPQGGKGNPGHHGT* | 8559 | ATGGGAGCTCCATTCTGTGTATGTCCCTGTTTCGCGTGGTGTCTCATTCCCTTT CCTCCCGTGCGCCTCCCTTCCCGCCTCGAGTCTATGCTCCGCCGCGAGCTCCTGATTGTCAAA CGCAATTCTGAGTCTATGCTCCGCCGCGAGAGTTGAGTCTGGACCTCCGAGCGC CGCCCCAAACCTCGAGCGCGGAGAGCGGTCGGAGGTCGGAGAGCCAAAGCA GAGGGTGGAGGGAGTCCCAGGGTGGTAAGGGAATCCGGGACATCGGGACCTA G | 8560 |
| hsa-mir-22 | 1 | MEGESGVYRAATPSPSGRRRGGGGRGASGRGAWTGRVS VSGATRKESGTGVVAEGLAEWRGAGGEPRGRRAGGGS PGGPRSEDTGAGHLAWGGKSGPPERAARRCFASAGVHW VRASSAPWQGRGRWAGRPLLSFSPGDVM* | 8561 | ATGGAGGGTGAAAGTGGTCCGGCGGGCGGCCACCCAGCCTTCCGGGAGGAGAAG GGGCGGCGGGGCAGGGGCGCTACGAGGAAAGAGTCTGGACGGGAGTCGTGGCGGAAGGGCTGG GTGTCAGGAGCTACGAGGAAAGAGTCTGGACGGGAGTCGTGGCGGAAGGGCTGG GTGAGTGGCGGCGGCGCGGGGGGAGAGCGGAGAGCGGGAGCGGGAGGGCGGGGCCGGGTC ACCCGGCGGCCGCCCCCCGGCTCTGAGGATACAGGGGCCCATCTAGCCTGGGAGGGT CTGAGCACCCCGAGCGGGCGGCGAGGAGGTCTTTGCCTGCCGCGTTCACTGG GTCAGGGCCAGTTCAGCGCCTGCAGGAGGAAGGGGTGCTGGGCGGCGCCGGCCCCT CCTCTCGTTCTTCCAGGGATGTTATGTAA | 8562 |
| | 2 | MLCKGGHERSRGRRCRGLMQPKG* | 8563 | ATGTTATGTAAGGGGGAGGGGAGGAGAGAGTAGGGGCGCGCGTGCCGGGCCTTA TGCAACCCAAAGGTTAG | 8564 |
| | 3 | MASGEAVTPTSLRPWFQPPTPLACHPGCQHGLGAVRVP EG* | 8565 | ATGGCCTCCGGCGAGGCTGTCACCCCACCCCGAGCTGCCCCAGCCTGGTTCCAGCCTCCA ACTCCTTTGCCTGTCATCCTGGCTTGCAGATTGGGCTAGGAGCTGTCAGAGTGCCA GAGGGTTGA | 8566 |
| | 4 | MEQLVRGSYPWAHPALQPRAPAWHRLSAAAESSGHNR AISDRGRSDGVGLVTQGKEDTQSSCLPRGFRNLNRTPY PPFLTL* | 8567 | ATGGAGCAGCTGGTCAGAGGGTCAGTGCCCTGGCCATCACCCCGCCCTGCAGCCAAG GGCACCTGCTTGGCACAGAGGAAGTTCTGGACGCAGCTGCTGAGTCCTCTGGTTGAACAGAGC TATCTCAGACAGGAGAAGTTCGGACGGAGTTGAGTGACTGGTCAGGGAAGGAAG ATACACAAAGTTCAGCCTCCCAAGAGGGGTTCGGAATTTGAACCGACCGTATC CCCCAATCTTCTTACCCCTCTGA | 8568 |
| | 1 | MWKIS* | 8569 | ATGTGGAAAATTTCATGA | 8570 |
| | 2 | MSLDICKHL* | 8571 | ATGAGTTTGGATATATGCAAACACCTGTGA | 8572 |
| hsa-mir-221 | 3 | MQTPVIPSF* | 8573 | ATGCAAACACCTGTATTGTGATACCATCACCATAA | 8574 |
| | 4 | MDYFNSQSFIVSLWFCVCVCVYKMHLT* | 8575 | ATGGATGTATTCAACATCTCAAAGTTTCATTGTATCCCTTTGGTTTGTGTCTGTG TTTGTTGTATAATGTTAAGAATCACTTAACATGA | 8576 |
| | 1 | MWKIS* | 8577 | ATGTGGAAAATTTCATGA | 8578 |
| | 2 | MSLDICKHL* | 8579 | ATGAGTTTGGATATATGCAAACACCTGTGA | 8580 |
| hsa-mir-222 | 3 | MQTPVIPSP* | 8581 | ATGCAAACACCTGTGATACCATCACCATAA | 8582 |
| | 4 | MDYFNISQSFIVSLWFCVCVCVYKNHLT* | 8583 | ATGGATGTATTCAACATCTCAAAGTTTCATTGTATCCCTTTGGTTTGTGTCTGTG TTTGTTGTATAATGTTAAGAATCACTTAACATGA | 8584 |
| | 1 | MANGWTGSRPGRRNPEL* | 8585 | ATGGCCAATGGCTGGACTGGCTCCCGCCCTGGGCGGAGGAATCCGAGCTGTGA | 8586 |
| hsa-mir-25 | 2 | MAGLAPALGGGIPSCEAAGIRARVLLCLLRAEAMAGAG VGCGGGVRWRRSR* | 8587 | ATGGCTGGACTGGCTCCCGCCCTGGGCGGAGGAATCCGAGCTGTGAAGCGGCTGG AATCCGGGCCCATGCGTCTTGTTTACTAAGAGCGGAAGCGATGGCGGGAGCGG GGGTGAGGTGCGGTGGCGGGTGCGGTGCGGAGGTCCCGGTGA | 8588 |
| | 3 | MCPFVY* | 8589 | ATGTGCTTCTTTGTTTACTAA | 8590 |
| | 4 | MLDGPVHCHGLFILRWLETDL* | 8591 | ATGTTGGATGGCCCTGCACTGCCACGGGCTCTTTATTCTTCGCTGGTTAGAAACA GACTTGTGTGA | 8592 |

Figure 1 (Continued)

| | | | | |
|---|---|---|---|---|
| hsa-mir-26b | 1 | MDSSAVITQJSKEEARGPLRGKGTGAAGRGPKPGRRGR REGAGIFPRGAAAAPGGRLSCARSSQPEREQGESLNSE EAQRRKGAGPGAFGALLFARGEETEAGHERELFGGFLAGH AWCMGAPPPLAPMGLGDGGAEEGAYGPPAETTPHPPPP PPRAAVR* | 8593 | ATGGACAGCTGGCCGTCATTACTCAGATCAGCAAGGAGGAGGCTCGGGCCGCT GTGGGGCAAAGGTACCGGGGATCTTCCCAGGGAGCCGCGAAGCCGGGGCGCCGTGG AGGAGAGAAGGRGCCGGATCTCCCAGGGAGCGAGTCCGCGGGGAGCCCGGCGG CCGCCTTAGCTGTGCCCGAAGCTCCAGCCGACCCCAGCCAGAGGGAGCAGGGAGAGAGTTGA ACTCAAGAGGAGGTCAGAGACGCGGGGCTGGGCGCTGGCGCCTTTGGGGCGCTCCTG TTCGCTCCAGGGCAGGGAAACTGAGGCAGGAATAGAGAGGGAACTTCTCGGGGTTT CCTGGAGGCATTGCTGGTTGCATGGCGGTCATGGGCGCCCCCCACCATTGGGCCAATGGGCT GGGAGATGGGAGCTGAGGGGTTGCCGCTATGGTCAGCCGCTGACCTCGCCC ACCCCCCACCCCACCCCCGtrCCTGCGGTCCGGTAG | 8594 |
| | 2 | MGELRRAPMGHPLRLRPTPHPHPPGLRSGRVLGGGAEV TAGWGGLEGSPANTQLRSPQTSRHAWRRRPPRRHRED GRHFQESLGARGESRAPSGHAPPRKASPPRGCVPQRG WAGVGGSVFSFSPCGPQDLDAAPRSAHPRLLGLAAPELR ARWKG* | 8595 | ATGGGGGAGCTGAGGAGGGCGCCTATGGCCACCGCTGAGACTCGCCCCACCCC CCACCCCCACCCCCCGGGCTGGGGGCTGTAGGCTTGGGAGGGGCGCGGAGG TGACAGCAGGCTGGGAGGCTTGGAGGGATCTCCCCGCAACACAACCAGCTACGTTCC CACAAACTTCGGCTCACGGTGAAGGGCGACCCCCTCGGAGGCACAGAGGA CCGGCCGACCTTCAAGAATCTGTCTGCGCCGCGGAGACTTGCCCGCGTCCTAGTG GCACGCAGCACCCCGCAAAGCTCCCCCGACGAGGCTGCGTCCCCAGCGT GCTGGGCCGGGGGGGGCCCAGTCTGCCCACCCCAGTCTGGGTGGACTCCAGGAT CTGAACCGTGCCCCCAGTCTGCCCAGTCTCTGGGTGCTGGCTGCCCGGAACTG AGGGCAAGGTGGAAAGGCTAG | 8596 |
| | 3 | MATGHWPQAAGLHPCLWAQPQ* | 8597 | ATGGCCACTGGACACTGGCCCAGGCTGCCGGGACTGCACCCTGCCTCTGGGCCA GCCGCAGTGA | 8598 |
| | 4 | MEGGQGWTALGPRPWLS* | 8599 | ATGGAGGGACGGGACAGTGGACTGCCTCCAGGCGTGAGTGTCCTGA | 8600 |
| hsa-mir-301a | 1 | MEAEVDKLEMVSAK* | 8601 | ATGGAGGCGGAAGTCGATAAGCTGGAACTGATGTCAGTGAAGTGA | 8602 |
| | 2 | MASEVGHNLESPETPGGGGWTRVEFPPPAPKGAAITVW CLNRLG* | 8603 | ATGGCCTCGGAGGTGGGCACAATTTGGAAGTCGCCGAAACTTGGAGTCGCCGAGG CTGGACCAGAGTCGAGTTGCCTCCTGCACCAAAGGGAGCCGCCACCGTCTGGTG TCTAAACCGCTCGGGTAA | 8604 |
| | 3 | MAGDAEGAGPLEFLVPCHLYTPYETAPGADRILCLYQ KRCEWNGP* | 8605 | ATGGCCGGAGATGCTGAGGTGCGAGGCCTTTGGAATTCCTTGTTCCTGCCTCAC CTTTACACCCCTACGAAACCCGCCGGGTGCAGACCGCATTCTGTGTTGTACCAA AAAGATGTGAATGGAACGGTCCTAA | 8606 |
| | 4 | MLRVRGLWNSLFLALTFTPLTKLRRVQTAFCVCTKKDV NGTVPKRPKKGEYVHTPRKGNGGWGGE* | 8607 | TTACGAAACTGGGCTGCCGGGTTGCAGACGGCATTCTGTTGTTGTACCAAAAAGATGTGA ATGGAACGGTCCTAAGCTGCCAAGAAGGAGGAGGTGGTTCACACTCCAAGAAAG GGGAACGGAGGGTGGGGTGGGGAATAA | 8608 |
| hsa-mir-30a | 1 | MGFQSDVCSCLLPRTSRGYFRSNYLVY* | 8609 | ATGGGCTTTCAGTCGGATGTTTGCAGTGCCTACTGCCTCGGACTTCAAGGGCTAC TTTAGGAGCAATTATCTGTTTACTAA | 8610 |
| | 2 | MFAAAYCLGLQGATLGAILFTKIEYLAISLHPYKAELK WYKLNEHFKTMSVHF* | 8611 | ATGTTTGCAGCTGCCTACTGCCTCGGACTTCAAGGGGCTACTTTAGGAGCAATTATC TTGTTTACTAAAACTGGAGCAACCTTGCTATCTTTGATACATTTTTACAAAGCTGAAT TAAAATGGTATAAAATTAAATCACTTTAAAACCATGCTGTACATTTTTAG | 8612 |
| | 3 | MBIRICNIKKKVPVREMRKCVTVPLFFLKA* | 8613 | ATGCATAGAATTTGCAATATCAAATAGAAAGATATTCGTAAGAGAAATGAGGAAATG TGTTACAGTATTTTATTTTTTTTAAAAGCGTAG | 8614 |
| | 4 | MCYSIFFFKSVVGQYFPEKSMK* | 8615 | ATGTGTTACAGTATTTTATTTTTTAAAGGTAGTAGGGCAATATTTCCAGAAAA AATCTATGAAGTGA | 8616 |
| hsa-mir-30b | 1 | MCVQHFSPSS* | 8617 | ATGTGTGTGCAACATTTTCCGTCTCTTAG | 8618 |
| | 2 | MGMHVFLY* | 8619 | ATGGHATGCATGTCTTTTATATTAA | 8620 |
| | 3 | MSFYINIFFKYFQIVAFRFIASSLKYSCPESSCTVSJFCVSP QJ* | 8621 | ATGTCTTTTTATATTAATATTTTCCTAAGTATTTCAGATTTGTTTGTATCTATTTTTTGT TGCTTCCTCCTTAAAATATAGCTGCCCTGAAAGCAGCTGTATTGTATCTATTTTTGT GTTTCCCCACAGATCTGA | 8622 |

Figure 1 (Continued)

| | | | | | |
|---|---|---|---|---|---|
| hsa-mir-30d | 4 | MTLSVD* | 8623 | ATGACACTCAGTGTGGACTAA | 8624 |
| | 1 | MCVQHFSPSS* | 8625 | ATGTGTGTGCAACATTTTCTCCGTCCTCTTAG | 8626 |
| | 2 | MGMHVFLY* | 8627 | ATGGGTATGCATGTCTTTTTATATTAA | 8628 |
| | 3 | MSFYINIFPKYFQIVAFRFIASSLKYSCPESSCIVSIFCVSPQI* | 8629 | ATGTCTTTTATATTAATATTTTCCAAGTATTTTCAGATTGTTGCTTTCAGATTTAT TGCTTCCTCCTTAAAATATAGCTGCCCTGAAAGGCAGCTGTATTGTATCTATTTTTGT GTTTCCCACAGATCTGA | 8630 |
| | 4 | MTLSVD* | 8631 | ATGACACTCAGTGTGGACTAA | 8632 |
| | 1 | MLRRSGVLASGRWRGGAKIRVPGFVGHHAAM* | 8633 | ATGCTGCGGAGCTGCGAGGGTTGGCTCCGGCGGTGGCTGGAGGCGCCAAGAT CAGGGTCCCGGGTTTTGTCGGCCACCACGCGCAATGTGA | 8634 |
| | 2 | MGRGARRGAESETWT* | 8635 | ATGGGGCGAGGGCCGCAGGCGCGGCGAGAGTGAGACCTGACTTAA | 8636 |
| hsa-mir-320 | 3 | MVTLEWSLFPGSDLAHFRGPLPCAPGGVLG* | 8637 | ATGGTGACCTTGGAGTGGTCATTACCTCCGGGCAGGACCTCGCCCACTTTCGGGGA CCCCTTCCCTGTGCTCCTGTGAGTCCTGGGGTGA | 8638 |
| | 4 | MLSPIPQTV* | 8639 | ATGTTATCCCCATCCCAGACCGTATAA | 8640 |
| | 1 | MGDKGTR* | 8641 | ATGGKCGACAAGGGACCGGTGA | 8642 |
| | 2 | MWAAARPGPDTQLADTQHWPAAAETHGGRLTHNTRTG TLTRGTGMLAHTLATASTRSSHAVARRHTRLGQHILAD SLVGMHSSQSNTHQF* | 8643 | ATGTGGGCCGCAGCTCCTGCCCGGACACACAGTCTGCTGACACCAGCATTGGCC GGCAGCCGACCGAGAGACCCACGGGGCAGGTTGACACACAATACACGGGCACAC TAACCCGTGCACAGGCATGCTGGCGCACACATGCACAGTCGCACACGCTCAT CACACGCAGTGGCACGCCGTCACATCCAACACCACCAACCAATTCTAG TTGTTGGCATGCACAGTCACAATCCAACACCACCAACCAATTCTAG | 8644 |
| hsa-mir-326 | 3 | MSRQHSGAQGHTNTDPHRHMQIDALKDWHPTGTSC* | 8645 | ATGTCTCACCAACAGAGTGGAGCCAAGGCACACTAACTGACCCCACAGACA CAATCAGACTGATGCTCCTCAAAGACTGGACACCCCACAGGCAGCTGCTAG | 8646 |
| | 4 | MPSKTGTPQARAASPRPADTHASGFTWPEVETHTSHRV ERPPFPAWGKQIAFHPNRSHPSTLFPFPLTS* | 8647 | ATGCCCTCAAAGACTGGCACCCCACAGGCCAAGGCACGAGCTGTAGCCACAGGG CACACACGTTCAGGCCCCGCACCCGCCGACACATCACAATCGCCGTGA TAGAGCGCCCCCCATTCCATGCGCCAGCTGGGGAAAACAGATGCCATTTCATCCAAATA GATCCCATCCATCTACTCTGTCCCTTCCCTGACCTCTGA | 8648 |
| | 1 | MSSFGAG* | 8649 | ATGAGTAGCTTTGGAGCTGGGTGA | 8650 |
| | 2 | MVSPLF* | 8651 | ATGTGTTTCCCCTTTCTGA | 8652 |
| | 3 | MGKGSVEACLLG* | 8653 | ATGGGGAAGGGTCGGTGAAGCTTGCTTGTTGGGGTGA | 8654 |
| hsa-mir-330 | 4 | MGLVSVPDLWGCPGRGWLRENVPEGPPCAHDDPRRAG TRLQPGHTLGAAFLPAQAGVGVSFCWNLLGAPIPPGGN RKAVKAAQACNLSTLGRSFEAKSLRPAWATHKTSTARS RAMWPEWDWCI* | 8655 | ATGGGGCTGGTGTCAGTGCCTGACCTCTGGGGGTGTCCTGGCAGAGGATGGCTCCG TGAAAATGTTCTGAGGGCCGCCTTGTCCATGATGACCCAGACGGCAGCTGGCAC CCACCTACAGCCTGGACACACGCTCGGAGCTGCCTTCTTGCCGACCCAAGCTGGAGT GGGTGTATCCTTTGCTGAAGCAGTCAGGCCTGAATCTCAGGCACTTTGGAGGATCGTTTG AAAGGCGGTCAAGCAGTCAGGCCTGGCAACACACACAAAAACAAGCACAGCAGCGTTCA AGGGCTATGTGGCCAGAGTGGGATTGGTGCATTGA | 8656 |
| | 1 | MPGWILQLRGFSGKQRPLLSRDPGS* | 8657 | ATGCCCGGATGGATCCTGCAGCTCCGCAGCTGTTTCTCGGGAAGCAGGGCCCTGCTC TCAAGAGACCCTGGCTCTGA | 8658 |
| hsa-mir-338 | 2 | MDPAAPWLFWEAAAPALKRPWLLMVAPRLPAGARDSG QFPRKGQAGSPSRGRVRKLGGAEATLGP* | 8659 | ATGGATCCTGCAGCTCCGTGGCTCTTCTGGGAAGCGGCCGCCCCTGCTCTTCAAGAGA CCCTGGCTCTGATTGTGGCCCAAGGTTGCCAGCTGGAGCTGGGACTCAGGACA GTTTCCCAGAAAAGGCCAAGCGGGCAGCCCTCCAGGGGTCGGTGAGGAAGCTGG GGGGTGCGGAGGCCACACTGGGTCCTGA | 8660 |
| | 3 | MAFP* | 8661 | ATGGCCTTCCCCTGA | 8662 |
| | 4 | MSGRGTGGEVSCPGGRRGAGGRRVRPGSRGRWRRSSRG* | 8663 | ATGAGTGGACGGGGCACAGGAGGAGAAGTGTCTGTCCTGGGGGCCGGTGGGGC GGGTGGGAGAAGAGTAAGGCCTGGAAGCCTGGAAGCCGGGAGCCGGGAGAGCCGT GGGTGA | 8664 |

Figure 1 (Continued)

| | | | | |
|---|---|---|---|---|
| hsa-mir-339 | 1 | MGGALPQPRPAATGGRSRCRPWRPDAAAAGPAPPCRPR AGRAALLGAPLRAGPRAGPGRSRALLPLTLLGAQGRAA GGRVGVQALQALRALERPRNRPGSPALWGRTGPPAAM QQPPGETRALRTLGGLESSAAA* | 8665 | ATGGGAGGGGCCCTGCCTGCCCAGCCCCGCCCCGGCGACAGCCTGCGCCTCCCGTGG GAGGCCGTGGCGTCCAGACGCTGCTGGGGCGTCTGCGGCGTCCCGCTGGAGACCCGGG CCGGCCGAGCGTCCCGGCCGCTTCTCGGGCGTCGCTGCGCCGGTCCCGAGCAGGCCT GGACGGTCCGCCGCCCTCACTTACTCTCTGGGGCGCCAGGGCCGGCAGGGCCGCG GGTGGCAGGGTGGGGGGTCCAGGCGTTCCAGCCTGCAGGCACTGCAGGCCCTCGAGCTCGAGCGCCCCG CAACGGGCCAGGTCCCGGTCGCTGCGTCCCTCGCGTGGGGCGGACCCGGGTGGGCTGGAGTCGTCG GCCGCCGCGTGA | 8666 |
| | 2 | MMKTIGIASLGSLPEDGGAGRQLLQEALPLLRRGSAGF GLESAEVLGVCLLSSEEAVARAGGGPVLVLRCVLGASS AARTAGRGRGPGVRTDTRTGLPSLLLGLTAAETAGMV TVASESFAYE* | 8667 | ATGATGAAAACAATTGGGATAGCTTCACTGGGAGCCTTCCTGAGGACGGCGAGC AGGGACCGGCAGCTGCTTCAAGAGGCTCTGCCGCTCCCGCTCCTGCGGCTCAGCCGGTT TGGGTTGGAGAGCGCAGAGGTCTTGGGAGTACAGAGGTCTTTATCTCTGAGGAGCGG TGGCCCGGGCAGGTGGCCGCCCTGTCGTCCTTGCGCTGTGTCCTCGGAGCGTCCT CAGTGCTGCGGCACAGCCGGGGCGTCGGACCAGGCGTCGCACGGACACGGA ACCCGGCTGCTGCCTAGCCTGCTGCTGGGCCTCACTGCTCAGAGACGCTGGAATGGT GACCGTTGCTTCAGAGTCCTTTGCTTATGAGTAA | 8668 |
| | 3 | MSNSPN* | 8669 | ATGAGTAACTACCGAATGA | 8670 |
| | 4 | MNSLLCSLRSCGKVRKPNPYLVPRCECFKLCVTTNKIDM MIHFTDI* | 8671 | ATGAATTCGTTGTTGTTCACTGAGGAGTTGTGGCAAAGTGAGAAAACCTAACCGTAC TTAGTTCCCAGATGTGAGTGTTTTAAACTATGTGTAACAACTAACAAAATTGACATG ATGATACACTTCACGGACATTTAA | 8672 |
| hsa-mir-33b | 1 | MPPSPAGSPGVGHAGYAT* | 8673 | ATGCCTCCGTCTCCTGCAGGTTCTCCGAGGTTGGGGGCATGCGGGCTACGCAACT TGA | 8674 |
| | 2 | MRATQLEQERAPSRGRRCDSYQLAGEVEGYLQPN* | 8675 | ATGCGGGCTACGCAACTGAGCAGGAAAGAGCCCTTCCGAGGGAGAAGGTGTGA CAGTTACCAGCTCGCTGGGGAAGTGGAGGGCTACCTCCAACCAAATTAG | 8676 |
| | 3 | MGNPAVESPL* | 8677 | ATGGGAAACCCTGCAGTTGAAAGTCCATTATGA | 8678 |
| | 4 | MTCDLGPQTRRVST* | 8679 | ATGACTTGTGACCTGGGGGTCCACAAACCAGGAGAGTTCTACTTGA | 8680 |
| hsa-mir-345 | 1 | MGCGDE* | 8681 | ATGGGCTGCGGGATGAATGA | 8682 |
| | 2 | MNESRV* | 8683 | ATGAATGAGAGCCGAGTCTGA | 8684 |
| | 3 | MRAESDSAPQESLTFAVARDCPGPCGASHSVTSHQPFPS ASGGPDCQVGAWEQGRARRFLFAVGVRSALGRAQLFS LGPAGRQGHHTVCHVSRFRVTWFFYPNSSGYLPPGGAGR KVLCIWY* | 8685 | ATGAGAGCCGAGTCTGACTCGGCCCCCAGGAGTCCTGACTTCGCAGTGGCAAG GGACTGCCCCTGTCCTGTCCTGGAGCCATTGGTGAGCTGTCAGGTTGGAGCAGGGACGGGCCA CAGCGCCTCTGAGGTCCAGACTGCCAGGTTGGAGCGTGGGAGCAGGAGGACGGGCCA GGCGCTTTCTGCGCTTAGGAGTCAGATCAGCCTTAGGCCGGGCCAGTTCCTT CTTTAGGGCGGCAGGCAGGCAAGCCACACCGGTGTGCACGTTTGCAGGTTTAGGG TCCATGGTTCTTTTTATCCAATTCAGTGGGTACCTCCTGGAGGTGCAGGTC GAAAGGTTCTGTGTATTTGGTACTAG | 8686 |
| | 4 | MVLLSKFQWVPTSWRCRSKGSVYLVLGHTGRCCQ* | 8687 | ATGGTTCTTTTATCCAAATTCCAGTGGGTACCTACCTCCTGCAGGTGCAGGTCGAAA GGTTCTGTGTATTTGGTACTAGGACACACAGGTAGTGTGTCAGTAG | 8688 |
| hsa-mir-363 | 1 | MVEREGSGFILHPPPSLPPACLPGLSSSDPACSLVSDL* | 8689 | ATGGTGGAAAGGGAGGGGCTCGGCTTCATTCCGCCTCCCTCCTCCTGCCC CCCGGCTTGCCTTCCTCTCGACCCAGCGTGCTCACTGGTCTCTGATT TGTAA | 8690 |
| | 2 | MLNSHLIVRLKLRHHPHLQSAVGLWP* | 8691 | ATGCTTAATTCCATTTGATTGTGCGTCTTAAACTAAGACATCATTTTATTCTACAGA GCGCTGTCGGGCTTTGGCCTTGA | 8692 |
| | 3 | MRGESKHAPYLPHCACIRWLLPLTIPAKKP* | 8693 | ATGAGAGGAGAAAGCAAGATAATTGCACGTATCTTCCGCACATTTGCGGTGTATT CGGTGGCGCTGCTACCGTTAACGATACCTGCCAAGAAACCCTGA | 8694 |
| | 4 | MCRE* | 8695 | ATGTGCAGAGTAA | 8696 |

Figure 1 (Continued)

| | | | | | |
|---|---|---|---|---|---|
| hsa-mir-365-1 | 1 | MDYSSEDISGAFQRSAWWGLEAKRNQKRH8P)HPQ|KM PFSFFF* | 8697 | ATGGATGTGTCCTCAGAGGACATAAGCGGCATTCCAACGCTCGCTTGGTGGGG ATTGGAAGCAAAGCAAAGAAAACCAGAAACGCCACTCCCCCACCCCCCAAATCAAAATGC CTTTTCTTTTTTCTAA | 8698 |
| | 2 | MCPQRT* | 8699 | ATGTGTCCTCAGAGGACATAA | 8700 |
| | 3 | MPAGLGRTWSGGRGRPAPRAALRSGSRSESVSRAGFPG WGRGRGRSTASSISKPRH* | 8701 | ATGCCAGCAGGGGCTCGGGCGCACTGAGCGGGGCGCGGCCGGCCTGCTCGCG CGCGGCATTGAGATCGGGGGTCACCGCAGGCGAGTCAGTTTCCCGAGCGGGCTTTCCGG GGTGGGGCGGGGACGCGGACGCTCCACCGCCTCGTCAATTCCAAGCCCAGGCAC TAG | 8702 |
| | 4 | MGGERRKSFSAESAQPTGLHPASTVRCRHKAAPPPPTP QRPMAGPGRGLGRPGVGRAGEAAAAQAAGRLLPGQ AERARAWKPSAPARVGVGVGVGVGAGAGVGGRLP RNARQI* | 8703 | ATGGGCGGGGAGCGTAGAAAATCCTTTCTGCAGAGAGCGCCAGCCGACGGGCT GCACCCGGCCTCCACGGTCCGTGCGCCACAAAGCCGCGCTCCGCCCCCCCCAAC CCCCAGCGCCCTATGGCCGCCCGGGCGTGGGGGCTGGGGCGTGGGGGTTGGCC CAGCTGGGAGGCGCAGCGCCAGCGGCCAGGGAAGCCTGAAGCCTCGGCAGCCAGGC CAGGCAGAGAGGGCGAGAGCCTGGAGCCTGGAAGCCTGGAGCGCGGCGCGGGCCGGC GGGTGGGGTGGGGTGGGGTGGGGTGGGGTGGGGTGGGGCGCGCCCCCCGGGCTGGGGCGTGG TAGAAACGCTCGCAAATATAG | 8704 |
| hsa-mir-365-2 | 1 | MGAEGWVFAGEMRVSDQLAYKVPVLGPRDQRLLPGPR PRPASSRAGVRSGQAASQVHAGEGVVRCARPGCVR* | 8705 | ATGGGAGCTGAGGGCTGGGTCTTTGCGGGCGAGATGAGGGTGTCGGATCAACTGGC CTACAAAGTCCCAGTTCTCGGCCCCCGGGACCAGGCTCTTCTCCGGTCCTCGCCC CAGGCCGGCTTCCTCCGCGGAGTGCGTGAGTGCCTCCGGCAGCTGCCTCTCAGGTCCA CGCTGGAAGGAGTGGTGAGTGCGCTCGCCCGGTGCGTGCGGTGA | 8706 |
| | 2 | MGQALPLTEACPAVLSRAATLSLGVGRTGPDF* | 8707 | ATGGGCCAAGCTCCCTGCCACTTACCGAGGCCTGCTGCCCCTGCCCTGTGCTTTCCAGGGCGGCA ACCTTGAGCTTGGGGATGGTTCCAAATGCCGGTCTTTGTTCCCTGA | 8708 |
| | 3 | MDLCGCVPNGRSFVP* | 8709 | ATGGATCTTTGTGAGTGGTTCCAAATGCCGGTCTTTGTTCCCTGA | 8710 |
| | 4 | MCSQWPVPCSLTDAT* | 8711 | ATGTGTCCAATGCCGGTCTTTGTCCCTGACGATGCAACATAA | 8712 |
| hsa-mir-371 | 1 | MMTCALVFFTEPLFIKCSIKS* | 8713 | ATGATGACATGCGCTTGGTCTTTTCACTGAACCTCTTTTATAAAGTGTTCAATAA AAAGCTGA | 8714 |
| | 2 | MRFGLFH* | 8715 | ATGCGCTTGGTCTTTTCACTGA | 8716 |
| | 3 | MYSLHLA* | 8717 | ATGTATTCTTTGCATCGGCATAG | 8718 |
| | 4 | MQEDHLSPGVPVQPGLTGRTPSLERKKCKKAFFVYYFF ETGSPSIPQTGVPWYHHSLLQP* | 8719 | ATGCAGGAGGATCATTGAGTCCAGGAGTTCCAGTCCAGCCTGGGTTAACAGGTAG AACCCCTTCTCTGAAAAGAAAAATGTAAAAAGCATTCTTTGTGTATTATTTTTT GAAACAGGGTCTCCCCTCTATACCCCAGACTGGAGTGCCTTGGTATCACAGCTTA CTACAGCCTGA | 8720 |
| hsa-mir-372 | 1 | MMTCALVFFTEPLFIKCSIKS* | 8721 | ATGATGACATGCGCTTGGTCTTTTCACTGAACCTCTTTTATAAAGTGTTCAATAA AAAGCTGA | 8722 |
| | 2 | MRFGLFH* | 8723 | ATGCGCTTGGTCTTTTCACTGA | 8724 |
| | 3 | MYSLHLA* | 8725 | ATGTATTCTTTGCATCGGCATAG | 8726 |
| | 4 | MQEDHLSPGVPVQPGLTGRTPSLERKKCKKAFFVYYFF ETGSPSIPQTGVPWYHHSLLQP* | 8727 | ATGCAGGAGGATCATTGAGTCCAGGAGTTCCAGCCTGGGTTAACAGGTAG AACCCCTCTCTGAAAAGAAAAATGTAAAAAGCATTCTTTGTGTATTATTTTTT GAAACAGGGTCTCCCCTCTATACCCCAGACTGGAGTGCCTTGGTATCACAGCTTA CTACAGCCTGA | 8728 |
| hsa-mir-373 | 1 | MMTCALVFFTEPLFIKCSIKS* | 8729 | ATGATGACATGCGCTTGGTCTTTTCACTGAACCTCTTTTATAAAGTGTTCAATAA AAAGCTGA | 8730 |
| | 2 | MRFGLFH* | 8731 | ATGCGCTTGGTCTTTTCACTGA | 8732 |
| | 3 | MYSLHLA* | 8733 | ATGTATTCTTTGCATCGGCATAG | 8734 |

Figure 1 (Continued)

| | | | | |
|---|---|---|---|---|
| | 4 | MQEDHLSPGQVPVQPGLTGRTPSLERKKCCKKAFFVYYFF ETGSPSHPQTGVPWYHHSLLQP* | 8735 | ATGCAGGAGGATCATTTGAGTCCAGGAGTCCAGTTCAGCTGGGTTAACAGGTAG AACCCCTTCTCTGGAAAGAAGAAAAAATGTAAAAAGGCATTCTTTGTGTATTATTTTT GAAACAGGGTCTCCCTCTATACCCAGACTGGAGTGCCTTGTATCATCACAGCTTA CTACAGCCTTGA |
| hsa-mir-374a | 1 | MARGEVSCLCLAILG* | 8737 | ATGGCGAGGGAGGTAAGGTCGTCTTTGCTTGGCCATCTTGGCTAG |
| | 2 | MLWPDPLEINPES* | 8739 | ATGCTGTGGCAGATCCACTAGAATTAACCAGAATCTTAG |
| | 3 | MRRR* | 8741 | ATGAGGAGGCGATGA |
| | 4 | MMTLQKVAAAGGA* | 8743 | ATGATGACTCTGCAAAAGGTTGCGGCAGCTGGGCGGTGCGTAG |
| hsa-mir-374b | 1 | MARGEVSCLCLAILG* | 8745 | ATGGCGAGGGAGGTGTCTTGTCTTGCGATCTTGGCTAG |
| | 2 | MLWPDPLEINPES* | 8747 | ATGCTGTGGCCAGATCCACTAGAAATTAACCAGAATCTTAG |
| | 3 | MRRR* | 8749 | ATGAGGAGGCGATGA |
| | 4 | MMTLQKVAAAGGA* | 8751 | ATGATGACTCTGCAAAAGTTGCGGCAGCTGGCGGTGCGTAG |
| | 1 | MAGNDCGALLDEELSSFFLNYLADTQVRPAGAAGPGP GVLSCGGJRSCSRGGREAAVGALG* | 8753 | ATGGCGGGAACGACTGCTGGCGCGCTGCTGGACGAAGAGCTCTCCTCTTCTCTC AACTATCTGCTGAGCTGCACGCAGGTACCGCCGTGGGCTGCGGCCGGCCCAGG GGTGCTGAGCTGCGGGGTACGCAGCTGCAGCCGCGGGAGGCAGCGGTG GGAGCCCTGGGGTAA |
| hsa-mir-378 | 1 | MRSVTGAGSRRSPGACRSAGGATAAGEGLALAAWSLP PRGQNWGVPRFLWEVEARHGVGYPQAGAGCWRRAVS ARHLLPYFHVDLWPRHGCMPGSPESPSPPGCSPQSAVA GPPRLSTRARSAEFPASCRLKA* | 8755 | ATGCGCTCCGTTACCGGGCAGGAGCCGGAGGTCTCCGGCGCGTGCCGAGCGC TGGGGCGCTACGCCGGCTGGGAGGGTATCGCTGCCTTCGCGTTGGAGTCTGCCAC CGCGCGCAAAACTGGGGGTACCACAAAAACTGGGGGTAGCTTTCGCGGACTGCGGCCGCGGGAGTGCGACTTGCTGCCGCTACTTCACGTGGACTTGTGTCCGCACGGGTGCATGCCGGGTCTCCGAGTCTCCTAGTCCAGGTGTAGTCCAGCAGCGCGAGTGCGGGTGTTGCTGCCC CCGCGGGGCTTTCTACCCGCAGCCGAGTTCCTGCCAGTTGCGGCTAAA GGCATAA |
| | 2 | MRAETASSWFRYRAEPPGGKSQAGWGRKDCLGAPGSP CGARPRCALHDAGGREGEAESQALAEPGSPTGDTRVTG EGALVCRGAGERGSWWLGDWERGAAGTSSHQKCQHE ACAAPTPSHFPTQCLLQA* | 8757 | ATGCGGGCGGAGACAGCGTCTTCGCTGTTCTCGTTCAGGTGCGGTGGCCCCTGGGGG GAAAAGCCAGGCTGGATGGCGGCGAAGGACTGTCTGGGAGCCGCTGGGTCCCCT GCGGCCGCCGCAGGGGGCCGCCGCAGCGGGCCCACGATGCAGGGGAAGGGAGGC GGAGTCCAGGCACTGGCCGAGCCGGAGGCCGGAGCTGAAGAAGCCGGTGAGC GAGAGGTGCTCTGGTGTGTGGTGCGGTGCTGGACAAGCAGCCACCCAAAATGCCTTGTGCAGCAGGCGTGCCGGCCGGCCCACCCATTCCCACCACCAATGCCTGTGCAAGCATA A |
| | 3 | MGAEGLSGGAWVPLRCAAPVRAPRCRGKGRRGGVPGT G* | 8759 | ATGGGGGCGGAAGGACTGTCTGGGGCTGGGTGTCCCCCTGCGGTGCCGGGCCC GGTGCGCGCTCCACGATGCAGGGGAGAAGGGAAGGCGAGTGCCAGGCACT GGCTGA |
| hsa-mir-423 | 1 | MAIPGRQ* | 8761 | ATGGCGATTCCGGGCAGGCAGTGA |
| | 2 | MRNYGDCIFGRGVLNALEVKGLCRQ* | 8763 | ATGAGAAACTACGGCGACTGTATCTTTGGCCGGAGGAGTTTAAATGCGCTGGAAGTG AAGGGACTGTGTGTCAAGGGTAG |
| | 3 | MRWK* | 8765 | ATGCGCTGGAAGTGA |
| | 4 | MEARSLREKLVRK* | 8767 | ATGGAAGCCCGAAGTTTGAGGGAGAAACTTGTGAGGAAATAA |
| | 1 | MGANLTFKVPNK* | 8769 | ATGGGGGCAAATCTGACATTTAAAGTGTTTAACAATGA |
| hsa-mir-424 | 2 | MSAAGKFSGNGLGKKKQQLTWRGGERKLSKGQ* | 8771 | ATGAGTGCGCGCCGGAAATTCTCAGGAAACGGACTGGGAAAAAAAACAACT AACATGAGGGGCGGGAGGAGAAAACTGAGTAA |
| | 3 | MEGRGEKTE* | 8773 | ATGGAGCGGGGCGGGAGAAGACAAACTGAGTAA |
| | 4 | MNFSSYLQEVSYVLERNV* | 8775 | ATGAACTTTTCCTCTTATTGCAAGAGTTAGTTATGTCTTGAAAAGAAATGTGTGA |

Figure 1 (Continued)

| | | | | | |
|---|---|---|---|---|---|
| hsa-mir-425 | 1 | MGGF* | 8777 | ATGGGCGGTTCTGA | 8778 |
| | 2 | MWPQGE* | 8779 | ATGTGGCCCAGGGCGAGTGA | 8780 |
| | 3 | MGCP* | 8781 | ATGGGGTGCCCCTGA | 8782 |
| | 4 | MGVDVGEPRLVAISGTLGRGEGGWTQDLWVGLQW* | 8783 | ATGGGTGTAGACGTGGGAGAGCCGAGGCTGGTGGCCATCTCTGGAACCCTGGGGAG GATTGGCGAGGGAGAGGTGGACCCAGGACCTCTGGGTAGGGCTGCAATGGTAG | 8784 |
| hsa-mir-449b | 1 | MYLGDGTPGY* | 8785 | ATGGTCCTGGGGACAGGGACTCCAGGGGTTTGA | 8786 |
| | 2 | MEWKLERTAPRRVRTEEEMLWVSNTLFCILPNSLMRGR RPR3* | 8787 | ATGGAGTGGAAACTGGAGCGCACCGCGCCTCGGAGGGTCCGCACGGAAGAGGAGAT GCTGTGGGTGAGTAACACCCTTTCTGCATTCTGCCCTAACTCTCTAATGCGCGGCCG AAGGCCCCGTTCATAA | 8788 |
| | 3 | MIFLNSFSLNMLSVFSKESIMRVLSKDLKQKRSQDSANV SPGLVLVLCFNSDLEQTNSW* | 8789 | ATGATTTTCTAAATAGTTTCTCCCTCAATATGTTATCTGTGTTTCAAAGGAAAGTA TCATGCGTGTCCTCTCCAAGACTTGAAGGACGAAGAAGTCAAGATTCCGCCAAC GTGAGTCCAGGGCTTGTGTCTTGTTCTGTGTTTAATTCTGATCTTGAACAAACGAATT CTTGGTAA | 8790 |
| | 4 | MRILVSYYILKKISL* | 8791 | ATGAGAATTTTAGTATCTTATTACATACTAAAAAATTTCTTATGA | 8792 |
| hsa-mir-450a-1 | 1 | MGANLTFKVFNK* | 8793 | ATGGGGGCAAATCTGACATTTAAGTGTTTAACAAATGA | 8794 |
| | 2 | MSAAGKFSGNGLGKKKQQLTWRGGERKLSKGQ* | 8795 | ATGAGTGCGGCCCTGGGAACGGGCTGGGAAATTCTCAGGAAAACGACTGGGAAAAAACAACT AACATGGAGGGGCGGGAGGGAGAAAACTGAGTAAGGGCAGTGA | 8796 |
| | 3 | MEGRGEKTE* | 8797 | ATGGAGCGCGGGGAGAAAACTGAGTAA | 8798 |
| | 4 | MNFSSYLQEVSYVLERNV* | 8799 | ATGAACTTTTCCTCTTATTGCAAGAAGTTAGTTATGTCTTGAAAGAAATGTGTGA | 8800 |
| hsa-mir-450a-2 | 1 | MGANLTFKVFNK* | 8801 | ATGGGGGCAAATCTGACATTTAAGTGTTTAACAAATGA | 8802 |
| | 2 | MSAAGKFSGNGLGKKKQQLTWRGGERKLSKGQ* | 8803 | ATGAGTGCGGCCTGGGAATTCTCAAGGAAAACGGACTGGGAAAAAAACAACACT AACATGGAGGGGCGGGAGGGAGAAAACTGAGTAAGGGCAGTGA | 8804 |
| | 3 | MEGRGEKTE* | 8805 | ATGGAGGGGCGGGAGAAAACTGAGTAA | 8806 |
| | 4 | MNFSSYLQEVSYVLERNV* | 8807 | ATGAACTTTCCTCTTATTGCAAGAAGTTAGTATGTCTTGGAAAGAAATGTGTGA | 8808 |
| hsa-mir-484 | 1 | MLGTPGGAGPRGPAASSGSVPSR* | 8809 | ATGCTCGGAACCCCGGGGGAGCTGGCTTTTTTTTCTCTCGAGCCTCGTCAGGCTC AGTCCCCCGATAA | 8810 |
| | 2 | MKMPVPSAPPFSSLGSRHVMLLYF* | 8811 | ATGAAAATGCCTGTCCCTCAGCATCTAAATCTAGTGCAACCTAG | 8812 |
| | 3 | MAHRPQHPKSSAT* | 8813 | TGGTTCCCACTTTATTTTTAA | 8814 |
| | 4 | MNTAPPVTGWASRKEILRLVSNTLCFRWPDMLCGLL* | 8815 | ATGAATACTGCGTTTCAGTTGGGCGAGCAGAAAGGAAATCTTACGGTT AGTTTTCAAACACTTGTGTTTTAGGTGGCCAGATATGCTGTGTGGTTTGCTTTAA | 8816 |
| hsa-mir-497 | 1 | MRIRLGALPLASGWSH* | 8817 | ATGAGAATTAGATTATTGGCTCTCCCTTGCATCAGGATGGAGTATTATTGA | 8818 |
| | 2 | MEYYLISCGVSVYYGVLL* | 8819 | ATGGAGTATTATTACGTGTGTTGTGTCATGGGTATCAGTTTATTATGGGTGATTGA | 8820 |
| | 3 | MVSFRYGADLEVTLVLGVLTPTIWRLCSPVSSWTISRTK VLMLJWGCSLFWGAF* | 8821 | ATGGTAAGTTTCAGGTATGGACTGACTTGGAAAGTTACATTAGTTCTGGGGTTCTG ACACCCAATTGGAGATTGGTGTCTCACCTGTCATCTGGACTATCAGCAGAACC AAAGTACTCATGCTGATTGGGGGCTGCAGTCTATTTGGGGGTGCCATCTAA | 8822 |
| | 4 | MGLTWKLH* | 8823 | ATGGGGCTGACTGGAAGTTACATTAG | 8824 |
| hsa-mir-503 | 1 | MGANLTFKVFNK* | 8825 | ATGGGGGCAAATCTGACATTTAAGTGTTTAACAAATGA | 8826 |
| | 2 | MSAAGKFSGNGLGKKKQQLTWRGGERKLSKGQ* | 8827 | ATGAGTGCGGCCTGGGAATTCTCACGAAACTGACTGGGAAAAAAAACAACAACT AACATGGAGGGGCGGGAGAGAAAACTGAGTAAGGGCAGTGA | 8828 |
| | 3 | MEGRGEKTE* | 8829 | ATGGAGGGGCGGGAGAAAACTGAGTAA | 8830 |
| | 4 | MNFSSYLQEVSYVLERNV* | 8831 | ATGAACTTTTCCTCTTATTGCAAGAAGTTAGTTATGTCTTGAAAGAAATGTGTGA | 8832 |
| | 1 | MFRRSLNRFVSTLAAAPRVPVCLLASPFAGSLTTF* | 8833 | ATGTTCCGCCGAAGCTTGAATCGTTTGTGAAGTACACTGCTGCGGTCCGCGGTG CCGGTTGCTTGCTCGCCAGCCCTGCCGGGTCCCTCACACAATTTTCTGA | 8834 |

Figure 1 (Continued)

| | | | | | |
|---|---|---|---|---|---|
| hsa-mir-505 | 2 | MAFYSQGGGFLLPPLPRAHGGKPRPVTVAQKKSWGLRE PETRARLSLA* | 8835 | ATGGCGTTTTATTCTCAGGGAGGTGCTTCTTTTGTTCCTCCGCACGAGCACATG GAGGTAAAACCTAGACCTGTCACGGTGGCCCAAAAGAAGAGCTGGGGGCTGAGGGAG CCGGAGACTAGGCAAGACTCAGCCTTGCCTAG | 8836 |
| | 3 | MEVNLDLSRWPKRRAGG* | 8837 | ATGGAGGTAAACCTAGACCTCACGGTGGCCCAAAGAAGAGCTGGGGCTGA | 8838 |
| | 4 | MCSREEAAPPLPVLPISGLKPRGGLSTPDLEPMGEGGL* | 8839 | ATGTGCAGCCGCGAGGAGGCTGCGCCGCCACTGCCGGATCTCTGGCTG AAGCCTCGCGGAGACTGAGCACTCCAGAACCTTGAACCCATGGAGAAGGCCGACT GTGA | 8840 |
| hsa-mir-542 | 1 | MGANLTFKVFNK* | 8841 | ATGGCGGGCAAATCTGACATTTAAGTGTTAACAATGA | 8842 |
| | 2 | MSAAGKFSGMGLGKKKQQLTWRGGERKLSKGQ* | 8843 | ATGAGTGCGCCGGGAAATTCTCAGGAAACGGACTGGGAAAAAAAAACAACT AACATGGAGGGGCGGGGAGAGAGAAAACTGAGTAAGGGGCAGTGA | 8844 |
| | 3 | MEGRGEKTE* | 8845 | ATGGAGGGCGGGGAGAGAAAACTGAGTAA | 8846 |
| | 4 | MNFSSYLQEVSYVLERNV* | 8847 | ATGAACTTTTCTCTTATTGCAAGAAGTTAGTTATGTCTTGAAAGAAATGTGTGA | 8848 |
| hsa-mir-545 | 1 | MARGEVSCLCLAILG* | 8849 | ATGGCCAGGGAGGTAAGCTGTCTTGCTTGCCATCTGGCTAG | 8850 |
| | 2 | MLWPDPLEINPES* | 8851 | ATGCTGTGGCCAGATCCACTAGAAATTAACCAGAATCTTAG | 8852 |
| | 3 | MRRR* | 8853 | ATGAGGAGGCGATGA | 8854 |
| | 4 | MMTLQKVAAAGGA* | 8855 | ATGATGACTCTGCAAAGGTTGCGGCAGCTGGCGGTGCGTAG | 8856 |
| hsa-mir-548b | 1 | MSLDWACLSSWGRATSWGPAHTRTHVERVCKSTPVLL TEEGDYSIVFLGHLFFFTSGLTLAARGSPPGLGCWIPATRG KHWRHDPGSTSRGARTGRGAAGLAAAAARGWAGL GCGEMTSRSPRAPW* | 8857 | ATGTCTCTGGATTGGGCTTGCCTCTCTTCTTGGGAAGAGCCACTTCTTGGGCGCCT GCACACAGAGGACTGCATGTGGAAGAGGTCTGAAATGCACACCGTTCTGCTAAC CGAAGGTGATTACAGCAGCTTCTTGGGGATACTTTTTTTTACGTCAGGCCTC ACGCTCGCTCACGGGGATCTGGGCTGTGATCTCCGCCACACG AGCGGAAGCACTGGCGGCACGATCCGGATCTGACCTGGCGGCGAGGCGCCCACTGGCC GGGGGCTGCGGGACTGGCGGCGTCGTCCCGCGCCGCCCTGGTAA | 8858 |
| | 2 | MWKGSVNRHPFC* | 8859 | ATGTGGAAAGGTCTGTAAATGACACCGTTCTGCTAA | 8860 |
| | 3 | MSPPHAAARPVSSSLRSLAESSVRAASGTRGAALSSTFP PGAGRGIASKSWPGPRPPPMPGHLPRAVVPAASGRRDR PVPSRGDPGIVAGGTAPAAESGGRRVSGREAAAATLASR ASLLHGPASTRGDRCPGWGLLGRWRPPA* | 8861 | ATGTCTCCTCCTCGGCTATCCCGCGCTGCCAGGCCGTCTCGCCGAGCCTCG CCGAGTCCTCGCTCCGCCAGTCCGCGCTGCGAGGCCGGCGACCCGGAGCGGTGCCGCTCGCTCGACG CCTCCGCCAACCGCGCGGCATCTGCCCGCCGGTTGTCCGCGGCTTCGGCCGGCG GAGCCGCGTCGCTCCCTCCAGGGTGACCCGGAGCCGCGGGGGTCGGGTCAGGAACGCGCCTG GCGTCGAGTCTGCGGCGGCGTCGGGTGCCGGTCGGAAGCGCGCGCGGACTCTT GCTCCCGCGGCCGTCGTTGTTGGGAAGATGGCGACCACCCGGCATGA | 8862 |
| | 4 | MATPGMSWQQHYYGGSAAKFAPSPATAQLAGHSMDY SQEMHLKMSKKIAQLTKVRGAATGVATPCGPRRTHL SPREAVRPAPAARGTLLLRRSNSRRHLQNPANFGGTLA T* | 8863 | ATGGCGACCCCGGCATGAGCTGGCAGCAGCACTATTACGGCGGCTCGCGCCAA ATTCGGCCTCGCCGACCTGAAATGCACCTGCTGGGCACGAGCTGACTACAGCC AGGAGATGCACCTGAAAATGAGCAAGAAAATCGCCCAGCTCACCAAGGTAAGGGGG GCAGCGACGGGCAGTCGGCGACCCGTGCGGCCGCCGGGAACTCACCTGTCTC CGGGAGGCAGCGCCCGTGCGCCGCAAACCCGTCCAGGGAACTCTACTCTCCGCCGAA GCAACAGCCGGAGACACCTCCAAAACCTTGGTGAACGCTGGCAACA TGA | 8864 |
| hsa-mir-548c | 1 | MVKRQ* | 8865 | ATGGTGAAAAGACAGTAG | 8866 |
| | 2 | MINACKGASILLYDKSWLT* | 8867 | ATGATAAATGCAAAGGCTTCTTCTATATGACAAGTTGGCTAACTTAG | 8868 |
| | 3 | MHAKELLFYMTSLG* | 8869 | ATGCATGCAAAGGAGCTTCTCTTCTATATGA | 8870 |
| | 4 | MQRSFSSI* | 8871 | ATGCAAAGGAGCTTCTCTATATGA | 8872 |
| | 1 | MPSS* | 8873 | ATGCCATCATCTTAG | 8874 |
| | 2 | MVKNPVGWMQWLMPHPTLWEAEVGGLLEPKSLRPA* | 8875 | ATGGTGAAGAATCCCGTGGGCTGGATGCAGTGGCTCATGCCTATAATCCCAACACTT TGGGAGGCTGAAGGTAGGAGGACTGCTTGAGCCCAAGAGTTTGAGACCAGCCTGA | 8876 |

| | | | | |
|---|---|---|---|---|
| | 3 | MCPWVWGGWGAKEWDERWSRNGGRCCPPRGLQAET G* | 8909 | ATGTGCCCTGGGTTTGGGGAGGGTGGGGAGCCAAGGAGTGGGATGGAGAGGTGGTC ACGGAATGGGGCGGCTGCTGTCCTCCCCGGGGCTGCAGGCCGAGACCGGGTGA | 8910 |
| hsa-mir-564 | 4 | MRGGHGMGGAAVLPGGCRPRPGEGRG* | 8911 | ATGAGAGGTGTCACGGAATGGGGCGGGGCGCTGCTGTCCTCCCCGGGGCTGCAGGCC GAGACCGGGTGAGCGCGCGGGGGTGA | 8912 |
| | 1 | MDSVGRRGAR* | 8913 | ATGGACTCGGTGGGCCGGCGCGGCCGTTAG | 8914 |
| | 2 | METAKPREVYLLPQRPQYPAWPQASGPDVLPRAQIYY RLGRRPPQPRVSATWPAPSEAPESDSQGACRSVASQER RVT* | 8915 | ATGGAGACGGCTAAGCCGCGAGAAGTTACCTTCTACCACAGCGTCCACAGTACCG GCTTCGCCTCAGGCTCCGGGTCCGACGTCCTGCCACGTCCAGAGCACAAACCTACTACAGG TTAGGCCGGAGGCGCCACAGCCAGGGTCTGCCACCTGGCCGCCCCCCTCCGAG GCGCCGGAGAGCGATTCCAAGGGGCGTGGCGTCACAGGAGGGTCG CGTCACGTGA | 8916 |
| | 3 | MAERPGPPGGAVSATAYPDTPAEFPPHLQAGAMRRF WGVPNCLCAGAPGALAAASAKLAFGSEVEPCGALLVLLL RAGGRGAAGRRRGAAGPAGLLGWGGGRRAPPHPRRS VPPGRPRAAGGAAVSWGGRECFASNHAKPSSSVGGKRR RGLRPLPLPGT* | 8917 | ATGGCCGAGAGGCCGGGCTCCGGGAGGCTCCGCACCTCAGGCGGTGCGATGCGGCGCCTTG CACCCCGCGGGCGAATTCCTCCCACACTCAGGGCGGCTCCGATGCGGCGCCGCCTTG GGGCGTATTCACTCAGGCTGCGGCCCTTGCCCGCCCCTCCGCCCGCCCGC CAAGCTGCCTTGGCAGCGAGTCGAGCCCTGCCCCTCCCGCGCC GGGCGCGGCGGCGGCGCGGCGCCGCGAGGGACGCGCGCGGGGCCCGCGGG GCTCTTGCGGGCTGGGCCGGGCCCCGCGGGCCCGGGCGCACCCCTGCGCGCTCG TGTTCGCTCTAATCACGCAAACCTGCGCAGTGAGTGGTAGGTTAAGAGACGTCGG GGACTGAGGCCTCTGCCCACTACCAGGAGACCCTAA | 8918 |
| | 4 | MTSLPHYQENWFPGIL* | 8919 | ATGACCAGTCTGCCGCACTACCAGGAGAATTGGAGTTTGGGATACGTAG | 8920 |
| | 1 | MPPTRRVGVRRRAP* | 8921 | ATGCCGCCGACCGCGGCGGTTGGAGTTGCGACGAGCGCCGTGA | 8922 |
| hsa-mir-565 | 2 | MDRWYPEARSNCIRVISYHGEGFSKSGPVAQWITRLTT DQKILGSTPGWLAMSVLPHLIHVLLGLVKMYIHNVKV LQDLGKYYG* | 8923 | ATGGATCGTTGGTACCCCGAAGCCGTTCAAACTGTAAGGTTGATCAGCTATTAC GGAGAAGGCTTTAGCAAGTCTACTAGTTCGACTCCTGGTGATAACCGTCTGACTAC GGATCAGAAGATTCTAGGTTGCAGCACTTCGGGTCTTGACTCCTGGCTCGATGTCGTTTGCCACA CTTGACCCATGTGGCTTAGGTTCGGGTCTTGTAAAGATGTATATTCACAATGTGAAAGTATT ACAAGACCTTGGAAAGGTGTATGGTTAG | 8924 |
| | 3 | MDNASDYGGSEDSRFDSWLARDVCFATLDPCTTGSCKD VYSQCESTRRPWKGVWLECES* | 8925 | ATGGATAACGCGTCTGACTACGGATCAGAAGATTCTAGGTTCGACTCCTGGCT CGGATGTCTGTTTGCCACACTTGACCCATGTACTACTGGGTCTTGTAAAGATGTA TATTCACAATGTGAAAGTGAGACTAGAAGACCTTGGAAAGGTGTATGGTTAGAATGTGAA AGTTAA | 8926 |
| | 4 | MYYWVL* | 8927 | ATGTACTACTGGGTCTTGTAA | 8928 |
| | 1 | MAPGGR* | 8929 | ATGGCCCCGGGGGCCGCTAG | 8930 |
| hsa-mir-566 | 2 | MDVWMMWPAGSPMCKATFSCKVLGGCSHTPPPSRFW SGSSDPPSASALSPINARGSALPRRCACPTSVSLLEDWPA RREAVYWQSPRGGSPTSAEWEDLQS* | 8931 | ATGGATGTGTGGATGATGTGGCCTGCGGGTCACCATGTGCAAAGCAACTTTTTCC TGCAAGGTTCTGGGATGCCCTTGCCTGCCTACGTTCATACACCGCACCACTTCTCGAGCGG AGTTCCCGTAGAGATGGGCCTTGCCTGCCTACTTCAGCTCTCTCGCCATTAACGCCAGGCAGCGCTC TTCCCCGTAGATGCCGCCTACTTGGCAGGTCTCTACTTGAGGACTGGCCAGCC GAAGGAAGCGTATACTTGGCAGTGGGGGTCTCCCACATCAGCAGAG TGGGAGGACCCTCCAGTCCTGA | 8932 |
| | 3 | MRLPYLSVST* | 8933 | ATGCGCTTGCCCTACCTCAGTGTCTCTACTTGA | 8934 |
| | 4 | MGQEGIKVGLGMRQCWRELACAGAGAGGPTG* | 8935 | ATGGGACAGGAGGGTATCAAAGTTGGCTAGGAATGAGGCAGTGCTGGCGGAGTT GGCTGGAGCTGGGGGTGGGGGCCCCACTGGATAA | 8936 |
| | 1 | MTTKFCTSFPEAPDRLAWSIYYWTYS* | 8937 | ATGACTACTATCAAATTCTGTACTTCATTTCCAGAGGCTCCTGACAGACTTGCTTGGTCA ATATACTACTGGACATATTCATGA | 8938 |

Figure 1 (Continued)

| | | | | | |
|---|---|---|---|---|---|
| hsa-mir-570 | 2 | MRLSHTGHSNPVCPTLFLSMPVPLPLPHMSVTVHLLSLS PSPFGS* | 8939 | ATGAGACTGTCTCACACAGGCATCTGAACCCAGTGTCCACAATTCTCTCCTA TCCATGCCTCTTCCTCCTCCACTGCCTCATATGTCGGGTGACTGTCCACCTTCTCTCTC TCTCCCCCTCTCCGTTTGCTCATAG | 8940 |
| | 3 | MAITLLQINIFNHWNDGNNLIGFILSSI* | 8941 | ATGGCCATTACCCTATTACAGATCAACATCTTCAATCACTGGAATGATGGCAATAAT CTAAATTGGGTTCATTTTATCCTCTATCTAA | 8942 |
| | 4 | MMAII* | 8943 | ATGATGGCAATAATCTAA | 8944 |
| | 1 | MIGS* | 8945 | ATGATTGGTAGCTAA | 8946 |
| | 2 | MVSVRGRASQG* | 8947 | ATGGTGAGTGTGCGTGGCAGGGCGTCCAAGGCTGA | 8948 |
| hsa-mir-571 | 3 | MAAGPSLRTESPLPPLSPGASVPSGEGPGLLSVPAQRLW PSLQPSLCSSAPAAPHLPQAVG* | 8949 | ATGGCGGCAGGACCGAGTCTGCAACGGAGTCCCGCTCCGCCCCTCAGTCCTGG GGCTCAGTACCCTCCGGTGGAGGGACCTGGGCTCCTGTCGGTCCCCGCACAGGCGCT CTGGCCCCAGCCTGCAGCCTCCTTGTGCAGCTCTGGCACCCGCAGCCCCGCACCTTCC CCAGGCTGTGGGGTGA | 8950 |
| | 4 | MPAWEELWEKLWSGDPVPALPCSE* | 8951 | ATGCCGGCCTGGGAGGAGCTGTGGGAGAAGCTGTGGTCTGGGGATCCGGTCCCTGC TTTACCCTGTTCGGAATGA | 8952 |
| hsa-mir-574 | 1 | MHPTPRPHSGSAPSACVNLRGACLDLPKYPVLAPSKSG KVPPMARGQVRGGLQGPPARARREQVPVRQRPRPRVR LPSALAQGAQALTSPLPSPYSSPNSRPTPCLLFQSSQHSK QAPPPLAAPGMGPTPYRRSPGPLRPVG* | 8953 | ATGCACACACCACACGCCACACTCAGGGTCGCCCCTCGCCTGCGTAACCTC CGGTGGAGCCTGCCTGGATCTCCAAAGTATCCAGTCCTGGCACCAAGCAAGTCTGGA AAAGTGCCCCAATGCTCGGGCGACAAGTGCAGGGCCCTCCAGGGTGGCGCC CCGGGCCACGAGGAGCAGGTCCTGTAAGACACAGAGAGCCTCGCAGGGTGCGCC TGCCCTCGCCCTTGGCACAGGAGCTCAGGCCCAGCCCAGCTCAGCCTCTGACCTCCGCCTT ACTCTCCCCCACAGCCTGCCCTCGACCCAGCCCACTCGCAGCTCCAGTCCAGCCAACACT CTAAGCAGGCACCGCCTCCACTCGCAGCCCCCGGGATGGGTCCCACTCCCTACCGCA GATCCCAGCCCCTCCACCCAGTGCGGCTAG | 8954 |
| | 2 | MGGCIESHTYALLIPSFPILMRKDTGRWLLKSVCSELPVTS AML* | 8955 | ATGGGCTGTGAGAGCATTACCTATGCCTCATCATGCCTACTGATCCATCATTCCCATCTAAAC ATCTTTGAAGGACACAGGCAGGTGGCTTCTAAATCAGTGTGCTCTGAACTCCCTGTG ACCTCAGCGCCGCTAG | 8956 |
| | 3 | MRQALSSEPLFALSAA* | 8957 | ATGAGACAGGCTCTATCCTCAGAGCCTCTGTTTTGCCTCTCTGCAGCTAG | 8958 |
| | 4 | MDLRHK* | 8959 | ATGGATTTGAGGCACAAGTGA | 8960 |
| | 1 | MSAAGL* | 8961 | ATGTCAGCGCTGGACTGTAG | 8962 |
| | 2 | MPLQP* | 8963 | ATGCCCTTGCAGCCTTGA | 8964 |
| hsa-mir-580 | 3 | MGINERTVFCNELVPCTQGASSKAIWLLAVAQLATCVC VAA* | 8965 | ATGGGAATAAATGAAAGGACTGTATTTTGCAACGAGCTTACCCGTGCACGCAGG GGCCTCCAGCAAAGCCATTTGGTTGCTTGCTGCAGCTTACCGTGCACGCAGGGGCCTCCAGCA CGTCGCGCCTAA | 8966 |
| | 4 | MKGLYFATSFTRARRGPPAKPFGCLLSLSWLRVFASPPK SELLSAYLC* | 8967 | ATGAAAGGACTGTATTTTGCCAACGAGCTTACCCGTGCACGCAGGGGCCTCCAGCA AAGCCATTTGGTTTGCTGTCTGCCTCAGCTGGCTACGTGTTGCGTGCGCT AAAAGCGAGCTGCTTTCAGCCTTCAGCTGCTGA | 8968 |
| | 1 | MASSGEVLSATVSALLPRRPRSPWVLPSRPGFPCILSIP TPTPRPSHPDPGLAPAPVLPASCPQDSYPVSEGTSCLPL RSCIPDRQSCPRLSVP* | 8969 | ATGGCCAGCTCGGGAGAAGTCCTGTCTCCGGCGACTGTCTCCGCTCTCTTGCCTCGG CGGCCCGACCCGGAGCCCGCGCCCCCGCGTCCCCATCCGACCCGGGTTCCCTTGCCATCCTTCTA TCCCACCCCTCCCCACCCCGTCCCAAGACTCCTACCCTGTCGGAAGGCACAAGCTG TCCTCCTGCCCCCTCGCGTCGCATTCGCTGATCGCCAGAGTTGTCCGTCTCTCGGTCCCG TGA | 8970 |
| hsa-mir-589 | 2 | MLSPSPSPLLPGACLLNDVGGG* | 8971 | ATGCTCAGTTCAGCCCCAGCCCTCCGTGGACCCCTGA | 8972 |
| | 3 | MTWGVGDGGKAISPEGLTTYPGILSQHSPNLGPMERKPA ASL* | 8973 | ATGACGTGGGGTGTGGGTGATGGAGGAAAAGCCATTTCACTGAGGACTTACGAC GTACCCTGGAATTCTTTCCCAACACTCCCAAATCTGGGTCCGATGGAGAAGCCCGGC CGGGTCCCTGTAA | 8974 |

Figure 1 (Continued)

| | | | | |
|---|---|---|---|---|
| hsa-mir-590 | 4 | MEEKPFHLRDLRRTLEFFPNTPQIWVRWRSPPRPCNVV QSIVSAERGAAGTLDSD* | 8975 | ATGGAGGAAAAGCCATTTCACCTGAGGGACTTACGACGTACCCTGGAATTCTTTCCC AACACTCCCAAATCTGGGTCCGATGGAGAAGCCGCGCCGCCCTGTAATGTGGTG CAAAGTATGTCTGCAGACTCTAGAGTCTGACTCTGA | 8976 |
| | 1 | MADFDTYDDRAYSSFGGGRG* | 8977 | ATGGCGGACTTCGACACTTACGACGATCGGGCCTACAGCAGCTTCGGCGGCGGCAG AGGGTGA | 8978 |
| | 2 | MARSETGRRRLGSRGLACGADPFHCLPPTTTCWFLPCL GRGGADARRRAPASSPFPPTVGPVRG* | 8979 | ATGGCGCGCTCGGAGACGGGGCGCCGGCTCGGCAAGCGTGTTGGTTTTTGCCCTGCCTT GGCCGCGGGACGCCCGGATRCTCGGAGACGAGCGTCCGCTTCCAGCCCATCCCCC TACGGTAGGACCAGTGCGGGRCTGA | 8980 |
| | 3 | MPGDIERPLPAPSPLR* | 8981 | ATGCCCGGAGACGAGCGCCCGCTTCCAGCCCATCCCCCTACGGTAG | 8982 |
| | 4 | MVRLLAGGGRPRR* | 8983 | ATGGTACGACTCCTTGCCGGCGGCGGRAGACCAAGGAGATAA | 8984 |
| hsa-mir-594 | 1 | MWTFVL* | 8985 | ATGTGGACTTTTGTTCTCTAA | 8986 |
| | 2 | MTYQRGK* | 8987 | ATGACGTACCAAAGAGGAAAATAG | 8988 |
| | 3 | MLCERVVCRSPSGLMDKALAS* | 8989 | ATGTTGTGTGAGCGCGTCGTTTGCAGAAGCCCAGTGCCTAATGGATAAGGCATTG GCCTCCTAA | 8990 |
| | 4 | MPTLLFFFLNGKCVCVFTSWWAAIPENLHTPMSFV* | 8991 | ATGCCAACTTTACTTTTTTTTCGAGAATGGAAGTGTGTGTTTTACTAGCT GGTGGGCTGCAATTTCGAGAATCTGCACACCATGTCCTTTGTCGA | 8992 |
| | 1 | MRASDPASPHGERGACGWPHFQQAAAWLVTSCPFHPVVS EHEJFHRSELCGYNFFSTRFHSVTQAGMQEYDHSSLQP* | 8993 | ATGAGAGCCAGCGACCCTGCACCCCATCGGTGACCCGTTCGACCCAGTGGTATC CATTTTCCAGCCAGGCTGCCTGCCAGAAGTGAATTGTGTGGATATAATTTTTAGCACAAG AGAACATGAGATATTCCACAGAAGCTGAATGCAGGAGTATGATCATAGCTCGCTGCAGCC GTTCACTCTGTCACACAGGCTGGAATGCAGGAGTATGATCATAGCTCGCTGCAGCC TTAA | 8994 |
| | 2 | MRYSTEVNCVDIIFLAQGFTLSHRLECRSMIIARCSLNS WAQAQGFSRPSLLSCWDYRLTPPHQANPFF* | 8995 | ATGAGATATTCCACAGAAGTGAATTGTGTGGATATAATTTTTAGCACAAGGTTTC ACTCTGTCACACAGGCTGGAATGCAGGAGTATGATCATAGCTCGCTGCAGCCTTAAC TCCTGGGCTCAAGTCAAGGGTTCCTCCCGCAGCCTCTGAGTTGCTGGGACTAC AGGCTTACACCACCACACGCCAGGCTAATTTTATTTTTATTTTTTAG | 8996 |
| | 3 | MYLFFVYFYFYF* | 8997 | ATGTATTTGTTTTTGTTTATTTTTTAG | 8998 |
| | 4 | MSACHHAWLLNRFAKASSNMYVISAPPHGSGLPCHSS MK* | 8999 | ATGAGCGCGGTGCCACCATGCCTGGCTATTAAATAGATTTGCTAAAAACAGCAACAAC ATGTATGTCATCTCGCCCCGGATCTGGCTTCCATGTCACCACGCAGTATG AAATGA | 9000 |
| hsa-mir-604 | 1 | MNFSVETAPPQSLFKKQK* | 9001 | ATGAACTTCTCCGTCGAAAACTGCCTCTCCCAGAGCCTGTTTAAGAAGCAGAAATAA | 9002 |
| | 2 | MPVDALTSKIFKGEVDTRY* | 9003 | ATGCCGGTGGATGCACTGACCTCAAAGTGAAGTGGATACACGTTAT TAA | 9004 |
| | 3 | MSKPLGHESP* | 9005 | ATGAGCAAGCCTCTTGGAATAATTGAATCACCTTAA | 9006 |
| | 4 | MGNERRKGKEMGWKEKSRRDRPIPVGLVP* | 9007 | ATGGGAAACGAAGGAGAAAGGGAAAGAAATGGGTTGGAAAGAAAAAGCAGAA GAGATCGCCCTATACCAGTAGGCTAGTACCCTAG | 9008 |
| hsa-mir-607 | 1 | MAQGRERDEGPHSAGGASLSVRCGVHGPATDLGLAEP PAPSPLLPPLPPVP* | 9009 | ATGGCGCAAGGTGCGGGAGTGCCGGGTTCAGGGCGCCAGCCGATCGGGTCTCGGGAACCTCC TGCCCAAGTGCCCTCCTCCCTCTCCTCCCCTGGTTCCTAG | 9010 |
| | 2 | MSRGPSPNQCPSLAFSTFKHTFNI* | 9011 | ATGTCTCGAGGTTCTCACCAAACCAGTGTCCTTTCCACCATCTTCA AGCATACCTTTAAATATTTAA | 9012 |
| | 3 | MFFLCASLSFTSTSFLLFSTFPICIFKSKIWPHTLHLCK* | 9013 | ATGTTTCTTTTGTGTGCTAGCCTTTCATTCACGTCGACTTCATTCCTTTATTTCTAC GTTTATCTGTATTTAAATCTAAAATGGCCACATACTCTTCATCGTGTAAATAA | 9014 |
| hsa-mir-609 | 4 | MATYSSSV* | 9015 | ATGGCCACATACTCTTCATCGTGTAA | 9016 |

Figure 1 (Continued)

| | | | | |
|---|---|---|---|---|
| hsa-mir-611 | 1 | MVRALRGVPDGDAKTPRGLTHTALISSDAGDPEG* | 9017 | ATGGTTGAGAGCGGTTGAGGGAGGAGTTCCAGACGGAGATGCGAGGACCCCTCGGGGTCTGACCCACACGGCGCTTATCTCCTCGGGGTCTGA | 9018 |
| | 2 | MRGPLGV* | 9019 | ATGCGAGGACCCCTCGGGGTCTGA | 9020 |
| | 3 | MNSLGPSARDF* | 9021 | ATGAACTCCTTAGGTTCTCAGCTCGCGATTCTAA | 9022 |
| | 4 | MPWANYYW* | 9023 | ATGCCCTGGGCAAATGTTATTGGTGA | 9024 |
| hsa-mir-612 | 1 | MRVKKGRGLVRDTVWVGVGVGNAG* | 9025 | ATGAGGGTGAAGAAGGGGAGAGGGTTGGTTAGAGATACAGTGTGGTGGTGGGGTGGTAGGAAATGCAGGTTGA | 9026 |
| | 2 | MQVEGNSLGLWGI* | 9027 | ATGCAGGTTGAAGGAAATTCTCGGGCTTTGGGAATTTGA | 9028 |
| | 3 | MPSHRQGKCLYQLPPGGQDSLFQRVVLFGVWVLSSELVT* | 9029 | ATGCCATTCACAGGCAGGGAAATGTCTTTACCAGCTTCCTCTGTTGCCAAGACAGCCTGTTTCAGAGGGTTGTTTTGGGGTGTGGGTGTATCAAGTGAATTAGTCACTTGA | 9030 |
| | 4 | MSLPASSWWPRQPVSEGCFVWGVGVIK* | 9031 | ATGTCTTTACCAGCTTCCTCTGTGGCCAAGACAGCCTGTTTCAGAGGGTTGTTTGTTTGGGGTGTGGGTGTATCAAGTGA | 9032 |
| hsa-mir-613 | 1 | MMSELYNTMKKIKTSN* | 9033 | ATGATGTCGGAACTATACAACACCATGAAAAAATTAAGACAAGCAACTGA | 9034 |
| | 2 | MLYT* | 9035 | ATGTTATATACATAA | 9036 |
| | 3 | MPVIPALLEAKAGGSLEPRSSRPAWAT* | 9037 | ATGCCTGTCATCCCAGCACTTTTGGAAGCCAAGGCAGGGATCACTTGAGCCTAGG | 9038 |
| | 4 | MTKPPLYK* | 9039 | ATGACGAAACCCCTCTTTACAAAATGA | 9040 |
| hsa-mir-615 | 1 | MSSYVANSFYKQSPNIPAYNMQTECGNYGSASEVQASRYCYGGLDLSITPPPAPSNSLHGVDMAANPRAHPDRPACSAAAAPGHAPGRDEAAPLNPGMYSQKAARPALEERAKSSGEIKEEQAQTGQPAGLSQPPAPPQJYPWMTIKLHMSHGKL* | 9041 | ATGAGCTCCTACGTAGCAATTCATTCTATAAGCAGAGCCCAATATCCTGCTATAACATGCAAACTTGTGGAACTATGGACATGGCTGCAGCATCCAAGTACTGCTACGGCGGATTGGAACTATGGACTTCCCACCCCGGCTCTCACCCGACCGCCCCGCCTGTCTCCAACGGCGGGTAGACATGGCCTAACATCACTTCCCACCCCGGCTCTCACCGCCCGCCTTCCAACTCCAGCGCCGCGGCCGCTCCGGACACGCTCCGGCACGGGACACGGGCTCTCGAACGCCGGATGTACAGTCAGGAGGAGGCGGCTCCGCCGGCTGGAGGACGGAGCTAAGAGCAGTGGGAGGAGTCAAAGAGGAGCAGGGCAACAGGGCAGCCTCCCCGACTGAGCCAGCCACCGGCCCGGCCACCAGATTTACCGTGGATGACCAACTGCACATGAGCCACGGTAAACTTTAG | 9042 |
| | 2 | MDRPQRCRHPGTATADWT* | 9043 | ATGGATCGGCCTCAGAGGTGCAGCATCCAGGTACTGCTACGGCCGATTGGACTTAA | 9044 |
| | 3 | MRGK* | 9045 | ATGCGCGGGCAAATAA | 9046 |
| | 4 | MARKTVH* | 9047 | ATGGCTCGTAAAACTGTCCACTAA | 9048 |
| hsa-mir-616 | 1 | MLKMSGWQRQSQNQSWNLRREASTDSHLPFTLPSPQSWGVRSLGSASLLHSEYRDRPREEWGESLJLGWCLQTPIASDDGVSPPLPGAGTRALLCAAGQRDLGCPWEJHSFP* | 9049 | ATGTTAAAGATGAGCGGGTGGCAGCGACAGAGCCAAAATCAGAGCTGGAACCTGAGGAGAGAGGCGAGTACTGACTCTTTAGGATCGGCCTCTTCCTCAAAGTTGGGGCGTCCGCTCTTTAGGATCGGCCTCTTCCTCACAGTGAAGTTAGGGACCGTCCGAGAGGAGAATGCGGAGGAGTCCCTTATTCTGGGGTTGGTGCTTACAAACCCTATTGCTTCGGACGACGGCGTCTCTCACCCGGTCCGGAGCGGGAACACGGGCCCTGCTCTGTGCTGCTGGGCAAAGGGACCTCGGTTGCCCTTGGGAATTCATTCTTTCCGGTAG | 9050 |
| | 2 | MGRVPYSGVVLTNPYCFGRRRLSTPARSRNTGPALCCWAKGPRLPLGNSFFPVANPRPHR* | 9051 | ATGGGGGAGGTCCTCCACCGTCCCTATTCTGGGGTGGTGCTTACAAACCCTATTGCTTCGGACGACGACGGCGTCTCCACCGGCTCCGGAGCCGGAACACGGGCCCTGCTGTTGTGCTGCTGGGCAAAGGGACCTCGGTTGCCCTTGGGAATTCATTCTTTCCGGTTGCCAACCGCCCCATCGTTAG | 9052 |
| | 3 | MATLVAGATGPCSG* | 9053 | ATGGCCACTTGGTAGCTGGGGCTACTGGACCTGCAGCAGGCGATAG | 9054 |
| | 4 | MDREWCVFLLP* | 9055 | ATGGACAGGGAGGGTGTTTTCCTTTGCCGTAG | 9056 |

Figure 1 (Continued)

| | | Protein | SEQ ID | Nucleotide | SEQ ID |
|---|---|---|---|---|---|
| hsa-mir-619 | 1 | MALVTLQRSPTPSAASSSASNSEVSPGLAAPGLGRRTPRRGRRSWGRACGAGGRLRGLLGAPP* | 9057 | ATGGCCCTGGTGACCCTGCAGCGCTCGCCACGCGCCAGCCCTCCTCCTCGGCCAGCAACAGCGAGGTGAGCCCCGGACTCGCCGCCCCCGGCCTGGGTCGCCGGAGGACGCCGGCCCGAGCCTGAGCCTGAGGGCCGAGCTGGGGCCGCCGCCGTGCGGGGACAGGGGCCGCTGCGGGCTCCTCGGGGCTCCCCGGCCGTAG | 9058 |
| | 2 | MQCDPSGSVCRILCVRCDPHQGVTPILG* | 9059 | ATGCAGTGCGACCCCTCTGGGAGTGTCTGCAGGATACTGTGTGCGCTGTGACCCACATCAGGGGGTTACCCCCATCTGGGGTGA | 9060 |
| | 3 | MCNWDP* | 9061 | ATGTGCAACTGGGACCTTGA | 9062 |
| | 4 | MPGCAM* | 9063 | ATGCCTGGCTGTGCGATGTGA | 9064 |
| hsa-mir-623 | 1 | MAATSSRLLVPPTQGGLRHVTLPFLAPPPTAVLDGRRSGERGRRPFCVCFLWDVVVAVGLGK* | 9065 | ATGGCTGCCACTCTTCTGCGCTCTTAGTCCACCACTCAGGGCGGGAGGTCTGCGTCATGTGACCCCTGCCCCTTCGGCTCCTGCCCCTCCTATCGCAGTGCTTGACGGAGGCGGAGCGGGAACGAGGCGTCGGCCCATTTTGTGTCTGCTTGTCTGGGACGTGGTGGTAGCCGTTGGGTTGGGAAGTGA | 9066 |
| | 2 | MGRKKKKQLKPWCWYPLSV* | 9067 | ATGGGTCGCAAGAAGAAGAAGCAGCTGAAGCCGTGGTGCTGGTATCCTTTGTCGGTTGA | 9068 |
| | 3 | MGFRGRQAFAVVGRVTL* | 9069 | ATGGGGTTCCGAGGTCGACAGGCTTTCGCAGTTGTGGGTCGTGTGACTCTGTGA | 9070 |
| | 4 | MEGWGQLHSLSPTFSVPIYFMCVLCLFFRIGGLVKNQVSQPWFRTFFFFFSGREEN* | 9071 | ATGGAGGGTTGGGGACAAGCTTCACAGTCTGTCACCACTTTTCGTTTTATTTACTTTATGTGTGTTTTATTTTACGAATTGGCGGTTTAGTAAGAACCAAGTTAGTCAACCCTGGTTTGAACCTTTTTTTTTTTTTTTCTTTTCGGGGCGGGAGGAGAACTAG | 9072 |
| | 1 | MEEGL* | 9073 | ATGGAGGAGGGATTGTAA | 9074 |
| | 2 | MAAAGSSLL* | 9075 | ATGGCGGCAGCGGCAGCTCCTCCTGCTCTGA | 9076 |
| hsa-mir-624 | 3 | MDELAGGGGGPGMAAPPRQQQGPGGGNLGLSPGGNGAAGGGGPPASEGAGPAAGPELSRPQQYTIPGLHYIQHEWARFEMERAHWEVERAELQVPRWGRCAGAAAAGFPAGGWGWGLHSAGAGALGGRAEPTCAAQVVMVLSTAFPGVPLPLSRISLLPNLHWLRGAGLLGAAHLAFSMASAGAPPEAAFPGLRGLGPSTSLWESPVWGLSTLSLLLFVPLEMKSPKRGTRIGILPPFSGPPPFFIWRIWPPFSDLVRACPLTATLLSWAARVHSDLGLTCEVLFPVNFKYFLT* | 9077 | ATGGACGAGCTTGCCGGAGGCGGTGGTGCGGGCCGGCCCCTCCCGGCAGCAGCAGGGCGCCCGGGAACCTGGCGTTCGCCGGGGGAACGGAGCGGCGGCGGCGGCGGCGGCTCCTCCGGAGGAGCGGGCTCACTGCACTCCAGCACGAGCTGTCCCGGCCAGCAGTACAGCTATCCGGGAGATACTGCACTAATCCAGCAGGAGTGGGCTCGGTTCGAGAGAGCGCATTGGGAAGTGGAGCGCGAGCTGCAGGTGCCACGGTGGGCGCTGCGGAGCGCCACTGAGGTAAGCGCGAGGTTCCGGCGGGAGGTACCTCGTTGGGGTCGGTGGGACTTCAGCATCAGCGGAGCCCACTCAGTCGCAGCGGCCTTGGAGGCCGAGCGGAGGACCTACCCTGTGCTTCCCGCATAAGCTTGCTCCCAACTTGCACTGGCTACGCGGTGCGGGCCTCCTCCGGAGCTCCCGGGGCAGCCATTTGGCTTTAGTATGGCGTCTGCTTTGTTCCTCTTGAGATGAAGAGCCCGAAGAGAGGGACTAGGATCGGAGATCCGTTGGGGCCTCCAACCTACAGTTGCTTCTCCTTGAGATGAAGAGCCCGAAGAGAGGGACTAGGATAGGCACTCCCCCCTTTCCGATTTGGCGTATCGGGAAGGCTCTTGCCCATTGGGCAGCTTCTGGGGAGCCCGAGACCACTCCCTTTCCCGACTGTCTGGGAGACCACTCCTTGCCTGACAGCCACCGCTCTTCCCATCGTCAACTTAAGTACTTCTCACCTGA | 9078 |
| | 4 | MLPYSLGFSVVIPYLVTHQRFQH* | 9079 | ATGCTGCCTTACTCACTGGGATTCTCTGTAGTTATTCCTTACTTAGTGACTCATCAAC | 9080 |
| | 1 | MAVLLKGL* | 9081 | ATGGCTGTGTTGTTGAAGGGCCTGTAG | 9082 |

Figure 1 (Continued)

| | | | | |
|---|---|---|---|---|
| hsa-mir-627 | 2 | MHDAFEPVPILEKLPLQJDCLAAWGEPRGRGAEAESAQ ERSGSFLRPGKWTGYHPCGLRLDATREGLRMREGREM TTGYRHRCLWGYLGDPSDPVI* | 9083 | ATGCACGACGCTTTCGAGCCAGTICGCGATCCTAGAAAAGCTGCCTCTGCAAATCGAC TGTCTCGGCTGCCTCGGCGTGAGCCGAGGGCCGCGGGGCTGAGGCGGAGTCAGCACA GGAGCGGTCCGGATCTTTCTGAGGCCGGGAAGTGGACAGGCGTCCATCCGTGTG GGCTTCGGTTGGATGCTACGAGAGGGGCTTAGGATGAGGAAGGCAGAGATGG ACCACCGGCTATAGACATCGATTCTGTGGGCTACTTGGTGATCCCAGTGATCCA GTCATTTAG | 9084 |
| | 3 | MLHERGLG* | 9085 | ATGCTACAACGAGAGGGGCTTAGGATGA | 9086 |
| | 4 | MSVGLLG* | 9087 | ATGTCTGTGGGGCTACTTGGGTGA | 9088 |
| hsa-mir-629 | 1 | MYPQGRHPVSNCRSVYLSIYHGRVNEAVYLAFPPCLLL PLWCVCLCVCSHTKGDAAGGRR* | 9089 | ATGTATCCGCAGGGCAGACATCCGTGAGTAATTGCAACTCGGTTTATTAAGCATC TATCATGGCAGGGTAAACGAGGCAGTTTATCTGCACCTCCATTTGCTTGTTGCTA CCTTATCGTGTGTTGTGTGTGTCTGCTCTCACACAAAGGGGGATGCGGCCGGG GGCGCCGTTGA | 9090 |
| | 2 | MVCVFVCVLSHKGGCGRGAPLREEVNSARVARGAACV PGGAVHAVPGPALKSPNSPGLSPAPALLGRGRPLVKGM GAPLPTCGRDGAPPLRPVGELRNLLGRFWAEGGLFWLGA VGEGRGPL* | 9091 | ATGGTGTGTGTGTTGTGTCTGTCTCACACAAAGGGGATGCGGCCGGGGGGC GCCGTTGAGAGAGGTTAATTCCGGCGAGTGGCGCGGGGGGCTGCTTGTGTC CAGGGGGAGCTGTTCACGGGGTCCCCCGGCCCCTCTGAAGTTCCCAACTCACCG GCTTGTTCCCCCCGCCCGCGACGGGGAGATGGGGCCCCCTTGGTGAAAGGCATG GGAGCCCGCGTGCCAGGGAGACTTGCTGGGAAGGTTCTGGGGTGGCCTCTTTGGTTGGGCGC CGTTGGGAGGGCGCGGGCCGGGGCCCGCTGA | 9092 |
| | 3 | MRPGGAVERGG* | 9093 | ATGCGCCCGGGGGCGCCCTCGCCGTTGAGAGGAGGTTAA | 9094 |
| | 4 | MGRPPSAPSES* | 9095 | ATGGGGCGCCCTCCAGCCCCCTCGCCGTCGAGAGCTGA | 9096 |
| | 1 | MAAAPALKHWRTTLERVEKFVSPLYFIDCNLRGRCGP WSPAAGRPQPCASSFPSGEKPKLQPPGPRIDKVPAAGRA GAGEEGVGNGLCRGAARQPSWRRIQCKCCGPTGQLAPR RKRGGLQHVPTGPSHAGFLGPAALWLCSPAS* | 9097 | ATGGCGGCTGCCGCGGGACGGCGCCARGCAGCCCTCTTGGGCRAGGATCCAGGAAAG GTTCGTGTCGCCGGCTCTACTTACCGACTGAACCTCGCCACCACTGCGCCACCACCCTCCTG CTCCCCCAGCACGCAGCCGCCACCGGAGCCACAAGTCTCCCGCCGGCCAGGGGAGAA ACCTAAGCTGCAAGCGCACCGCCGGGCTCGCCCGGCGGCCCGGCGCGGGCCCGGGAA GGGCCGGGGAGGAGGGGTAGGAGAAGTGCGCACCGGCGGCCCCAGGCAGGAAGG CTCTTTGCCGCRGGAGATCCAGGGAAAGTGCCAGCTGCCCCAGGCCCACCCACCCTCGTT GAAACGGGGCGCCTGCCCTGTGCCTCTGCCTCCAGCCCAGGGCCTCCAGG GGGCCAGCTGCCCTGTGCCTCTGTCTCTCCAGCTCCTGA | 9098 |
| | 2 | MDCAAERPGSPLCGGGSRESAAPPASWPPGGNGAASSM CPFARPTQAFWGQLPCGCALQLPDAGETSLFGGSPAGL PPRACGRRQLRTHVGNAQRVGGATGLGEVPTQLPATPSL SALCRRQLRGHEQHPLLGAAPSAGNSSLVPGSSGDGFHS HVAASGHPLGRAP* | 9099 | ATGGACTGTGCCGCGGAGCGGCCCARGCAGCCCTCTTGGGCRAGGATCCAGGAAAG TGCGGGGCGCAGCTGCCCTGTGCCTCAGGAGCGGCCTCCAGTCCAGCGGACTTC TCAGCTTCCTGACGCCGGAGGACTTCCTGCCTACCAGGAGCAGTCCAGGGACTTC TCAGCTTCCTGACGCCGGAGGACTTCCTGCCTACCAGGAGCAGTCCAGGGACTTC GGCCCCGCGCCAGGTCGRGACAGCTCGARCCGAACTGACCCGTAATGCCCAGCGGTG GTCTGCCCTGCCCTGAGACAACTAGGGATCGAGCAGCACCCCCTGCTGGGAGC AGCACCCTTGCTCGGCGGCCCTCTGGACATCGGACATCCGTCTTAGGAAGGCACCCTAG TTCCCACGTGGCGCCCTCTGGACATCGTCTGACTATCCTGGACATCCCTTAG | 9100 |
| | 3 | MVFIPTWPPLDIP* | 9101 | ATGGTTTTCATTCCACGTGGCCGCCCTCTGGACATCCCTTAG | 9102 |
| | 4 | MLGEFQAPADTLSKEGYQDRTSTSRPTTALLQMVDLL VPGGADHPRGMGGPGSSPLLGK* | 9103 | ATGCTTGGAGAGTTCAAGCCCCTCAAGGCCTTATCCAAGGAAGGATATCAGGAT AGGACTTCTACCTCTAGGCCTATGACCACTGCTCTTGCAGATGGTGGACCTGCTG GTTCCCGGTGGAGCTGAACCATGGCCATGGTGGGCCAGGAAGTTCAACCTTT GCTGGGAAAGTGA | 9104 |
| | 1 | MCSLYQPFQFLPGLSWKPDHRGDCAL* | 9105 | ATGTGCTCTCTCTATCAACCATTCCAATTCTTACCTGGCCTATCCTGGAAGCCTGACT TCAGGGGAGATTGTGCTTTATGA | 9106 |

Figure 1 (Continued)

| | | | | |
|---|---|---|---|---|
| hsa-mir-635 | 2 | MMETPW* | 9107 | ATGATGGAAACTCCTGGTAA | 9108 |
| | 3 | MEGDR* | 9109 | ATGGAAGGAGATAGATAA | 9110 |
| | 4 | MKTTCQQGASCLPECVTLSHATA* | 9111 | ATGAAAACCACTTGCCAGCAGGGGCCAGTTGTCTCCTGAATGTCACCCTGTCCCATGCCACAGCCTGA | 9112 |
| hsa-mir-636 | 1 | MSYGRPPPDVEGMTSLKVDNLTYRTSPDTLRRVFEKYGRVGDVVYIPRDRYTKESRGFAFVRFHDKRDAEDAMDAMDGAVLDGRELRVQMARYQRPPDSHHSRRGPPPRRYGGGGYGRRSRR* | 9113 | ATGAGCTACGGCCGCCCCCCTCCGATTGGAGGGTATGAACCTCCTCAAGGTGGACAACCTGACTACGGCCGACGTGTACATCCCGCGACACGTGAGGGCGGTCTTCGAGAAGTACGGCGCGGTCGGGGACGTGGTGTACATCCCGCGAGACCGCTACACCAAGGAGTCCCGGGCTTTCGCCTTCGTTCGCTTCACGACAAGCGCGACGCTGAGGACGCTATGGATGCCATGGACGGGGCCGTGCTTGACGGCCGCGAGCTGCGGGTGCAAATGGCGCGTTACCGGCCGCCCCCGGACTCACACAGCCGCCGAGGGCCCCACCCCAGTTACGGGCCGGGGTGGCTACGGACGCGAGCCGCAGGTAA | 9114 |
| | 2 | MWRV* | 9115 | ATGTGGAGGGTATGA | 9116 |
| | 3 | MPWTGPCWTAASCGCKWRATAAPRTHTTAAGDRRHPAGTGAVATDAGAAGKRG* | 9117 | ATGCCATGGACGGGGCCTGCTGGACGGCCGCCGGGGCCCGAGCTGCGGGTGCAAATGGCGCGCTACGGCCGCCCCCGGACTCACACAGCCGCCGAGGGCCCCACCCACGCCGGAGCCGCAGTAAAGGGGCTGA | 9118 |
| | 4 | MASGGERIMAAAWAGARGRPRCLELTPLCLLVPPAALGGVAAADPGVGVVPGLAADLATAARSLGPALVLDLGRPPSPDPHEGPSPSPRRSPDLVRGPGPGLGPGVLPQCPRGNPNPGRDRRKVPPSLLKRKERCPLKKMVMSGNPRHITLHKWDLG* | 9119 | ATGGCGTCTGGCGGCGAGATAATGGCCGCCGCCTGGGCGGAGCGCGGGCGCCCGCGCTGCGAGCTGACCCCTCTGTGCCTGCTGGTGCCCCCAGCCGCTCTGGGCGGCGTCGCAGCCGCTCGGAGTCCGGCACTCGCGTCTGATCTCGGTCGACCTCGCTACAGCGCCCGCAGTCGCTCCGAAGTCCGGAGTCGGAGCCCACTCAAGTCCAAGCTCCGGTCCAGTTCTCAGATCTCGCAAGTCAGATCGCACGCCGGTTCAGATTCGCGTCGAAGGAGTCCCCAGTGTCCAAGGGAATCCAAATCCAGGGAATTCTAAGAAGAAATGTAATGTCTCCCCAAGTGTCTCCAAGTGCCCAAGTGGTGTCTCTTAAGAAAATGGTAATGTCTGGGAATCCGAGACACATAACCCTAATCATAAATGGGATTTGGGGTAG | 9120 |
| hsa-mir-637 | 1 | MSTFRQEDVEDHYEMGEELGR* | 9121 | ATGTCCACGTTCAGGCAGGAGGATGTGGAGGACCATTATGAGATGGGGAGGAGCTGGGCAGGTGA | 9122 |
| | 2 | MRWGRSWAGELSARTAGHLQG* | 9123 | ATGAGATGGGGGAGGAGCTGGGCAGGTGAGCTGTCTGCCCGCACGGCTGGGCTCCAGGGATAG | 9124 |
| | 3 | MLRRNESVSCGGGTNLGRGVRQPRL* | 9125 | ATGCTGAGAAGGAATGAGTCAGTATCATGCGTGGGGAACGAATTTGGCCGTGGAGTCAGACAGCCCCGGCTGTGA | 9126 |
| | 4 | MSQYHAVGERIWAVESDSPGCEFLLGNPLCVSCGEKSN* | 9127 | ATGAGTCAGTATCATGCGGTGGGGGAACGAATTTGGCCGTGGAGTCAGACAGCCCCGGCTGTGATTCCGATGAATCCTCGTGTGTTCCTGTGGGGAAACCCCTGAGGGAAAAAGTAATTGA | 9128 |
| hsa-mir-639 | 1 | MVKPLLFSPSYRRSAPFDWSRKLIGQSPGASPSLGSDRPQGAGANVGASCPDWPTGRARPGGAGRTQSRV* | 9129 | ATGGTCAAGCCCCTTCTTCTTTAGCCCTCTACGGCGTTCCGCCCCCTTGATTGGTCTCGCAAGTTGATTGGTCAATCCCCTGGTGCATCCCTGGTGCTAGTCCTACCTCGTCTTGGTTGGGACCGGCCCAAGGAGCAGGGGCGAACGTGGGCGAAGTGGGCTCAGTGCCCTGATTGGCCGACGGGGCGCGGCGGCGCTGGAGGGCGGCGGACAGAGCCGCGTTAG | 9130 |
| | 2 | MKHYEVRSEKQGPCGHC* | 9131 | ATGAAGCATTACGAGGTAAGAGAAGGCGAGAAACAGGGCCGTGTGGCCACTGCTGA | 9132 |
| | 3 | MRMCAGSIYKSATQAVLGVLFLGGLCRGWDACRFLAAPPAG* | 9133 | ATGCGCATGTGCGCAGGAAGTATTTATAAATCTGCAACCCAGGCTGTTTTGGGGTACTTTTTCTTGGGGGTCTCTGCAGGGGCTGGGACGCTTCCTTGCAGGTTCCC | 9134 |
| | 4 | MGATKVRDPCSQSEGVLHKSCATPFSPA* | 9135 | ATGGGAGCCACGAAGGTGCGGGACCCTTGCTCCCAATCCGAGGGAGTCTTGCACAAATCTTGCGCCACGCCGTCACCAGCGTGA | 9136 |
| | 1 | MGGGRAPPESLGGCR* | 9137 | ATGGGGCGGGGAGGGTAGAGCCCCGCCGAGAGGGTGGCGGCCTGCCGGTGA | 9138 |

Figure 1 (Continued)

| | | | | |
|---|---|---|---|---|
| hsa-mir-641 | 2 | MVASGPPAVPRWAVPPVPGGGTAALEPLLQELSGGGR AGAVGPASGGRGHGHGPYH* | 9139 | ATGGTCGCGTCCGGACCCCCGCGCGGTCGTGTACCACCGTGCCGG CGGGGGGACCGGCAGCCCCTCCTGAAGCCCTCCTTCAGGAGCTGAGTGGGGTGGCCGAG CGGGGCGTGGGAACCAGCCTCGGGGACCGTGCCGCCGGGCCATACCA CTGA | 9140 |
| | 3 | MGCTTRARRGDRGPRAPPSGAEWGWPSGGGGTSLGGP GRWRRAIPLRRWGERCKFAGRGAQAAACAGRGLDLSG AAGRSSLACAG* | 9141 | ATGGGCTGTACCACCGTGCCGCCGGCGGGGGACCGGGGACCCCTCCTCA GGAGCTGAGTGGGGGTCGCCAGCGGGAACCACTCTCGGGGGCCGG GGCGGTGGCGGCGGGCCCATACCACTGAGGGGTGCGGGGAGCGCTCGAAGTTGCG GGACGGGGAGCGCAGCGCGAGCGTGCCAGCGCGGCAGCCTGGCGTTGCGGCGGCTAA GGCCGGCAGATCGAGCCTGGCCTGCGCGGCTAA | 9142 |
| | 4 | MLPQLWLGYITALGEPCLERRGTQIRGL* | 9143 | ATGCTTCCCAACTGTGGCTGGGTTATATCACCAGGCGTTGGGGGAGCCTGCTTA GAACGTAGGGGAACCCAAATCAGAGGACTGTGA | 9144 |
| | 1 | MSLSACFHLWLAAR* | 9145 | ATGTCTCTGTCTGCTGCGTGTTCTATCTCTGGTTAGCTGCTAGATAA | 9146 |
| | 2 | MLGKGCSTYSGLYLPPAGKVL* | 9147 | ATGCTGGGAAAGGGTTGTTCCACTTACTCTGGCTTTATCTACCCCAGCGGGGAAA GTTTTGTAA | 9148 |
| hsa-mir-642 | 3 | MCARKPGLGEWELGWAFQVLHQAVGTQMGVSSTPL GGTENLQVFQPHEKGSRLTVSTPSSPRRSPCSQESVGPD FGDIDTSAQRSSRATARSANTPPHLCCPNNSQGRPGN HLRGPAHHRSSTHSACLSLPDHAWELRERVRCLGVP RVYGSPAVCPCV* | 9149 | ATGTGTGCTAGAAAACCCTTTGGCTTGGAGAGTGGAGCTCGGATGGGCGTTTCA AGTTCTCCACCAGGTCTGTGACAACTTCAAGTTTTCAGTTCCCATAGAAAGGGCTTCAAGTACCCACTAGGAGG TACTACCCCTCCTCCTCCCAAGTGTGTCGTCTCCTAGGAGTCTGTAGGTCCAGA CTTCGGTGACACTGACATTCGCCCCAGCGTAGTCTAGGCAACCGCCGCTCAGC AACACCCCCCCCCTTCCACCCGAGGGCCCACCGAGTTCCACACAGTCCAGGAGGCCGGGAA TCACTTAAGGGCCCCCAGATCATCACGCTGGAGTTGCGGAGGCGGTGCGTCGGAGTCC CGCGTGTATAGCGTCCCAGCCGTTCGCCCTGTGTGA | 9150 |
| | 4 | MGVSSSPPGCGNSDGRFKYPTRGY* | 9151 | ATGGGCGTTTCAAGGTTCTCCACCAGGCTGTGGGAACTCAGATGGGCGTTTCAAGTAC CCCACTAGGGGTACTGA | 9152 |
| | 1 | MAWRYGATAAREFSPV* | 9153 | ATGGCGTGGAGATATGGCGCAACTGCGGCGCGTGAGTTTTCCTTTGTTAG | 9154 |
| hsa-mir-643 | 2 | MAQLRRVSFPLFRLSVRLAVPSRFCTRDVGGGTDLFIPA PLSPPRVNSCVPSEC* | 9155 | ATGGCCAACTGCGGCGCGGTCAGTTTCCTTTGTTAGATTAAGTTGCGTTAGCG GTGCCCTCACGCTTCGTACCCGGATGTGGGGCGTCAGTACAGACCTTGAAATCCCC GCACGCTCTCTCCACCCGAGTAAATTCATGCGTCCGTCAGAGTGTTAA | 9156 |
| | 3 | MWGAVQTLKSPHRSLHPE* | 9157 | ATGTGGGGGGCGGTCCGTCAGAGTGTTAAAATCCGCCTAAATCGCCTAG | 9158 |
| | 4 | MRPVRVLKSP* | 9159 | ATGCGTCCGTCAGGCTGACCCGGTAG | 9160 |
| | 1 | MVRLTR* | 9161 | ATGGTCAGGCTGACCCGGTAG | 9162 |
| | 2 | MSRNICVTEAET* | 9163 | ATGAGCAGAAACATTTGTGTAACTGAGGCAGAAACTTAG | 9164 |
| hsa-mir-645 | 3 | MSLNSSQFLS* | 9165 | ATGTCACTAATTCGAGTCAGTTTTGTCTTAG | 9166 |
| | 4 | MKPNFHKFSCPKEKFNELHLN* | 9167 | ATGAAACCAAATTTCATAAATTTCTTGTTTAAAGAAAAATTTAATGAGCTACATT TAAACTGA | 9168 |
| | 1 | MAAPPARADADPSPTSPPTARDTPGRQAEKSETACEDR* | 9169 | ATGGCTGCGCCCCGGCCCGCGCGACGCTGATCCTTCGCCACGTCGCCACCTACG GCCCGAGACACACCAGGCCGGCACGTTGAGGCAGAAACTTAG GGTAG | 9170 |
| | 2 | MLSARGVALPDPRGQGLGFGGAAAHGAFGLPRTRVAP SSLCGGFARA* | 9171 | ATGTTGTCGGCTCGGGTGGCCCTGCCCGACCCGCGCAGGGCTTAGGATTT GGAGGTGCTGCGGCGCACGGCACGTGCCTTCGGATTGCCTGCACGCGGCGTGGAGGACC AGCCTCTGCGGGGGCTTTGCAAGAGCATGA | 9172 |

Figure 1 (Continued)

| | | | | |
|---|---|---|---|---|
| hsa-mir-647 | 3 | MKWGSCGBAAGGTRPHPGSSPRVAPLGAGPCAAPLGP WPSGGRGHAVPGAARGRSGRCPSLPGLKCPLGSPRGPQ EGVVFPTQAPLAWVQAVTPVRNAVSQDSLRDGLRWMP QGEGCPGTGSLLSRSC* | 9173 | ATGAAGTGGGGAAGTTGTGCGGTGCAGCGGGAGGAACCCGCCCCACCCGGTTC GTCACCCCGAGTGGCCCCTCTGGGACCGGAGCCCTGCGCGCGCCCTTGGGGCCGT GGCCGGTCAGGGGCGCGTGACCCACGCAGTGCCGGGACTGCCAAGGGGCGCTGGG CGCTGCGCCCTCCCTTGTCCGGTCTGAAGTGTCCCTTGGGGAGCCCGCGGGTCCCAG AAGGGGTTGTTCCCACTCAGGCGCCTCTTGCCTGGGTTCAGGCTGTGAACTCCTGT AGAAACGCTGTGAGCAGGACTCCCTGAGAGATGGGCTGCGCTGGATGCCGCAGGG GGAAGGGTGTCCGGCACAGGGTCGCTCCTCTCCAGGAGCGTGCTGA | 9174 |
| | 4 | MGCCAGGCRRGKGYPAQCGRSSPGAAFQKELSPGPASLQV HTLPVGSD* | 9175 | ATGGGCTGCGTTGGATGCCGCAGGGGAAGGGTCCCGGCAGGGTCGCTCCTC TCCAGGAGCGTGCTGAAGCAGAAAGAGCTTTCCCGGCCCTGCGTCCTTCAGGTCCA CACCCTTCCAGTGGGCAGTGACTAG | 9176 |
| hsa-mir-657 | 1 | MPGWILQLRGFSGKQRPLLSRDPGS* | 9177 | ATGCCCGGATGGATCCTGCAGCTCCGTGGCTTTCTGGGAAGCAGGAGCCCCTGCTC TCAAGAGACCCTGCTCCTGA | 9178 |
| | 2 | MBPAAPWLFWEAAAPALKRPWLLMVAPRLPAGARDSG QFPRKGQAGSPSRGRVRKLGGAETLGP* | 9179 | ATGGATCCTGCAGCTCCGTGGCTTTCTGGGAAGCAGGAGCCCCTGCTCTCAAGAGA CCCTGCTCCTGATGGTGGCCCCAAGGTTGCCAGCTGGTGCTAGGGACTCAGGACA GTTCCCAGAAAAGCGACCAAGCGGCAAGCCCTCCCAGGGGCCGGGTGAGGAAGCTGG GGGGTGCGGAGGCACACTGGGGTCCCTGA | 9180 |
| | 3 | MAFP* | 9181 | ATGGCCTTCCCGTGA | 9182 |
| | 4 | MSGRGTGGEVSCPGGRRGAGGRRVRPGSRGRWRSSRG* | 9183 | ATGAGTGGACGGGCACAGGAGGCACAGGAGAAGTGTCCTGTCCTGGGGCCGGCGTGGGGC GGTGGGAGAAGAGTAAGGCCTGAAGCCCTGGAAGCCGGTGAGGGGAGCAGCCGT GGGTGA | 9184 |
| hsa-mir-658 | 1 | MSGPRLRPEAGSSAPLGPACKPEAPPRPLAI* | 9185 | ATGAGCGGCCGCGCGCTGCTCGCGAGGAGTGTCCTGAGGCCGAAGTTCAGCCCCACTCGGGCCTGC CGGGAAACCGGAAGCCCGTTCTCTACTAA | 9186 |
| | 2 | MEKPRLY* | 9187 | ATGGAGAAACCCGTTCGGGTA | 9188 |
| | 3 | MPVIPATREAEAGESLEPGIRRRLR* | 9189 | ATGCCTGTAATTCCAGCTACTCGGGAGGCAGGAGAGTCGCTTGAACCCGG GAGGCGAGGTTGCGGTGA | 9190 |
| | 4 | MLHKRWPASRVKEDSDTGA* | 9191 | ATGCTACACAAAAGATGGCGGCTTCTCGCGTGAAGGAAGATTCGGATACGGGGGC CTGA | 9192 |
| hsa-mir-659 | 1 | MSGPRLRPEAGSSAPLGPAGKPEAFPRPLAI* | 9193 | ATGAGCGGCCGCGCGCTGCGTCCTGAGGCCGGAAGTTCAGCCCCACTCGGGCCTGC CGGGAAACCGGAAGCCCTTTCCGAGGCCTTCTGCTACTAA | 9194 |
| | 2 | MEKPRLY* | 9195 | ATGGAGAAACCCGTTGCGGTGA | 9196 |
| | 3 | MPVIPATREAEAGESLEPGRRRRLR* | 9197 | ATGCCTGTAATTCCAGCTACTCGGGAGGCTGAGGCAGGAGAGTCGCTTGAACCCGG GAGGCGGAGGTTGCGGTGA | 9198 |
| | 4 | MLHKRWPASRVKEDSDTGA* | 9199 | ATGCTACACAAAAGATGGCGGCTTCTCGCGTGAAGGAAGATTCGGATACGGGGGC CTGA | 9200 |
| hsa-mir-661 | 1 | MVAGMLMPRDQLRAIYEVLFREGYMVAKKDRRPRSLH PHVPGVTNLQVMRAMASLRARGLVREIFAWCHFYWY LTNEGIAHLRQYLHLPPEYPASLQRVRRPYAMVMPAR RTPHVQAVQGPLGSPPKRGPLFTEEQRVYRRKELEEVS PETPVVPATTQRITLARPGFPPAPATGQLHFDFKS* | 9201 | ATGGTGGCCGGCATGCTCATGCCACGGGACCAGCTGCGGGCCATCTATGAGGTGCT TCTCCGCGAGGGCTACATGGTGGCCAAGAAGTACCGCCGCCCGCAGCTTGCACC CCATGTGCCGGGCGTCACCAACCTGCAGGTCATGCGTGCCATGCGCTCACTCACCA CAGGGGCGCTGGTCCGCGAGACCTTTGCCTGGTGCCACTTTTACTGGTACCTCACCA ATGAAGGCATGCGCCGCCGCCATCGCCAGTACCTGCACCTGCCCCCAGAGATCCGCCCG CCTCTCGCAGCGCGTGCGCCGCCCATACGCCATGGTCATGCCGGCCCGGACCCCG CCACGTGCAGGCTGTGCAGGGACCACTGGGCTCCCCCACCAAGCGTGGGGCCGCTG CCGCAGTGCAGCTCCTTACCGAGGAAGCTTCGAAGAGGTGTCACCTGA GACCCCTTGGTGCCTGCTACCACCAACGACCCTACCATTCAGCGTCAGGCGCCTGA CTGCCCCAGCGCAACAGTCAGCTGCACCCTGACCGACGCTCATGA | 9202 |
| | 2 | MRCSSARA* | 9203 | ATGAGGTGCTCTTCCGCGAGGCGTGA | 9204 |

Figure 1 (Continued)

| | | | | | |
|---|---|---|---|---|---|
| | 3 | MCPASPTCRSCVPWRPCGHGAWSARPLPGATFTGTSPMKASPTSASTCTCRQRSCPPLCSACAAPSPW* | 9205 | ATGTGCCCGGCGTCACCAACCTGAGTCATGCGTGCCATGGCGTCCTGCGGCACGGGGCCTGGTCCGCGAGACCTTGCCTGGTGCCACTTTACTGACCTCACCAATGAAGGCATGCGCCCACCTCCGCACTACTGCACTGCCGCCAGAGATCGTGCCCGCCTCTCCAGGCGGTGCGCCGCCCGTGCCATGGTGA | 9206 |
| | 4 | MMGGK* | 9207 | ATGATGGGTGGCAAGTAG | 9208 |
| hsa-mir-7-1 | 1 | MSWSYVALGTRDLVEERRPVRGEGRAAALFV* | 9209 | ATGAGCTGGAGCTATGTGGCACTGGAACTAGGGACCTGTGAGGAAAGGAGGCCGGTGCGGGGAGAAGGAGGACCTGTGCGGGGAGA | 9210 |
| | 2 | MWHWELGTSWRKGGRCGEKVAPPLSLCEPRLTLGLPARGRSWSGGDGTVRAASMALSRAVGGGCGG* | 9211 | ATGTGGCACTGGGAACTCGGAGACCTCGTTGTGAGCCCCGCCTCACTTGGGTCTCCCGGCCGGGGTCGGAGCTGGAACGGCGGGGATGAACGGTCAGGGCTGCCCTGGATGGCTTTGTCTCGGGCAGTGGGGAGGATGCGGGGGATGA | 9212 |
| | 3 | MERSGLPRWLCLGQWGEDACIDETSGPRGGWGRGSALGSA* | 9213 | ATGGAACGGTCAGGGCTGCCTCGATGGCTTGTCTCGGCAGTGGGGAGGATGCCGGGGATGAGAACCTCGGGAGCCGCGTGGTGGTGGGGAGGTGGGGGTCCGGCGCTCGGCTCCGGCTAG | 9214 |
| | 4 | MRGMRPRDRVVGGCGKGRRSAPPSST* | 9215 | ATGCGCGGGATGAGACCTCGGGACCGCTGGGTGGTGGGTGGCGGGGTGCGGCGCTCGGCTCCGCTAGTAGCACGTAG | 9216 |
| | 1 | MDVTSQLNLEREAGMGHENTERQPAEPESAGGGGSSRAQAGVPRDQCRPRGRTSRRLLSAPRGSQTRQPSGRTRRLLP* | 9217 | ATGGACGTGACCTCGCAGTAAACCTGAACGTGAAGCGGGATGGGGAAAACACGGAGCGGCAGGCCGGGTGCCAAGGGACCAGTGCCGCGCCACGTCGCCAGCCGCCGCCTTCTTTCTGCACCGGCGGCTCCAGACTGCGAGCTCGCCAGCTTCCGGCCGCACGCAGACTCTTGCCCTGA | 9218 |
| hsa-mir-9-2 | 1 | MRLGFENGRIMSARFNVMGVLCCVCVCMYYCVLGGACASEHRGRRSEQREISLSMATSGTHLRSHLGQQS* | 9219 | ATGCGCCTCGGTTCATTAACGGCAGGATCAATGAGCGGCGGTTTAATGTGATGGGAGTGCTGTGTGTGTGTCGGCGTCTAGTATGTGTGTTGGGAGGTGCTTGCGCTAGTGACGCACCGAGGCAGGCGCTCTGAGCAAGAGAATCAGTCAGGCCATCTAG | 9220 |
| | 2 | MYVCWEVLALVYSTEAGALSRERSVFPWPRLGLLGCGAI* | 9221 | ATGTATGTGTGTTGGGAGGTGCTGGCACCGAGGCGCTCTGAGCAGAGAGAATCAGTCTTCCATGGCCTAGTGAGCACCGAGGCAGGCGCTCTGAGGTCTGGAGACTCATCTGGAGCCATCTAG | 9222 |
| | 3 | MCVGRCLR* | 9223 | ATGTGTGTTGGGAGGTGCTTGCGCTAG | 9224 |
| | 4 | MYLIAKDFSTLFSYVFFNCKLLGF* | 9225 | ATGTATCTGAATAGCTAAGGATTTTCAACTTTATTCTCTTACGTATTTTCAACTGTA | 9226 |
| hsa-mir-92a-1 | 1 | MDGINCC* | 9227 | ATGGATGGAATTAATTGCTAG | 9228 |
| | 2 | MELIAVRRLEFNSKYRFGRW* | 9229 | ATGGAATTAATTGCTGTTAGGAGGTTGGAAAATAGCAAATAGATTGGACGGTGGTAG | 9230 |
| | 3 | MFYLFFPYTSLFQSYTWT* | 9231 | ATGTTTTTATCTTTTTTTCCCTATTCCAGTCATACACGTTGGACCTAA | 9232 |
| | 4 | MVEREGSGFHLHPFPPSLPPACLPGLSSSDPACSLVSDL* | 9233 | ATGGTGGAAAGGGAGGGGTCGGGCTTCATTTGCACCCCTTCCTCATTTGCACCCCAGCGTGCTCACTGGTCTCTGATTTGTAA | 9234 |
| hsa-mir-92a-2 | 1 | MLNSILIVRLKLRHHFILQSAVGLWP* | 9235 | ATGCTTAATTCCATTTTGATTGCGTCTTAACTAAGACATCATTTATTCTACAGAGCGCTGTCGGCGGCTTGGCCTGA | 9236 |
| | 2 | MRGESKHAPYLPHCACIRWLLPLTIPAKKP* | 9237 | ATGAGAGGAGAAAGCAAGATAATTGCACCGTATCTCCGCACATTGCGCGTGTATTCGGTTGGCTGCTACCGTTAACGATACCTGCCAAGAAACCTGA | 9238 |
| | 3 | MCRE* | 9239 | ATGTGCAGAGAGTAA | 9240 |
| | 4 | MELSGWGPEVCGRGTEVCGRGRWNVGGGVGHVLCGPLCT* | 9241 | ATGGAGCTAAGCGGGTGGGGTCCTGAGTATGTGGAAGGGCACCGAGGTATGTGGGAGAGGACGTTGGAACGTGGGGGGGGAGTTGGACACGTTCTGTGTGGCCGTTATGTACTTAA | 9242 |

Figure 1 (Continued)

| | | | | | |
|---|---|---|---|---|---|
| hsa-mir-92b | 2 | MWKGHRGMWERTLERGRGSWTRSVWAVMYLRGRSG VARWLTPVIPTLWKAEASCSGQGEKTSLAKMVKPRL Y* | 9243 | ATGTGGAAGGGGCACCGAGGTATGTGGGAGAGAGGACGTTGGAACGTTGGCGCGGCGA GTTGGACACGTTCTGTGTGGGCCGTTATGTACTTAAGAGGCAGAATCCGGCGTTGGCAC GGTGGCTCACGCGCCGTAATCCAACACTTGGAAGGCCGAGTGAGTTGGATAACAA GGTCAGGGGGTTCAAGACCAGCCTGGCCAAGATGGTGAAACCTCGTCTCTACTAA | 9244 |
| | 3 | MGFTDTELSFGEQSGCGDR* | 9245 | ATGGGATTTACGGACACAGAACTATCCTTTGGGGAGCAGAGTGTATTGGGGACAG GTAG | 9246 |
| | 4 | MRDSQEVCAAAVHEGRKLSQAAAARGTWVPQSQAAL* | 9247 | ATGCGTGACAGCCAAGAGGTTGTGTGCGCAGCAGTGCACGGAGGGAGGAAGCTATC CCAGGCCGCGGCAGCAGCGTTGGAACTTGGGTCCGCAGTTGCAGGCTGCGCTCTAG | 9248 |
| hsa-mir-93 | 1 | MANGWTGSSRPGRRNPEL* | 9249 | ATGGCCAATGGCTGGACTGGCTCCCGCCCTGGGCGGAGGAATCCGAGCGGAATCCGAGCTGTGA | 9250 |
| | 2 | MAGLAPALGCGHPSCEAAGHRAHVLLCLLRAEAMAGAG VGCGGGVRWRRSR* | 9251 | ATGGCTGGACTGGCTCCCGCCCTGGGCGGAGGAATCCCGAGCTGTGAAGCGGCTGG AATCCGGGCCCATGTGCTTCTTTGTTTACTAAGAGCGGATGGCGGGAGCGG GGGTGGGGTGCGTGCGCGGTGCGTGCGGAGGTCCGGTA | 9252 |
| | 3 | MCEFVY* | 9253 | ATGTGCTTCTTTGTTTACTAA | 9254 |
| | 4 | MLDGPVHCHGLFILRWLETDL* | 9255 | ATGTTGGATGCCCTGTGCACTGCCACGGCCTCTTTATTCTTCGCTGGTTAGAAACA GACTTGTGA | 9256 |
| hsa-mir-98 | 1 | MFTTLGIASPTLLLYCRGELQRSVGFIGALVRIFTVL* | 9257 | ATGTTCACTACCCTGGGAATCGCAGCCACCCTCCTCTTATACTGCAGAGGTGAAG TTACAGAGATCGTTGGATTCATGCAGCTCGTGTAAGAATTTTCACTGTGCTTAG | 9258 |
| | 2 | MFLSYTQIRYLFHFFVDYMCSLLGSAAFWGIPNYVNSS AHVFSNY* | 9259 | ATGTTCTGTCATACACACAAATAAGGTATTTGTTCCATTTCTTGTGGATTACATGT GTAGCCTTTTGGGGAGTGCAGCCTTTTGGGGAATACCAACTATGTCAATAGTTCTG CCCATGTATTTAGCAATTATTAA | 9260 |
| | 3 | MSIVLRMYLAIHCLMPST* | 9261 | ATGTCAATAGTTCTGCGCATGTATTTAGCAATTATTAAGTCTCATGCCAAGCACTTAA | 9262 |
| | 4 | MVGVQTTERV* | 9263 | ATGGTTGGTGTACAGAGACTAGAGAGGGTAG | 9264 |
| | 1 | MLPQLMVHQLSLA* | 9265 | ATGCTCCCTCAGCTAATGGTACCAACTTCACTGGCTTAA | 9266 |
| | 2 | MFQDPFFKNHLNVIFSSH* | 9267 | ATGTTTCAAGATCCGTTTAAAACATTATTTAAATGTTATTTTAGCAGCCATTAA | 9268 |
| hsa-mir-99a | 3 | MLFLAAINLYTLNYLIKLHAKSKSLFSFRYFIVQNLVASL TIAIVLSLSKLLL* | 9269 | ATGTTATTTTTAGCAGCCATTAATCTCTACACTCTTAATATCTTATTAAAGCTCCATG CCAAATCAAATCTCTTCAGCTTCGTACTTCATTGTGCAAAACCTAGTCGCTTC TTTAACAGCCATCGTCCTTCACTTGAAACTGTTACTGTGA | 9270 |
| | 4 | MPNPNLFSAFATSLCKT* | 9271 | ATGCCAAATCAAATCTCTTCAGCTTTCGCTACTTCATTGTGCAAAACCTAG | 9272 |
| | 1 | MAGTAGGRGEAAVRRRRGEDGERSAAVGPGLRARGG GEDPFPATREPREP* | 9273 | ATGGCGGGAACGGCGGGGGAGGCAGCGGTGCGTCGCGGACGCGGCGAGGCGGGGAGG AGGATGGAGAGCGGTCGGCGGCTGTGGGAGCCGGGCCTGAGGGCGCCGGCGGGAGGGG AGAAGACCCCTTCCGCTGCAGACGCGGAGCCGGAGCCCTGA | 9274 |
| | 2 | MESARRRWGPACGPGAAEKTPSLRRGSRGSRESAEREG GGLGPALLGP* | 9275 | ATGGAGAGCCGTCGACGCCGTGGGGGACCCGGGGAGCCGGGGGCCGGGGCCGGGGCCGG GGTGGGGGCTGGGGCGCCGCACTCCTGGGTCCCTGA | 9276 |
| hsa-mir-99b | 3 | MGAGAGRIVAGRD* | 9277 | ATGGGGGCTGGGGCTGGTAGGATCGTGGCTGGAAGAGACTAG | 9278 |
| | 4 | MGLRGFEGSRVSRASGRGPRRRGRLSGLPDRPGSAAGA GDVWRRRGPASMLPRGPGIPGPPRPLLPQIWEYTTQSPTH SRIRAPSPLFSRIQESEPPVCSLRPGNPHSSP* | 9279 | ATGGGGCTGCGGGGCTTTGAGGGTTCAAGGGTTGAGCCGTGCCAGTGGAGGGCC GAGGAGGAGGGGAGGTTGTCGAGGAGGAGGGCCTCCAGACACCGCAGGTGCAGCCGCGGGG GCAGGAGATGTCTGAGGAGGAGAGCCCAGCATCCATGCTCCCTGGGGACCCGG GATTCCAAGGCTGCAAGCCCCTCCTCCAGAATCGTGGGAGTACACCAGTCGCC CACCCATTCCAGAATCGCAGGAGCCCCTTTTTCCAGGATCCAACCACTGGAGCTGA GCCCCGCAGTGTCTCTCAGACGGAATCACACACTGCAGGAGAGTCTAA | 9280 |

Figure 1 (Continued)

| | | | | |
|---|---|---|---|---|
| hsa-mir-553 | 1 | MNQGF* | 9281 | ATGAACCAAGGTTTCTGA | 9282 |
| | 2 | MAGPRVEVDGSIMEGVSTERSGRGCSLTKEGSSHHRCAYFSSPCTPTFAGRPDPESLYGLIELSPRPPLAGAEDPSRPEHARPEVNLAGGGVGP* | 9283 | ATGGCGGGGCCGGCGGTGGAGGTCGAGCATCATGGAAGGGGTGAGTACAGAGCGAAGCGGCCGGGGCTCAGCTAACCTAAGGAGGGAGCTCTCACCACGGTGTGCTTACTTCTCTTCCTGTACCCAACCTTTGCAGGGCGGCCAGATCCTGAGAGTCTCTACGGCCTTGAGCTGTCTCCCTAGGCCTCCCTTTCGGGTTGCAGAAGATCGAGCCGGCCGGAGCACGGCCAGGCCTGAGGTAAATCTGGCTGGAGGTGGAGTTGGGCGTGA | 9284 |
| | 3 | MAASWKG* | 9285 | ATGGCAGCATCATGGAAGGGGTGA | 9286 |
| | 4 | MGDPGRGTLPGRWPGL* | 9287 | ATGGGCGATCCAGGGCGGGGCACTCTGCCTGGGCGTTGGCCTGGGTTGTAA | 9288 |
| hsa-let-7a-1 | 1 | MSLASNALRSFNFLQ* | 9289 | ATGTCCTTGGCCAGTAATGCCCTTCGGTCTTTCAACTTTTTACAGTAG | 9290 |
| | 2 | MPFGLSTPYSRFCVRGNGMYSSTYRFLKN* | 9291 | ATGCCCTTCGGTCTTTCAACTTTTTACAGTATCTGTGTCAGAGGTAATGGTATGTAGTTCTTCAACTTACCGGTTTTTAAAAAATTGA | 9292 |
| | 3 | MVCHLQLTGF* | 9293 | ATGTATGTATGTCTTCAACTTACCGGTTTTAA | 9294 |
| | 4 | MLKF* | 9295 | ATGTTAAAATTTTGA | 9296 |
| hsa-let-7d | 1 | MSLASNALRSFNFLQ* | 9297 | ATGTCCTTGGCCAGTAATGCCCTTCGGTCTTTCAACTTTTTACAGTAG | 9298 |
| | 2 | MPFGLSIFYSRFCVRGNGMYSSTYRFLKN* | 9299 | ATGCCCTTCGGTCTTTCAACTTTTTACAGTAGATTCTGTGTCAGAGGTAATGGTATGTATTCTTCAACTTACCGGTTTTTAAAAAATTGA | 9300 |
| | 3 | MVCHLQLTGF* | 9301 | ATGGTATGTATGTCTTCAACTTACCGGTTTTTAA | 9302 |
| | 4 | MLKF* | 9303 | ATGTTAAAATTTGA | 9304 |
| hsa-let-7e | 1 | MAGTAGGRGEAAVRRRRGEIDGERSAAVGPGLRARGGGEDPFPATREPREP* | 9305 | ATGGCTGGGACGGCGGGAGAAGGAGCCGCCGTCGTCGCGAAGCGCGGGAGAGGATGGAGAGCGCTCGGGGCGTGGGAAGCCGGTTGGGGGCCCCGGCTGCCCCGGAGCCTGCGGCCGGCCGAGAAGAAGACCCCTTCCCTGCAACGCGGACGGGTGGGCCTGCCGGCCCTGGGGCGGCCGGCGAGAAGAAAGGGAGGGTGTGGCGCTGGTAGGATCGGCTGAAGAGACTAG | 9306 |
| | 2 | MESARRRWGPACGPGAAEKTPSLRRGSRGSRESAEREGGGLGPALLGP* | 9307 | ATGGAGAGCGCTCGGGGCGTGGGAAGCCGGTTGGGGGCCCCGGCTGCCCCGGAGCCTGCGGCCGGCCGAGAAGAAGACCCCTTCCCTGCAACGCGGACGGGTGGGCCTGCCGGCCCTGGGGCGGCCGGCGAGAAGAAAGGGAGGGTGTGGCGCTGGTAGGATCGGCTGAAGAGACTAG | 9308 |
| | 3 | MGAGAGRIVAGRD* | 9309 | ATGGGCGCTGGCGCTGGTAGGATCGGCTGAAGAGACTAG | 9310 |
| hsa-let-7f-1 | 1 | MGLRGFEGSRVSRASGRPGPRRRGRLSGLPDRPGSAAGAGDVWRRRGPASMLPRGPGIPGPRPLLPQJWEYTIQSPTHSRIRAPSLFSRIQESEPPVCSLRPGNFHSSP* | 9311 | ATGGGGCTGCGGGGCTTTGAGGGTCAAGGTGAGCCGTGCCAGTGGGAGGGGGCCGAGGAGGAGGAGGGAGTGTCTGAGGAGGAGAGCCTCCCGAGCATCCAGGAGAGCCCGGGGGACCCGGGCAGGAGATGTCTGAGGAGACCCCTCCAGCCACCATGGGAGTACACACCAGCACCCCAGTCCCCGATTCCAGGTCCAGAATCCGAGCCCGTCCAGCCCCTTTTCCAGGATCCAGGAGTCTGACACCCCATTCCAGCACCCCAGATCTGTTCTCCAGACCAGGAATCCACACTCCAGCCCTGA | 9312 |
| | 2 | MSLASNALRSFNFLQ* | 9313 | ATGTCCTTGGCCAGTAATGCCCTTCGGTCTTTCAACTTTTTACAGTAG | 9314 |
| | 3 | MPFGLSIFYSRFCVRGNGMYSSTYRFLKN* | 9315 | ATGCCCTTCGGTCTTTCAACTTTTTACAGTAGATTCTGTGTCAGAGGTAATGGTATGTATGTTCTTCAACTTACCGGTTTTTAA | 9316 |
| | 4 | MVCHLQLTGF* | 9317 | ATGGTATGTATGTCTTCAACTTACCGGTTTTTAA | 9318 |
| | 5 | MLKF* | 9319 | ATGTTAAAATTTTGA | 9320 |
| | 1 | MKLTDSVLRSFRVAKVFRENSDKINCFDFSPNGETVISSSDDDSIVLYDCQEGK* | 9321 | ATGAAGCTGACCGACAGTGTTCTGCGGAGCTTCCGCGTTGCGCTAAGGTGTTCCGCGAAACTCGGACAAGATTAACTGCTTCGATTTCAGCCCCAAGGCGAGACGCGTCATCTCGAGTAGCGACGACGACTCCATCGTGCTCTATGACTGCCAGGAGGGCAAGTGA | 9322 |
| | 2 | MTARRASECGGGPGPESQCLPPVAQHRSLGLPSVPTSAPSLECTRSCQGRLRPAAVQEITFYFFLLKKKR* | 9323 | ATGACTGCCAGGAGGGCAAGTGAGTGCGGCGAGCCCTGGCCCTGGCCGGCCCTGTCCTCCCGAGTTCAGCCCCAGCCTATTTTGCACGCGTCTATTTGCACGCGCCGCTGCACCCACCGTCGGAGCCGCTTCAGGCGGAGAGGGCAAGTGA | 9324 |

Figure 1 (Continued)

| | | | | | |
|---|---|---|---|---|---|
| hsa-let-7g | 3 | MSSVSFERYASLAKPHLDLDL* | 9325 | ATGTCTTCGGTCTCCTTTGAGCGCTATGCATCACTTGCCAAACCCCACCTTGACCTTG ACCTTTAA | 9326 |
| | 4 | MHHLPNPTLTLTFKRPVRPPWAHQVAFSAPQAVKGAGL LRPRRRTAGAAPLPPSAAASALSCALSTVTSIPPWHSAHPL PLSFRPFCRQTAWVALLSCQDLFVVPL* | 9327 | ATGCATCACTTGCCAAACCCACCTTGACCTTTCAGCCTTTAAAGCGCGGTCGCCA CCCTGGAGCCCACCAGGTAGGCTTTCTGACCTTTCAGCTGTCAAGGTGCTGGTCTG CTCGGCCTTGACGCAGGACTCACAGGGCTGCTTTCTGCCTCTCGGCAGCGTCA GCTCTCTTGTGTCCTCTCCACTGTAACTCGATTCGCATTGCCGCCACTCGCCCATC CCCTGCCCCTCACGCTTCCGCGGCCCTTTCTGCCGCCAGAACCGCGGGTTGCACTTCT TAGCTGTCAGGATTATTTGTTGTGCCCTTTGA | 9328 |
| | 1 | MAARGAAWRGGHVVRSSARASLSDL* | 9329 | ATGGCGGCGCGGGGGGCGGCTGGCGGGGCGGGTCACGTGGTGAGGAGTAGCGCGC GAGCCCTCTAAGTGATCTCTAA | 9330 |
| | 2 | MPWLLFGGAGGSLCGMPAGDYRRRERAGGGFDSAAAR VGARVPDSAAAQPPPGTRSREGRERRSSSGRGGSS* | 9331 | ATGCCCTTGGCTCTGTTTGGCGGAGCCGGAGCCGGGATGCCCGGTGG CGATTATCGCGCGCCGAGAGCGGGACTCCAGCGGGGTTCGACACGGCGGCCGGGTGG GGGCCCGGGTACCGGCGGCGGCAGCCCAGCCCCACCGGGACTCGGAGCAGG GAGGGGCGGAGCGGCAGCTCGGCAGCGTGGCGCAGCTCCTAG | 9332 |
| | 3 | MALAEVVCAVGRVVTLPAVEITAQATALLVLVMLSA AEDNGWESPLFSGALPGDSPRSLGARPARPPRKPLVSHF PRRN* | 9333 | ATGGCCCTGGCTGAGGTAGTTGTGTGTGCGGGTTGTGTCTTGTGACATTGCCGCT GTGAGATAACTGCGCAAGCTACTACCTTCTGCGGTTTAGTCGTCGGTCGGGGCGCCG GAGGACAATGGCTGGGAATCCCCTTTGTTTCCGGGCGCTGCTCGGGGACAGCCG GCGAAGCCTCCGCCGCCGGCCCGGCCACCACGGAAACCGTTAGTTTCACATTT TCCTAGAAGGAATTGA | 9334 |
| | 4 | MAGNPLCFPGRCLGTAREASAPGRRGHHGNR* | 9335 | ATGGCTGGGAATCCCCTTTGTTTCCGGGACGTGCTCGGGACAGCCGGGAAGCC TCGGCCCGGCGGTCACGTTGTGCGGAGCTTGCTGGTCATTAG | 9336 |
| | 1 | MAIVTLWRALLRH* | 9337 | ATGGCGATCGTCACGTTGTGGCGAGCTTGCTGGTCATTAG | 9338 |
| | 2 | MQIAGRTKEGEPGTPGGAGGCCGGGRARGRRGAARGRA PAGGGLRGACGRARLGAQSVDVRVRARAPPWSSAGCCA PGPVSRRVGAGLGTREAVGRTERLRRGWPRRTRTRSRG ARPARHPHWGLGAGQAAPGAEGAPLPSA* | 9339 | ATGCAAATAGCGGGAAGAACAAAGGAAGGGGAGCCCGGGACCCCGGGGGCGAG GTGGGTGTGGGAGGCGGCGGTCGGGGCGCGCGCAAGGCTCGGGGCGCAG AGTGTGGACGTCGAGTCGGCCCCGTCGCCCCCGTGCGCCGGCGCGCGAGGCCGCC TCCCGAGCCGTCCGTCTCGCGGGACGCCCGCGAGCCCACGCCGGGAAGCCGTGG GCCACAGAGCGGTCGGCGCGAGCGCACTAGGCGTCTAGGCATCCGACTGCCAGCGCGT GGGGCCGGCCCGGCGGCGCCGCCCACTGCCCAGCCCTAG | 9340 |
| | 3 | MGISAVLRGPRWGVSGNAGSPGRLARPPEGSGAEGRG VCVNVAHSLFPRPRPRPGCWRGSLAVRRRL* | 9341 | ATGGGCATTTCCGCGGTTTTGCGCGGCCCTCGGTGGGTCAGTGGGCAACGCGGG GAGCCCCGGCCCTGGCTCGGCCCCGGAGGGAAGCGGCGGGAGGGGCGGGT GTGTGTAAATTGCGCACTCGTTTGCCGCTCGCAGGGAGGGAGGGTGCCAGGGTGC TGCCGTGGGTCCCTTGCCGCGGCGCAGGGACTGTAA | 9342 |
| | 4 | MLRTRFSPAPARVQGAGVGPLPSGGDCK* | 9343 | ATGTTCGCACTCGCTTTCGCGGCGCTCGCGGTTCCAGGGTGCTGCGTGGGT CCCTTGCCGCGGCGCAGGGACTGTAATAG | 9344 |
| hsa-mir-103-1 | 1 | MKIKDAKKPCKTGAGARQVGRAPLGPV* | 9345 | ATGAAGATCAAAGATGCAAGAAACCTGTAAGACGGGCTGGGCCCGCCAGGT TGGGAGGGCACCCTTGGGCCGTCTGA | 9346 |
| | 2 | MPRMPVRRGLGPARLLGGHPWAPSESPLAGRSASKPVAP RRRPVRYGGGGTT* | 9347 | ATGCCAAGAAACCTGTAAGACCGGGCTGGGCCCGCCAGGTTGGGAGGCACCC TTGGGCCCGTCTGAAAGCCCCTTGGCGTGGGGCCGGCCTTCCAAGCGCGTCGCTCC TCCGCCGGACGTTCGTCCGTATGGGGCGGGAGGGACCATTTGA | 9348 |
| | 3 | MGAEGPFEPRVRGFRPFPHPHHAW* | 9349 | ATGGGGCGGGAGGGACCATTTGAGCACGAGTTCGAGCCTCCGTCTCCCCATCCC CCTATTCATGCATGGTGA | 9350 |
| | 4 | MHRGECLPPPSLSSHFLFEIWEVPEGISDSDFCQTRLVSSP SSP* | 9351 | ATGCATGGTGAATGCCTGCCGCCCTAGCCTTTCTCCCCACTTCTCTTCGAGATCT GGGAGGTGCCAGAGGGAATTTCGATTCGATTTGTCAAACCAGACTAGTTCTCCT CTCCCAGCTCCCCCTGA | 9352 |

Figure 1 (Continued)

| | | | | | |
|---|---|---|---|---|---|
| hsa-mir-106a | 1 | MGQGGSECALARMPVAPAPATASAWAAVPGAPLIK DSSLGEERRENADCGPPVGNWGSVGFSLWRGGGSVS* | 9353 | ATGGGACAAGGTGGTAGTGAGTGCGCCATCCTGGCCCGATCCGGTGGCACCCGC ACCGGCTCCGGCCACGGCTTCTGCGGCCCTCTGGCCGGCGGCCTTAATTAA GGACTCCAGTTGGCGGAAGAGAAGGGAAAATGCGACTGCTGGTCCGCCCGTGG GTAACTGGGGCTCGGTGGGGTTTCCGTTTGGCGGGTGGGGTTTGCGTTTGGC | 9354 |
| | 2 | MPTAVRPWVTGARWGFFRFGGVGVPFPNSCAGRVGkG GLFSLGY* | 9355 | ATGCCGACTGCTGCGTCCGCCGTCGTCCGCCGTGCAACTGGGGCTCGGTGGGGTTT CCGTTTGGCGGGTGGGGTTCGTTCGTTCCTAATTCCTGTCGCCGTGCAACTCTTTGCT TTTTCCTTGGGCTATTAA | 9356 |
| | 3 | MCARGLDPFSGRFESLLFPEWLRGRLRSHPAPERSSCAL GHWVYVWRGHPERAARAGSPRSPPARGGPELGPARGF PSGWLGKKGALRWGSCDPVELTGWVGGDGAGGT* | 9357 | ATGTGCGCTGCGCTGGCGGCCTTGATCCATTAGTGGACGCTTTTCTCACTTCTCTCCCT TCTGCCTCCGCGGAGACTGCGTATACGTGTGGAGGGGACACCCGGAGGGCGGCCCTGCGGG CTGGGACACTGGGTATACGTGTGGAGGGGACACCCGGAGGGCGCCCTGCGGG CTCCCCGGCGCTCTCCACCTGGCACTGGAGCCTTCGTTGGGCAGCTGTGATCCG GTAGAGTTGACTGGGTCTGGGTGGCAGCGACGAGCGGAGTGGGACGTTGA | 9358 |
| | 4 | MRGCTWREKRDSPFSWLLSHQPGNGGGRRGLGAFLV L* | 9359 | ATGAGGGGGTGCACGTGAGGGAAAAAGGGACTCCCCTCCCTCTGGCTCTATCC CACCAAACCGGGAATGGAGGGAGGGCTGTGGGCTTGGCGCGTTTTTGGTGCT TTGA | 9360 |
| hsa-mir-106b | 1 | MANGWTGSRPGRRNPEL* | 9361 | ATGGCCAATGCTGGACTGGCTCCGCCCTGGCGGAGGAATCCGAGCTGTGTGA | 9362 |
| | 2 | MAGLAPALGGGIPSCEAAGIRAHVLLCLLRAEAMAGAG VGCGGGVRWRRSR* | 9363 | ATGGCTGGACTGGCTCCGCCCTGGCGGAGGAATCCGAGCGTGAAGCGGCTGG AATCCGGGCCCATGTGCTTCTTGTTTACTAAGAGCGGAAGCGATGGCGGGAGCGG GTGGGGGTGCAGTGCGGGGTGCGGTGCGGAGGTCCGGTGA | 9364 |
| | 3 | MCFFVY* | 9365 | ATGTGCTTCTTTGTTTACTAA | 9366 |
| | 4 | MLJGPVHCHGLFILRWLETDL* | 9367 | ATGTTGGATGGCCCTGTGCACTGCCACGGGCTCTTTATTCTTCGCTGGTTAGAAACA GACTTGTGA | 9368 |
| | 1 | MHSLQYPLASPPRKQFPVCEAALWTASPLVDPG* | 9369 | ATGCACTCTCTGCAGTATCCTCTAGCTTCTCCTCCCCGGAAACAGTTCCAGTCTCCG AGGCCGCCCTTGGCACTTGCCTCCCGGACTTGGATCGGACTGA | 9370 |
| | 2 | MHLGRKGITSQAPDHFALPKDDPGQLERWGVRTERHT* | 9371 | ATGCATCTAGGGAGGAAGAAAGGTACCTCGCAGCCCGCAGACCATTTGCCTTACCAAAA GATGACCCAGGCCAGTGGAAAGGTGGGAGTCAGGAGCGGAGGACGAGGCACACTAG | 9372 |
| | 3 | MTQASWKGKGESGRKGTPRGEVEGKCQPVWGYAS* | 9373 | ATGACCCAGGCCAGTGGAAAGGTGGAGTCAGCTGGGAGGACCTCTGA | 9374 |
| hsa-mir-10a | 4 | MIEDTLFRGSCRLVLRCMHLSNSTSFLFSESQGIPRREKG NPSQGEVGVWEAIFGRKGNRRKRTGCPHRRCSGPEAEAV TSRSCQ* | 9375 | ATGATAGAGGATACCCTATTTCGGGGCTGTCCTAGGTGCTGTCTTAGTGAGGAGCAT CTCTCTAATTCGTTTCTTTTCTTTGTTTCTGAATCCCAAGGGATCCAAGGAGGAGGA AGGAAAATCCTTCCCAGGGAGAGGTCACGGGTGTTCGTGGAGGCGCAATATTGGGCGGAAG GGAAACCGAAAGTGCACGGGTTGTCCGCACCGCGCTCTGGACCAGAGGCAGA GGCTGTAACATCCGGAGCTGCAGTGA | 9376 |
| | 1 | MDSLEKHL* | 9377 | ATGGACAGCCTTGAAAAGCACATCTTTAG | 9378 |
| | 2 | MGLALAHLEQDLGPGTPWRLRAWVNPICSAAQEN* | 9379 | ATGGGCCTTGCCCTTGCTCTCACTTAGAACAGGACTCTGGGTCTCGGACTCCTGGAGA CTCAGAGTCTGGTTAAATCCCATTTGCTCTGCAGCTCAAGAGAACTAG | 9380 |
| hsa-mir-10b | 3 | MRMSTPHHPTTLLSPLRSFQAFCGLHWALLAPGSRASD TLLK* | 9381 | ATGCGCATGTCTACTCCACACCACCACACCAACCACTCTTCTACCAGCACTTCGCTCATTTC AGGCCTTTTTGTGGGCTCCACTGGGCACTCCTCGCACCAGGTTCAAGAGCCAGCGACCA CCTTACTTAAATAA | 9382 |
| | 4 | MQSFVPLSPPPSLG* | 9383 | ATGCAGTCTTTGTCGTCCTCCCACCCACGGCTTCTCTAGGTAA | 9384 |
| | 1 | MAGTAGGRGEAAVRRRRGEIDGERSAAVGPGLRARGG GEDPFPATREPREP* | 9385 | ATGGCTGGGACGGCGGCGGAGAGCGGGAGGAGGGAAGGGAGCCGCCGTGGCGGCGAAGGCGGGAG AGGATGGAGAGCCCTTCCCTGCGACGCGCGAGCCGGGAGCCGTGA | 9386 |

Figure 1 (Continued)

| | | | | | |
|---|---|---|---|---|---|
| hsa-mir-125a | 2 | MESARRRRWGPACGPGAAEKTPSLRRCGSRGSRESAEREG GGLGPALLGP* | 9387 | ATGGAGAGCGCTCGCGCGGTGGGCCCGGCCTGCCGGCCTGCCGGCGCGGCGGAGA AGACCCCTTCCCTGCGACCGGRAGCCGCGGAGCCGTGAGTCTGCGGAAAGGGAG GGTGGRGGGCTGRGGCCGCACTCCTGAGTCCCTGA | 9388 |
| | 3 | MGAGAGRIVAGRD* | 9389 | ATGGGGGCTGCGCGCTGGTAGGATCGTCGCTGAAGAGACTAG | 9390 |
| | 4 | MGLRGFECGSRVSRASCGRGPRRRGRLSGLPERPCGSAAGA GDVWRRRGPASMLPRGPGIPGPRPLLPQIWEYTTQSPTH SRIRAFPSLFSRIQESEPPVCSLRFGNPHSSP* | 9391 | ATGGGGCTGCGCGGGCTTTGAGGGGTCAAGGGTGAGCCGTGCCAGTGGGAGGGGCC GAGGAGGAGGGGAGGTTGTCTGRGCAGGTTGTCCAGACAGGTCAGRGTCAGCGGCGGGG GCAGGAGATGTCTGAGGAGGAGGAGCCAGCATCCATGCTCCCTGGGGACCCGG GATTCAAGGTCCAGACCCCTCCTCCCTGCAGATCGGGAGTACACCACCAGTCCC CACCCATTCCAGAATCCGAGCCCGCCAGCCCCCTTTTCCAGGATCCAAGAGTCTGA GCCCCAGTCTGTTCTCTCAGACCAGGGAATCCACACTCCACTCCAGCCCCTAA | 9392 |
| hsa-mir-125b-2 | 1 | MYSLRRMGLRDGGHMLMSFLWRGEHSDNWLNAM VKNCKAFSFREKHGLRSKGCFHFSLFVSAAFLFWFLEF NYLF* | 9393 | ATGTATTCCCTAAGGAGGATGGGTCTCCGTGATGGGGHTGTATAATTATGTTAAG TCATTTTATGGAGGGTGAGATTTTCATTCGTATAATTGGTTGAATCGTATGGTCA AAATTGTAAAGCCATATTCAGTTTAGGGAAAAGCATGACTTAGATCTAAGGCT GTTTATTATTTCGCTTTTTGTGAGTGCTGCTTTTTGTTTTTTGTTTTTGTTTTTA ACTATTTATTTAA | 9394 |
| | 2 | MGVV* | 9395 | ATGGGCGTGGTATAA | 9396 |
| | 3 | MLWSKIYKPYSVLGKSMDLDLRAVLFFREL* | 9397 | ATGCTATGGTCAAAAATTGTAAAGCCATATTCAGTTTTAGGGAAAAGCATGGACTTA GATCTAAGGCTGTTTTATTTTCGCTTTGTGA | 9398 |
| | 4 | MGMQMINRKRSYIMMHYIMEQNI* | 9399 | ATGGGGAAATCAAATTGATAAACAAGAAGAGATCTTATATAATGATGCATTACATCATG GAGCAGCAGAATATTTAA | 9400 |
| hsa-mir-136b | 1 | MEPAGEGPPRGAGSSGRGPGGRRWPGSSSV* | 9401 | ATGGAGCCAGCGGAGGGCCGAGGGCCGCCACGAGGCGGCGAGGTCGTCGTCTGGACGGGGAC CCGGGGCAGACGATGGCCGGGATCTCTTCCGTTCA | 9402 |
| | 2 | MAGRLFRLTLRVLTGPWAEGMSA* | 9403 | ATGGCCGGGATCTCTCTCCGTCTAACCCTCGTCGTCCTGACCGGCCCTGGGCGGAA GGGATGTCTGCGTGA | 9404 |
| | 3 | MLEKNPECT* | 9405 | ATGTTAGAAAAGAATCCAGAGTTGTATCTAG | 9406 |
| | 4 | MESSARRGASSRGAALFLLEPRAESGRRVVGLYPPRS GR* | 9407 | ATGGAGTCGTCAGCTAGAAGGGGCGGTCGTCCCGGGGTGGGCGCCGCCCTTTTCTC CTGAGCCGCGGGCCGAGTCAGGCGCCACGGTCGTCGGCCTGTACCCACCCGGCTC CGGGCGCTAG | 9408 |
| hsa-mir-132 | 1 | MFWIHLTHSLSHVSP* | 9409 | ATGTTCTGGATCCATCTTACCCACTCCCTCTCCCACGTGTCCCCATAG | 9410 |
| | 2 | MSPHSHLTLEAVRSQRGKRRPPELPVSREGPRHLARGT CCGLRWKLRSVEGRWRGSS* | 9411 | ATGTCTCCGCAGTCCCATAGCACTCTCACTTTAGAAGCAGTGAGGTCCAAGAGGAAAACGG AGGCCTCCGGAAGTCTGCCGGTCTCTAGAAGGCCGGACATCTCGCCGAGG CACGTGCTGCGTGGCCTGAGGTGAAGTTACGGCAGGTGGAGGTGAGGAGGCT CCTCATAA | 9412 |
| | 3 | MNRSSSTEQEGICE* | 9413 | ATGAATAGGAGTTCTTCTACCGAGCAGGAAGCATTTGTAATAA | 9414 |
| | 4 | MQGLSDPISHFSLFDRVRSPTHDFQRAPPPHVSCAVESV HC* | 9415 | ATGCAGGGGCTCTCTGACCCCATCTCTCATTTCTCTTTTGATAGAGTCAGAT CCCCCACCCACGTCCGACTTCCAAAGAGCCCCCTTCCACTTCTTGTCACAGGTGGAGT CGTGCATTGCTAA | 9416 |
| | 1 | MHLIFLPPSQYLAKGSHCGHYNHDNFPLTAPLKNKILAQ ED* | 9417 | ATGCATCTAATCTTCTTCCTCTCCCATTCTCCCAGTTCTTGCTAAAGGATCACACTGTGAA TCTACAACCATGACAACTTCCACTTACTGCTCCCTTGAAAAACAAAATATTAGCAC AAGAAGATTAG | 9418 |
| hsa-mir-135a-2 | 2 | MITFHLLLP* | 9419 | ATGACAACTTTCCACTTACTGCTCCCTTGA | 9420 |
| | 3 | MLSLRSPQ* | 9421 | ATGTTGTCTTTGAGAAGCCCTGGTTGA | 9422 |
| | 4 | MGELSNIKAAKIREFLLC* | 9423 | ATGGGCATTCTCTGAATATTAAAGCGGCAAAAATACGTTGAATTCTTTTATGTTAA | 9424 |
| | 1 | MGARDLQLFRRDPGPEAA* | 9425 | ATGGGAGCCAGGGATCTGCAGCTTTTCCGCAGGGATCCTGGGCCTGAAGCTGCCTGA | 9426 |

Figure 1 (Continued)

| | | | | |
|---|---|---|---|---|
| hsa-mir-141 | 2 | MMEAPVPVSATSHASGPQPLAGCSPLPTSHAPRKPLVLS* | 9427 | ATGATGGAGGCCCCTGTCCCTGTCGTCAGCAACATCCATGCCTCAGGTCCCCAGCCC TTAGCTGGCTGCAGCCCCACTTCCCACGCACCCCGGAAGCCCCTCGTCTTG AGCTGA | 9428 |
| | 3 | MGPSPSSHPVRFVTWWIQNPQSTLSLGLARPLSRDLTW PVARVPCSNW* | 9429 | ATGGGCCCCAGCCCTTCCTCCACCAGTGCGATTTGTCACTTGGTGGATCAGAAC CCACAGTCGACTTGGGTTGGCTGCCCCCTCTCAAGAGACCTCACCTGG CCTGTGGCCAGGGTCCCCTGTCCCCTGTAGCAACTGGTGA | 9430 |
| | 4 | MAPGWVLSAVTPREP* | 9431 | ATGGCCTCCCGGTGCAGGGTTCTCTGGCAGTAACCTTCAGGAGCCCTGA | 9432 |
| hsa-mir-148a | 1 | MERWRGVWGKMGKHPPDLLHARNSCSGAVCGGRGSA RMGDRVVAYAAGKRGCREGEKSSLGDCVQGCARTGS AGSTA* | 9433 | ATGGAACGGTGGCGAGGGGTTTGGGGAAGATGGGAAAGCACTTTCCAGACCTGTT GCACCGCGCAACAGAGTGGTCGCTTATGCTGCAGGGAAGATGGGGGAGGGGTCTCTAGGA TGGGGACAGAGCAGTCTTGGGGACTGGTGTCGCTTATGCTGCAGGGAAAAGGGGGTGCCGGGAGGGGGA GAAGAGCAGTCTTGGGGACTGTGTCGCAAGGTTGTGCGCGAACGRGGTCCGCGGGAA GCACTGCCTAA | 9434 |
| | 2 | MWGEGVC* | 9435 | ATGTGGGGGAGGGGTCTGCTAA | 9436 |
| | 3 | MLQGKGGAGRGRRAVLGTVCKVVPERGPREALPNGA GRIPKSGWVERRGWDFDPSSRGWARAAGRPGIEYWE WLGKGVSGEAPQSGSFLGRPHLGAFPGPVFVPHRLILSA PNIRPRAAPPPPAFQMCR* | 9437 | ATGCTGCAGGGAAAAGGGGGTGCCGGAGGGCGGAGAAGAGCAGTCTTGGGGACTG TGTGCAAGGTTGTGCGCGAACGGGGTCCGCGGGAAGCACTGCCTAATGGGGCAGGG AGAATCCAAAGAGTGGGTGGCTGAAACGGAGGGATGGGACGACTTCGACCCGA GTTCCCGGGGCTGGGCCGGGCGGTCGAGGGAGCCCCGCAAAGCGGGTCTTTCTTGGTCGTC CTGGGAAGGGGGTCTCAGGGAGGCCCTGTATTTGTTCCAACGTTTAACTCTTTCAGCT CATCTTAGGGGCTTTCCGGGCAGCCCTGTATTGTCCAACGTTTAACTCTTTCAGCT CCGAATATTCGTCCTGTGCAGCCCCCCAGCTTTCCAGATGGGAAGGTAA | 9438 |
| | 4 | MGQGESQRVGGWNGGDGTTSTRVPGAGRGRLEDRE* | 9439 | ATGGGGCAGGGAGAATCCCAAAGAGTGGGTGGGTGGAACCGAGGGGATGGGACGA CTTCGACCCGAGTTCCGGGGCTGCGGCCGGCGGTCGTGGAAGACCGGGAATAG | 9440 |
| hsa-mir-148b | 1 | MEALILVGAGGAAEMLWCPQGPGVRVQPEWETGKESS G* | 9441 | ATGGAGGCGCTGATTTTGGTAGGAGCTGGAGGCGCAGCAGATGCTGTGTCC ACAGGGCCGGAGTCAGGGTTCAGCCGAGTGGGAGACGGGGAAAGAGAGTTCC GGGTAA | 9442 |
| | 2 | MDSLGYTDL* | 9443 | ATGGACTCCTTAGGATACACAGACCTGTAG | 9444 |
| | 3 | MFCRYRLLLMVSQY* | 9445 | ATGTTTTGTCGTTACAGACTCCTCGATGGTTCCAAGTTTGA | 9446 |
| | 4 | MDCGIFFLDSLFCSPFLYPFRP* | 9447 | ATGGATTGTGGAATATTTTTCTAGACTCCTTATTCGTTCTCCTTTCTCTACCCATT TAGACCTTAG | 9448 |
| hsa-mir-149 | 1 | MVAGGLRADGRGVGRGGKHDGVSLGAVDAVDEELRC RGRSTSQVGPRLPLAQTSGAQADRDWPGAQAS* | 9449 | ATGGTGGCGGGGGGGCTTCGGGGCAGAGGAGGGGGTGTGCGCAGGGAGGGAAGC ACGATGGGGTGAGTCTGGGGCGCTGAGCCGTTGACGAGGAGCTGAGATGCCGT GGCCGGTCCACCTCGCAGTTGGGCAAGGCTGCCTCTGGCTCAGAGCGTCAGGAGC CAGGAGCGGACAGGGACTGGCCAGGGGCGCAGGCTTCTTAG | 9450 |
| | 2 | MPLTRS* | 9451 | ATGCCCTTGACGAGGACTGA | 9452 |
| | 3 | MPWPVHLAGGAKAASGSDVRSPGGQGLARGAGFLEDG AKVPKKRSSAAWAVGGPQETPWVVCFVHHPRRLLDVP EDATATGAGWGPRADGPGAGAGFEKRVRAWGKPSQPS ASQEGPVAGCRAE* | 9453 | ATGCCGTGGCCGGTCCACCTCGCAGGTGGGGCCAAGGCTGCCTCTGGCTCAGACGTC AGGAGCCGGGAGTCCGACCAGGGACTGGCCAGGGCGCAGCTTCTTAGAGGATGGGG CAAAAGTGAGGAAAAGATCCTCGCAGCCTCTGCAGCCTGGCAGTGGGTGGTCCCCAGGAAACC CCCTGGGTCGTTTGTCAGTGCAGTCACCCTGCGGTCCGAGGAGCCTGCTGACGTGCCGAG GATGCACAGCCACGGAGCTGTTGCGGTCGAGAGCAGAGATGGGCCAGGGCTGG GGCAGGCTTGGAGAAGCGGGTTCGCGGTTGGGGAAAGCCTTCCAGCCATCGCCA GCCAGGAAGGCCCCGTTGCCGGGTGCAGAGCTGAGTAG | 9454 |
| | 4 | MGQK* | 9455 | ATGGGGCAAAAGTGA | 9456 |

Figure 1 (Continued)

| | | | | |
|---|---|---|---|---|
| hsa-mir-152 | 1 | MQRPEAGHVRTRGRGPRRQAGGRRRLLEPGSPRGCGY GAGGRGDPGRRELGRDRAGLGGAANSELARPAAGNFV SPLTGPRTREEKFVPAPTGEEACPESVGAGLKPWVRLE WGWRVSCDSAGRVRSGLSVPDSAPITGG* | ATGCAGCAGGCCGAGGCTGGCCACGTCCGCACGTCGGGGAGGGGCGCGGGCACGGCCGGGGGAGCCCGCCGGGGATCCCGGGAGCCGGAGCTGGCAGGGACAGAGGAGGGAGGGGGAGCAGCCAACTCAGAACTCGCGCCGCGGCCCGGCCTGGAACTTTGTGTCACCCCTGACTGGCCCCCAGGACCCGGGAGGAAAAGTTCGTCCAGCGCCGACCGGAGAGGCCTGTCCTGAGTCCGCGCGCCGGATTCCGCGGGAGGGCTGAAGTTCTGGTCCGTTGGATGGGGGTGGCGGGTGAGTTGCAGGGGTAAGGAGTGGCCGTCCGTCCCAGACTCCGGCTCCCATCACCGGTGGGTGA | 9458 |
| | 2 | MGMLLESTRARAWGRADSAGPARPGISWKKEARPAVP PGRGSVIHSDSGSGAVSA* | ATGGGCATGCTCTTGGAGTCTACCGGAGCACAGGCTCAGGGCAGGGCCGATAGCGCAGGTCAGCCGGCCAGGGATCAGCTGGAAGAAGAGGCTCGAAGGGGCTGTCCCCCCGGCCCAGTTCTGTGATACACTCCGACTCGGCTCTGAGCAGTCAGTGCATGA | 9460 |
| | 3 | MTELGPGRTFCTQRAQPLGACSGTSAWEWSGHLGWP MWHRAGQNQLWTLRTGVAGA* | ATGACAGAACTTGGGCCTGGAAGGACTTTCTGCACCAACGGCACACGGCCACTCCGGGCTCAGTGGAAACATCTGCCTGGAGTGGAGTGGGCACTCGGGTTTAGCCCATGTGCACAGGGCTGGGACAGCCAGCTGTGACCTTGAGGACTGAGGACGTGGGGTTGCTGGGGCCTGA | 9462 |
| | 4 | MYPRASKSRHRHVSTSSXQPNGTLLSGVSCRNLPSTPSR LPSS* | ATGTATCCTACGGCCAGCAGGATCCCAGCAGACACAGGTGTCCACCTCGAGTCAGGGCCAAACGGAACTCTCCTCCGGTCAGTTGCAGGAACCTTCCCTCTACCATCAAGGCTGTTTTCATCCTAG | 9464 |
| hsa-mir-153-1 | 1 | MGGGGAGVRPPLGLEPRVGPGASASDFWPPAPDPTLPP LKAGLRLRLCPSPSLHHPRGPAPRRPLLCSLPLTLPGLA PSPPPASSRGPSAFCLPSLSRTPASFLLPVPSCPAVSRPCT ALPCCPLRLSLPPARLPSFIPLRPSFIPLRLFASFFCVFHSF SFPLSSSSLSPSLSHSVSASPPFSLSTSPSPRPFSSFLSALSPV FLRLLPLSASFSLLLCPSLPLPPAACLSSLSSLLPSFSL SLTAASVFFVICS* | ATGGGCGGGGAGGGAGCCGGGTCCGGCCTGAGCCCCGGGTCGGCCTGAGCCTCGGCTGCACCCCTCTGAGCGCCGACTTCTGGCCGCCAGACCCAACGGCCTGCCGCCCTCTGCCCGAGCCTGACCCTCCACCGCGCTAAAAAGCAGGCCTGAGGCTGAGCCTGCCTTCCGCCCTTCTGCTCCTCCGGGCTGCTCCCTCTCCAGGGCCCTCTGCTTCCTCTGTCTCCCGACTGCACTCCCAGGACCCTGGTGCTCCTCAGTTCCGTCCGCCTCAGTGTCCAGGCGGCCCTGTCCTCAGGCCTGCACTGCGTCCTCGGGTCCTCCCTCCTTCATCCTTTCGTGCCAGTCTCCCCATCTCTCCTCACTCGCTTCTCGTCTCCACCCTTCTCCACCCTCTGCCAGTTCCTGCTCCCCTGTCTCTCGCGCGCGCGCCAGGTCTCATTTCTGTGATCTGCAGTAG | 9466 |
| | 2 | MDRQDMWPGDHPELGARGTGKRQRLSKGVWEDLWIL GGSVEQVGTRQGLPEGLTLFQH* | ATGGACAGACAGGACATGTGGCCGGGAGACATGGAGGGACCTGGGGGCAGAAGAGGCAAAGACTGTCGAAAGGAGTGTGGAGGAATCTCGGATTCTGGGGGCTCAGTGGAGCAGGTGGGGACTAGACAAGGGCTACCTGAGGGACTTACCCTTTCCAACACTGA | 9468 |
| | 3 | MSLGTGQRSRAGGGDMGIVSEPQDSSF* | ATGTCTCTAGGTACTGGACAGAGGAGCAGAGGGGATGGGGATCATGGGATATGGTATAGTTTCTGAACCTCAGGACAGGACAGTTCTAA | 9470 |
| | 4 | MDLF* | ATGGATCTCGTTTAA | 9472 |
| hsa-mir-15b | 1 | MAPFPKSRCL* | ATGGCTCCCTTCCCGAAGTCCCGATGCCTCTAA | 9474 |
| | 2 | MPRKGTQPSTARRREEGPPPSPDGASSDAEPEPPSGRT ESPATAAGE* | ATGCCCCGTAAAGCACTCCACGCCCCTCCACTGCCGCGGCGCAGAGAGGAAGGGCCCCGCGCCGCCTGACCGGCGCCAGCAGCGGGACCCGCCGAGCCTGAGCCTCGAGCGCCGTCCGGGCCGCACGGAGAGCCCAGCCACCGCCGCAGGTGAGTGA | 9476 |
| | 3 | MGASKRVQL* | ATGGGGCGGAGCAAACGGGTTCAGTGTGA | 9478 |
| | 4 | MVQVTNKNSISLLYSR* | ATGGTACACGGTCACAAACAAAATTCAATATCTTTATTGTATCCCGCTAA | 9480 |

Figure 1 (Continued)

| | | | | | |
|---|---|---|---|---|---|
| hsa-mir-16-2 | 1 | MAPFPKSRCL* | 9481 | ATGGCTCCTTCCCGAAGTCCGCTGCCTAA | 9482 |
| | 2 | MPRKGTQPSTARRREEGPPPPSPDGASSDAEPEPPSSGRT ESPATAAGE* | 9483 | ATGCCCCGTAAAGGCACCCAGCCCTCACTGCCGGCGCAGAGGAAGGCCGGC GCCGCCGTCCCTGACGGCGCCAGCACGCACGCGGAGCCTGAGCCGCCGTCCGGCC GCACGGAGAGCCAGCCACCGCGCCAGGTGAGTGA | 9484 |
| | 3 | MGASKRVQL* | 9485 | ATGGGGGCGAGCAAACGGGTTCAGTTGTGA | 9486 |
| | 4 | MVQVTNKNSISLLYSR* | 9487 | ATGGTACAGGTCACAAACAAAATTCAATATCTTTATTGTATTCCCGCTAA | 9488 |
| hsa-mir-17 | 1 | MYLIAKDFSTLFSYVFFNCKLLGF* | 9489 | ATGTATCTGATAGCTAAGGATTTTTCAACTTTATTCTCTTACGTATTTTCAACTGTA AATTATTGGGCTTTTAA | 9490 |
| | 2 | MDGHCC* | 9491 | ATGGATGGAATTAATTGCRGTTAG | 9492 |
| | 3 | MELIAVRRLENSKYRFGRW* | 9493 | ATGGAATTAATTGCYGTTAGGAGGTTGGAAATAGCAAATATAGATTTGGACGGTG GTAG | 9494 |
| | 4 | MFYLFFPYFSLFQSYTWT* | 9495 | ATGTTTTATCTTTTTTTCCTTATTTCCCTATTCCAGTCATACACGTGGACCTAA | 9496 |
| hsa-mir-181c | 1 | METPKITRYTQTYSTPINTQSKVMLTHTYSPHNNTATC VDTSPTRARTSRDSAH* | 9497 | ATGGAGACCCCAAAATTACACGTCTATACACAGATCACACACAGAGTCCGATTAATACG CAGTCGAAGTGATGTGACACACACATACACACAGACAATCCCCACACAACTGCCACGTGT GTAGACAGTCACCCACAGGGCTCGGACATCCAGGGATAGTGCCATTGA | 9498 |
| | 2 | MEPPTKAATT* | 9499 | ATGGAGCCACCAACGAAGGCAGCTACAACATAG | 9500 |
| | 3 | MSLRVAMTNADP* | 9501 | ATGTCACTCAGGTAGCAATGACAAACGCAGATCCCTAG | 9502 |
| | 4 | MCPPNQVHTCTLTVTHSHPHTHTHTHTHRRYKACRN TSDSRSHHFPFIYLFILRWSLSWLPRLECRGTISRIQAILL PQPPE* | 9503 | ATGTGTCTCCCAACCAAGTTCACACTGACACTGACAGTCACCCACAGTCACCCC CACCACACACACAGCAGGTCACACATCTTTTATTTTATTACTATTATTTTGAGA ATCTGACAGCAGGTCACACATCTTTTATTTTATTACTATTATTTTGAGAA TGGAGTCTCTCTTGCCTCAGGTTGGACATGCCGTGGCACGATCCCGGATTCAA GCAATTCTCTCTGCCTCAGCCTCCTGAGTAG | 9504 |
| | 1 | METPKITRYTQTYSTPINTQSKVMLTHTYSPHNNTATC VDTSPTRARTSRDSAH* | 9505 | ATGGAGACCCCCAAATTACACGCTATACACAGATCACACACAGAGCACCCCGATTAATACG CAGTCGAAAGTGATGTGACACACACATACACACAGACAATCCCCACACATTGCCACGTGT GTAGACAGTCACCCACAAGGGCTCGGACATCGAGGATAGTGCCATTGA | 9506 |
| hsa-mir-181d | 2 | MEPPTKAATT* | 9507 | ATGGAGCCACCAACGAAGGCAGCTACAACATAG | 9508 |
| | 3 | MSLRVAMTNADP* | 9509 | ATGTCACTCAGGTAGCAATGACAAACGCAGATCCCTAA | 9510 |
| | 4 | MCPPNQVHTCTLTVTHSHPHTHTHTHTHRRYKACRN TSDSRSHHFPFIYLFILRWSLSWLPRLECRGTISRIQAILL PQPPE* | 9511 | ATGTGTCTCCCAACCAAGTTCACACTGACACTGACAGTCACCCACAGTCACCCC CACCACACACACAGCAGGTCACACATCTTTTATTTTATTACTATTATTTTGAGAA ATCTGACAGCAGGTCACACATCTTTTATTTTATTACTATTATTTTGAGAA TGGAGTCTCTCTTGCCTCAGGTTGGACATGCCGTGGCACGATCCCGGATTCAA GCAATTCTCTCTGCCTCAGCCTCCTGAGTAG | 9512 |
| hsa-mir-182 | 1 | MRLFPNRGRPCLASLVWTPRGAERRLCAQPGAGAGECL GPGAGGRAGRSQSGAQ* | 9513 | ATGCGGCTCTTTCCAAACCGGGGCCCGTTTTGCTGGCTTCTCTGGTGTGGACTCCG CGGGAGCTGAGGCGGCTGTGCGCCCAGCCTGGAGCGGGCAGGTGAGTGTCT GGGGCCGGAGCGGGGGCGGGCGGGGCCCGGAGGGCCAGAGCCGGGGCTCAGTAG | 9514 |
| | 2 | MTRQCLLALPRLQAEAPTGRLGPGSASGVCPAFSAVPG RGRGRERLRSECGRCLRGAYPKGVWLGSGCVSPPWWA QAEAPGWEGAAESAGAPELAPPASCQGCAAGSRLLPWP GAAPPSLWGKAALRPPVCLLHFAATHPGNPGARE* | 9515 | ATGACGCGGCAGTGCCTACTCGCTCTTCCGCGCCTTCAGGCGGCAGGCGCCCACGGG GCGCCTGGGCGGGGGCTGGAGAGTTTGGCTGGGAGTCGGCGTTCGCGCCCTGGTCGGCT GCCTACCCGCGGAGGAGCTCCGCTCGCCAGGCGTCTGCCCAGTGCGCTGCGGCT CAGGGCGAAGGCCAGCTGGGAGGGGGCTGCAGCAGCTGCCAGTCCGCCGGAGC TGGCCCCTCCAGGTCTTGTCAGGGCTCGCAGGCGCTCGCTGGTTCGAGGCTGCTTCCGTGCC CCGGGAAGGCCGCCCTCCGGGCGCGTCGGGGGAAAGCGCTCTCAGAACGCGCTGTGCC TCCACTTCCGGCCACTCATCCCGGAACCCGGAACCCGGGAAGCCCGGGGCACGCGAATGA | 9516 |

Figure 1 (Continued)

| | | | | | |
|---|---|---|---|---|---|
| hsa-mir-183 | 3 | MRHRSPPSTAPFLLIALVAPRFPALPQDRRLDGLPLAPH RSAHPRTMGSEGVTRGQGSPDSTVSSRLSHSFALPTRAP GHRVQ* | 9517 | ATGAGACACCGTTCCCGCCCTTCCCGCCCCATTCCTGTTAATAGCGGCTAGTGGCA CCCAGGTTCCCAGCCTTCCCAGCCGCCATCCCAAGGACTATGGGCAGTGGCTCCT CACGGGTCAGCGCCATCCACGGTTCCTCCAGCCTGTCCAGGTGAGGGTGTCACCCGGCGGTCACCCGG GTGCCGGTCAGCGCCATCCACGGTTCCTCCAGGCAGTGAGGGTGTCACCCGGCGTCAGGG GCTCCCGGACACCGTGTACAGTAA | 9518 |
| | 4 | MGTESADL* | 9519 | ATGGGCACCGAGTCGGCGGATCTCTGA | 9520 |
| | 1 | MRLFPNRGRFCLASLVWTPRGAERRLLCAQPGAGAGECL GPGAGGRAGRSQSGAQ* | 9521 | ATGCGGCTCTTTCCAAACGGGGGCGTTTTGCCTGGCTCTCTGGTGTGGACTCCG CGGGGAGCTGAGAGGCGTGTGCCAGCCTGGCGCAGGCGCAGGTGAGTGTCT GGGGCCGGGAGCGGGGCGTGGCCGCGGAGCCGGAGCCAGCGGGGCTCAGTAG | 9522 |
| | 2 | MTRQCLLALPRLQAEAPTGRLGPGSASGVCPAPSAVPG RGRGRERLRSECGRCLRGAYPRGVWLGSGCVSPPWWA QAEAPGWEGAAESAGAPELAPPASCQGCAAGSRLLPWP GAAPPSLWGKAALRPPVCLHFAATHPGNPGARE* | 9523 | ATGACGCGGCAGTGCCTCCTGGCTCTGCCTCGGCTCCAGGCAGCGAGGCCGCCACGG GCGGGAGCTGGGCCGGAGCGCGTCCTGCCGAGTGCGCCAGCGCCGATGCTGTTCCGG GCTACCCGCGAGGAGTTTGGCTGGGCTGTGGGCTGCGTTTCGCGCGCCTGTGGGCT CAGGGCGGAAGCGCCAGGTCCAGGCTGGAGAGGCGTGCGGAGAGCGGCCGGAGC TGGCCCTGCAGTCTGTCAGGCTGGGCCAGTCGCGGCTGTTCGAAGCTGCTTCCGTGCC GCCCCTGCAGCGCCCCGCCCAGTCTCTGGGGAAAGCGGCCCTCTCAGACCTCCCGGTGCC TCCACTTGCGCGGCCACTCATCCGGGAACCCCGGCGCACGGCGAATGA | 9524 |
| | 3 | MRHRSPPSTAPFLLIALVAPRFPALPQERRLDGLPLAPH RSAHPRTMGSEGVTRGQGSPDSTVSSRLSHSFALPTRAP GHRVQ* | 9525 | ATGAGACACCGTTCCCGCCCTTCCCGCCCCATTCCTGTTAATAGCGGCTAGTGGCA CCCAGGTTCCCAGCCTTCCCAGCCGCCATCCCAAGGACATCGGGCAGTGGCTCCT CACGGGTCAGCGCCATCCACGGTTCCTCCAGCCTGTCCAGGTGAGGGTGTCACCCGG GTGCCGGATTCCTCCAGCCTGTCCAGGTGAGGGTGTCACCCGGCGGTCACCCGG GCTCCCGGACACCGTGTACAGTAA | 9526 |
| | 4 | MGTESADL* | 9527 | ATGGGCACCGAGTCGGCGGATCTCTGA | 9528 |
| hsa-mir-185 | 1 | MPRALLEGVFDNPRWHGMRGTLAGGTRLAAGRLRSAG LGAAWSLQGVWAARPWPASGTALAPGHSAPYPRPAAG QQGDS* | 9529 | ATGCCCCGGCGGTTACTGGAAGGTTGTTGATAATCCCCGTCGACTGGCACGGGATCGGA GGGACTCTGGCAGGTGGAAGCGAGATCTCGGCGTGAGATCGGCAGCATCAG GGGAGCTGCGTGGTCCTGCAGGGTCGGCCGCGCGTTGGCCAGCATCAG GGACAGCTCTGCGCCGGTCACTCGCCCGCGCCTGCTGCGGCCCCCAGCAGCAGTCAG AGGGTGACAGCTAA | 9530 |
| | 2 | MRPSWGGLGS* | 9531 | ATGCGGCCTTCCTGGGGAGGTTTGGGTAGTTAG | 9532 |
| | 3 | MSHALPWPGLFALSCGSRPADHCFAAILGTYPSSMRQ M* | 9533 | ATGTCACATGCCCTGCCTGGCCTGCCTGGCCTGGCCTGTGCACTGCCTGTGCACTGGCCACATGCC CGTGACCACTGTTTGCTGCCACTCGGGACACAGTGCCCTCTCCATGA | 9534 |
| | 4 | MPCPGQACLHCRYALDLLTTVLLPLWAQCPLP* | 9535 | ATGCCCTGCCCTGGCCAGGCCTGTCAGCCTGTGTGTTGCACTGTCGTGTGCTAGACCTGCTGACC ACTGTTTTGCTGCCACTCGGACACAGTGCCCTCTCCATGA | 9536 |
| | 1 | MSTKNFRVSDGDWICPDKK* | 9537 | ATGTCGACCAAGAATTTCCGAGTCAGTGACGGGACTGGATTGCCCTGACAAAA GTGA | 9538 |
| hsa-mir-186 | 2 | MIFCALRRVEAAMRQFPGGKKAPNLLTREVFPGAFVLD MSSAFPRHYLRKVASLFRVRDGLPFCPHPPPPRPGFSD RKPLQSGQLGVGSPPRDFSLQNFTLVHGKYCFLALVLLP LIVHLVLYFYSNFSSILFSPFFEALPSSVWEILTFSLWIISP QELGFSPP* | 9539 | ATGATTTTCTGTGCCTTAAGACGGGTTGAGGCGGCGAACCGCCAGTTCCCTGGCGGG AAGAAGGCTCCAATCTCCTCACGAGAGAGGTCTTTCCGGGAGCCTTTGTTCTAGAT AGTGTTCAGCGTTTCTGGCCCTACGATTACCTCGCAAGGTAGCCTCTCTTTAGAGTGC GAGATGCGTACCTTTTGACCCGCAGCTTGGTGTTGGAGATCCCCCAGGTTTAGCG ATAGGAAACCTCTCCAGTCAGCCAGCTTGGTGTTGGAGATCCCCCAGGTGACTTTT CTCTGCAGAACTTTACTCTTGTTCACGGAAAATATTGCTTTCTGCACTCGTCTTTT GCCTCTATAGTTACCTTGTTTGTATTTACTCAACCTTTCTCCACTATTTT CCCTTTTCCGGAAGCTCACCCTCTTGGTTGGGAAATTCTGACATTTCTTTGTG GATCATTTCCCACAAGAATTGGCGTTTCTGCCTCTTAG | 9540 |

Figure 1 (Continued)

| | | | | |
|---|---|---|---|---|
| | 3 | MAYLFAPTHLPRPGQVLAIGNLSSQASLVLDLPHVTFLCRTLLLPTENIAFSHSSFCLL* | 9541 | ATGGCCTACCTTTTGCCCCACCCCTCCCCGCCCCGGCCAGGTTTAGCGATAGGAAACCTCTCCAGTCAGGCAGTTGGGTGTTGGATCTCCCACGTGACTTTCTGCAGAACTTACTCTGTTCACGGAAAATATTGCTTCTCGCACTCGTCCTTTGCCTCTTATAG | 9542 |
| | 4 | MPAAEKHVC* | 9543 | ATGCCTGCAGCAGGAAGCACGTGTGTTAG | 9544 |
| hsa-mir-18a | 1 | MYLIAKDFSTLFSYVFFNCKLLGP* | 9545 | ATGTATCTGATACTAAGGATTTTCAACTTATTCTCTTACGTATTTTCAACTGTAAATTATTGGGCTTTAA | 9546 |
| | 2 | MDGNCC* | 9547 | ATGGATGGAATTAATTGCTGTTAG | 9548 |
| | 3 | MELJAVRRLENSKYRFGRW* | 9549 | ATGGAATTAATTGCTGTGTTACGGAGGTTGGAAATAGCAAATATAGAATTGGAACGGTTGGTAG | 9550 |
| | 4 | MFYLFPYFSLFQSYTWT* | 9551 | ATGTTTTATCTTTTTTTCCTATTTCCAGTCATACACGTGACCTAA | 9552 |
| | 1 | MGQGGSECAILARMPVAPAPAPATASAWAAVPGAPLIKDSSLGEFRRENAIDCGPPVGNWGGSVGFSLWRGGGSVS* | 9553 | ATGGGACAAGGTGGTAGTGAGTGCGCCATCCTGGCCCGGATGCCGGTGGCACCGCACCGGCTCCGGCCACGCCGTCCTGCCTGCTGGCCGTGTCCAGGCGCGCCTTTAATTAAGGACTCCAGTTGGGGAAGAGAGAAGGGAAAATGCCGACTGCGGTCCGCCGGGGGTAACTGGGGCTCGGTCGGTGGGGTTTCGGTTTGGCGGGTAACTGTTCCGTTTCCTAA | 9554 |
| hsa-mir-18b | 2 | MPTAVRPWVTGARWGFRFCGGVGYPEPNSCAGRVGGGGLFSLGY* | 9555 | ATGCCGACTGCGCGTCCGCGGTCCGCCCCGTGGTAACTGGGGCTCGGTGGGTTTCGCTTGGCGGGTGGGGTTTCGGTGGGAGGGGCTTTTCTTGGGGCTATTAA | 9556 |
| | 3 | MCARGLDPFSGRFFSLLPPFWLRGRLRSHPAPERSSCALGHWVYVWRGHPERAARAGSPRSPPARGGPELGPARGFPSGWLGKKGALRWGSCDPVELTGWVGGIDGAGGT* | 9557 | ATGTGCGCTCGCGGGGACCTGCCGGAGACTGATCCATTTAGTGAGCGCTTTTCTCACTTCTCTCCCTCTGGACACTGGGTATACGTGGAGGCCACCCCGGAACAAAGGGCCCCGTGCGAGATCCCCGCGCTCTCCAACTTGCGAAGGGACCAGGTTCCCGAGCTCCTCGTTGGGCAGCGTGATCGGTAGAGGTTGACTGGGTTGGGAGGGGAAGCCGGGGGACTTGA | 9558 |
| | 4 | MRGCTWREKRDSPPSWLLSHQPGNGGGGRRGLGAFLVL* | 9559 | ATGAGGGGGTGCACGTGGAGGTGGAGCGGAAAAAGGGACTCCCTCCTCTTGGCTTCTATCCCACCAACCGGGAATGGAGGGGAGGGAGGCGTGGGCTTGGCGCGTTTTGGTGCTTTGA | 9560 |
| | 1 | MGGF* | 9561 | ATGGGCGGGTTCTGA | 9562 |
| | 2 | MWPQGE* | 9563 | ATGTGGCCCCAGGGCGAGTGA | 9564 |
| hsa-mir-191 | 3 | MGCP* | 9565 | ATGGGTGCCCTGA | 9566 |
| | 4 | MGVDVGEPRLVAISGTLGRIGEGGWTQDLWVGLQW* | 9567 | ATGGGTGTAGACGTGGGAGAGCCGAGGCTGGTGGCATCTGGAACCTGGAACCTGGGGAGCGAGATCAACTGGCGATTGGGCGAGGAGGGTGGACCCAGATGCCTCTGGGGCTGCAATGGTAG | 9568 |
| | 1 | MGAEGWVFAGEMRVSDQLAYKVPVLGPRDQRLLPGPRPRPASSRAGVRSGQAASQVHAGEGVVRCARPGCVR* | 9569 | ATGGGAGCTGAGGGCTGGGTCTTTGCGGGCGAGATGAGAGTCTCGGATCAACTGGCCTACAAAGTCCCAGTTCTGGCCCCGGGACCAGCGTCTTCTCCCGGGCCTCGCCCCAGGCCGGTCCTCTCCTCCGGGCTGCTCCGGCCAGGTGCATGCTGGAGAAGGAGGTGTAAGGTGCGCTGCCGCCGCCTGCGTGCGGTGA | 9570 |
| hsa-mir-193a | 2 | MGQALPLTEACPAVLSRAATLSLGVGRTGPDF* | 9571 | ATGGGCCAAGCCTTGCCACTTACCGAGGCCTGCCCTGTGCTGTTCGCGGGCTCTTTGTTCCCTGA | 9572 |
| | 3 | MDLCGCVPNGRSFVP* | 9573 | ATGGATCTTTGTGATGTTCCAATGGCCGGTCTTCCCTGACCGATCAACATAA | 9574 |
| | 4 | MCSQWPVFCSLTDAT* | 9575 | ATGTGTTCCAATGGCCGGTCTTCCCTGACCGATCAACATAG | 9576 |
| | 1 | MRRKGAWGSGLSRT* | 9577 | ATGAGGAGGAAAGGTGCGTGGGGGAGTGGCTTTCCAGAACCTAG | 9578 |
| hsa-mir-193b | 2 | MEHSPNLGAQQJ* | 9579 | ATGGAAATCATTCCCCAACTTGGGCGCGCAGCAAATTTGA | 9580 |
| | 3 | MRDD* | 9581 | ATGAGAGACGATTAA | 9582 |

Figure 1 (Continued)

| | | | | |
|---|---|---|---|---|
| | 4 | MGWGELYEAPRTPDLSAAKGRLGHPSCCPGSF* | 9583 | ATGGGGTGGGGGAACTGTACGAGGCAACCTCGGACACCCGATTTATCCGCTGCTAA GGGACGTTTGGGGCGTCACCCCTCGTGTTCCGGGAAGCTTTAG | 9584 |
| hsa-mir-195 | 1 | MSKPPHRPEFPSSRFLSCSFMHSNKDTLRSEGEGPGPDIQ PRGPWSAIPGQLYTLPSPNPGSFCLAAGFSSSTPSFNELC LACPQCLPKQNMRV* | 9585 | ATGTCAAAGCCACACCTCAGTTCCATCGTCCTGAATTCCAGTTCCGGTTTCTCAGCTGTCTT TCATGCATTCAAATAAAGACACACTCCGGTCTGAAGGGGAGGGCCCCGGCCTGAT ATCCAGCCCGTGACAATGTCGGCCATTCCTGCCTGCCAACTGTACACTCCCAGC CCAAATCGGGAGAGCTTCTGCCTGCCGCCAATGTCTCCGCAGCTGATTCAGCTCTACACCCTTCTCCA AATGAGCTTTGCCTGCCACCCTGCCCCGAAACAAATATGAGGGTGTGA | 9586 |
| | 2 | MVGHSWPTVHSPQPKSGELLPCSWIQL* | 9587 | ATGGTCGGCCATTCCTGGCCAACTGTACACTCTCCCAGCCAAATCGGGGAGCTT CTGCCTTGCAGCTGGATTCAGCTCTAG | 9588 |
| | 3 | MSFALPARNVSRNKI* | 9589 | ATGAGCTTTGCCTTGCCTGCCGCAATGTCCGTAAACAAATATGA | 9590 |
| | 4 | MSPETKYEGVIHAHLSDQGLQIRVVKPPPALSPSSLFSLL VYPTQF* | 9591 | ATGTCTCCGGAAACAAATATGAGGGTGATACATCTGATCAGGGACTTCAGATCAGGGA CTTCAAATTAGGGTCGGATCCCCGTCCTGCCATCTCTCAGATCAGGGA TTCTCGTTTACCCCACCCAATTTTAA | 9592 |
| hsa-mir-196a-2 | 1 | MGVGVWLVCVSSPHSPHTSHTAPCSPCKVKIESIRL* | 9593 | ATGGGGTGGGAGTTGGCTGGCTGTGTGTTCAAGCCCTCACTCACCACGACTCA CACACAGCATTCGTCTCCATGCAAAGTTAAGATCGAATCCATCCGCTGTAG | 9594 |
| | 2 | MSLPPSRSKNLLEVSYLYCFLLFSHPS* | 9595 | ATGTCTTACCTCCCAGTCGCTCTAAGAATCTGCTTGAAGTCTGCTGTATTGTACTGCT TCTGCTTTCTCCCACCCCTCCTAG | 9596 |
| | 3 | MPPPPM[IVLSLSGSCVI* | 9597 | ATGCCCCCCCCAAATGTCGTCCTGTCCCTGTGGAGTTGTGTTATTTAA | 9598 |
| | 4 | MLYLLHVASLMEKKPNKFPES* | 9599 | ATGTTGTATCTTTTGCATGTAGCTTCCTTAATGGAGAAAAACCTAATAAATTT CCAGAATCATAA | 9600 |
| hsa-mir-196a | 1 | MYLIAKDFSTLFSYVFFNCKLLGP* | 9601 | ATGTATCTGATAGCTAAGGATTTTCAACTTTATTCTTACGTATTTTCAACTGTA AATTATTGGGCTTTAG | 9602 |
| | 2 | MDGNCC* | 9603 | ATGGATGGAATTAATTGCTGTTAG | 9604 |
| | 3 | MELIAVRRLENSKYRFGRW* | 9605 | ATGGAATTAATTGCTGTTAGGAGAGTTGGAAATAGCAAATATAGATTGGACGGTG GTAG | 9606 |
| | 4 | MFYLFFPYFSLFQSYTWT* | 9607 | ATGTTTTATCTTTTTCCTTATTTCTCAGTACACGTGGACTAA | 9608 |
| hsa-mir-196b-1 | 1 | MYLIAKDFSTLFSYVFFNCKLLGP* | 9609 | ATGTATCTGATAGCTAAGGATTTTCAACTTTATTCTTACGTATTTTCAACTGTA AATTATTGGGCTTTAG | 9610 |
| | 2 | MDGNCC* | 9611 | ATGGATGGAATTAATTGCTGTTAG | 9612 |
| | 3 | MELIAVRRLENSKYRFGRW* | 9613 | ATGGAATTAATTGCTGTTAGGAGAGTTGGAAATAGCAAATATAGATTGGACGGTG GTAG | 9614 |
| | 4 | MFYLFFPYFSLFQSYTWT* | 9615 | ATGTTTTATCTTTTTCCTTATTCCAGTCATACACGTGGACCTAA | 9616 |
| | 1 | MGQGGSECAILARMPVAPAPATASAWAAVPGAPLIK DSSLGEFRRENADCGPPVGNWGSVGFSLWRGGGSVS* | 9617 | ATGGGACAAGGTGGTAGTGAGTGCGCCATCCTGGCCCGGATGCCGGTGGCCACCGC ACCGGCTCCAGCTGGGAAGAAGGAAGGAAATGCCGACTGCGGTCCGCCCGTGG GTAACTGGGGCTCGGTGGGGTTTCGTTGCCGGGGTTCGTTCCTAA | 9618 |
| | 2 | MPTAVRPWVTGARWGFRFGVGVPFPNSCAGRVGGG GLFSLGY* | 9619 | ATGCCGACTGCGGTCCGCCCGTGGGGCTGTACCTGGGCTGTGGTGGCTCGGGTGGCGG GGGGTGGGGGTTCCGTTCCGTAATTCCGTGTCGTAATTCCTGTCGCCCTTTGCTTTGC TTTTCCTTGGGCTATTAA | 9620 |

Figure 1 (Continued)

| | | | | |
|---|---|---|---|---|
| hsa-mir-19b-2 | 3 | MCARGLDPFSGRHFSLLFPWLRGRLRSHPAPERSSCAL GHWYVWRGHPERAARAGSPRSPARGGPELGPARGF PSGWLGKKGALRWGSCDPVELTGWVGGDGAGGT* | 9621 | ATGTGCGCTCGCGGCCTTGATCCATTTAGTGACGCTTTTCTCACTTCTCTCCCT TCTCGCTCCGCGCGGAGACTGCGCTCGCACCGGCCCGGAGCGCTCGAGCTGCGCG CTGGGACACTGGGTATACGTGTGGAGGGGACACCCGGAGCGAGGGCGGCCGGTGCGGG ATCCCCGAGCTCTCCAACTGGCTGGGCAAGAGGAGCCCGGGCCGGGCCTGGTCCCGCGCGCGGTT TCCCGAGCGGGTGCTGGGCAAGAGGAGCCTTCGTTGGGGCAGTGTGATCCG GTAGAGTTGACTGGTTGGTGGTGGGAGAGCGGGACTTGA |
| | 4 | MRGCTWREKRDSPPSWLLSHQPGNGGGRRGLGAFLV L* | 9623 | ATGAGGGGTGCACGHGAGtGGAAGGGAAAAAAGGACTCCCCTCCTTGGCTTCTATCC CACCAACCCGGGAATGGAGGCGGAGGGAGGCGTGGCTTGGCGCGTTTTGGtGCT TTGA |
| | 1 | MGCRQPGQRPGELRSLQTQAGAGPSPPQGKVGPCADA AGFRVWSHLGPTGCVFRARAQCVGSRHGVPSGQGLGR GQAPRGVTFLPPT* | 9625 | ATGGGCTGTCGCCAGCCTGGCCAGCGTCCAGGGGAGCTCAGGTCACTGCAGACACA GGCTGGAGCGGGTCCTTCCCCCCCAGGGAAAGTGGCCCCTGCGCAGATGCGG CTGGGTTTCGGGTGTGGAGCTCATCTTGGACCACAGGGCTGTCTTCGGGCACGGG CACAGTGTGTGGGCTCCAGGCATGGGGGGTGCCTCAGGGCAGGGCCTGGGCAGAGGG CAGGCTCCGAGAGGGGTCACGTTCTTGCCGCTACCTGA |
| hsa-mir-200a | 2 | MRLGFGCGAILDPRAASSGHGHSVWAPGMGCPQGRAW AEGRLREGSRSCRLPDSRPSRKFSPEAATAVLRHFVRRR EAVASEVGA* | 9627 | ATGCGGCTGGGTTTCGGGTGTGAGCCATTCTGGACCCAGGCTGCGTCTTCCGGG CACGGGCACAGTGTGTGGGCTCCAGGCATGGGGTGCCCTCAGGGCAAGGGCCTGGGC AGAGGCAGGCTCCGAGAGGTCAGGGTCACGTTCTTGCCGCTACCTGACAGCAGGCTT CTAGAAAGTTCTCTCGCCCTCGAAGCAGCTCTGAGGCACTTTGTGCGGAGAC GGGAAGCTGTCGCCTCAGAGGGTGGGTGCGTAG |
| | 3 | MTASPLGSGVCGGKGLVSAPSGQRPAEPMCGGEVGAWG RGWSGTGAQPGEAGAGSQAPRYDWGGGNVSREVFY LNVKRLSTVAAAGNKVRPTEAQP* | 9629 | ATGACCGCGTCTCCTTGGCTCTGAGCCCGGAGTCGCGGTGGGAAGGGCTTGGTTTCAGCA CCCTTCTCAGAGGGTACAGTGGGCCGGCCATGGGCGGTGAGAAGCTGGAGCCGGTTCCAAGG TGGCTGGTCTGGTACAGTGGGGTGGGGCAACGTCTCTGAGGTTTTTACTTAAATG CCCCGCTATGACTGGGGGTGGGGCAACGCCGGGAACAAGGTCCGACCCACCGAGGCC CAGCCTTGA |
| | 4 | ATGACTGGGGTGGGGTGCAACGTCTCTCGTGAGGTTTTACTTAA | 9631 | |
| | 1 | MGCRQPGQRPGELRSLQTQAGAGPSPPQGKVGPCADA AGFRVWSHLGPTGCVFRARAQCVGSRHGVPSGQGLGR GQAPRGVTFLPPT* | 9633 | ATGGGCTGTCGCCAGCCTGGCCAGCGTCCAGGGGAGCTCAGGTCACTGCAGACACA GGCTGGAGCGGGTCCTTCCCCCCCAGGGAAAGTGGCCCCTGCGCAATGCGG CTGGGTTTCGGGTGTGGAGCTCATCTTGACCACAGGGCTGTCTTCCGGGCACAATGCGG CACAGTGTGTGGGCTCCAGGCATGGGGGTGCCTCAGGGCAGGGCCTGGGCAGAGGG CAGGCTCCGAGAGGGGTCACGTTCTTGCCGCCCTACCTGA |
| hsa-mir-200b | 2 | MRLGFGCGAILDPRAASSGHGHSVWAPGMGCPQGRAW AEGRLREGSRSCRLPDSRPSRKFSPEAATAVLRHFVRRR EAVASEVGA* | 9635 | ATGCGGCTGGGTTTCGGGTGTGGCTCAGTTCTTGGACCACAGGCTGCGTCTTCCGGG CACGGGCACAGTGTGTCCGAGAGGCAGGTCATGGGGTGCCGCTACCTGACAGCAGGCTT AGAGGGCAGGCTCGAGAGGTTCTCCXAGAAGCAGCAGCGCCGTCGTGAGCACAGGGAGAC CTAGAAAGTTCTCTCCAGCAGCTCTGAGGCACTTTGTGCGGAGAC GGAAGCTGTCGCCTCAGAGGTGGTGCGTAG |
| | 3 | MTASPLGSGVCGGKGLVSAPSGQRPAEPMCGGEVGAWG RGWSGTGAQPGEAGAGSQAPRYDWGGGNVSREVFY LNVKRLSTVAAAGNKVRPTEAQP* | 9637 | ATGACTGCGTCTCCTTGAGTCTCGGGTGGAAGGGCTTGGTTTCAGCA CCCTTCTGGTCAGAGGTTACAGTGGGCCGGCCATGGGCGTGAGAAGCTGGAGGTCG TGGCTGGTCTGGTACAGTGGGGCTCAGCCGGAGAAGCTGGAGCCGGTTCCAGG CCCGCGCTATGACTGGGGTGGGGCAACGTCTCTGAGGTTTTTACTTAAATG TGAAACGGCTCAGTACGGTGGGCCAGCCGGGAACAAGGTCCGACCCACCGAGGCC CAGCCTTGA |
| | 4 | MTGVGATSLVRFFT* | 9639 | ATGACTGGGGTGGGGTGCAACGTCTCTCGTGAGGTTTTACTTAA |
| | 1 | MGARDLQLFRRDPGPEAA* | 9641 | ATGGGAGCCAGGGATCTGCAGCTTTTCCGCAGGGATCCTGGCCTGAAGCTGCCTGA |

Figure 1 (Continued)

| | | | | | |
|---|---|---|---|---|---|
| hsa-mir-200c | 2 | MMEAPVPVSATSLASGPQPLAGCSPLPTSHAPRKPLVLS* | 9643 | ATGATGGAGGCCCGTCCTGTCGCTGTCAGCAACATCCATCGCCTCAGGTCCCAGCCC TTAGCTGGCTGCAGCCCCCTCCCCACTTCCCACGCACCCGGAAGCCCCTCGTCTTG AGCTGA | 9644 |
| | 3 | MGPSPSSHPVRFVTWWIQNPQSTLSLGLARPLSRDLTW PVARVPCSNW* | 9645 | ATGGGCCCCAGCCTCCTCCCACCAGTGCGATTTGTCACTGGTGGATCCAGAAC CCACAGTGACCTTGAGCTTGGGGTTGGCTCGCCCCTCTCAAGAGACCTCACCTGG CCTGTGGCCAGGGTCCCGTGAGCAACTGGTGA | 9646 |
| | 4 | MAPGWVLSAVTFREP* | 9647 | ATGGCTCCCGGGTGGGTTCTCGGACAGTAACTTCAGGGAGCCCTGA | 9648 |
| | 1 | MGQRRCRRRIWSR* | 9649 | ATGGGTCAAAGGCGGTGCAGGAGGAGGATCGGTCCAGATAA | 9650 |
| | 2 | MNQSSPHYPDLCLPTSPVFTLAKSLYIQTKESVTPSQH* | 9651 | ATGAACCAGTCTTCTCCCCTCACTTACCCAGATCTGCCTGCCAACAGCCCGTGT TCACCCTGGCAAAGAGTCTTTACATTCAGACCAAGGAGAGTGACTCTTCTCAGC ACTAG | 9652 |
| hsa-mir-205 | 3 | MPERLDAWGGATYEKLPCFGSEQAPGRKYFKQQGAS APTHPACMLVLRTAFYGACTEPWACLNTTRKRPEQQQ HAKG* | 9653 | ATGCCCAAGAGCTAGATGCGTGGGGAGGAGCCACATACGAGAAACTGCCTCCTG CTTCGGGTCAGAACAAGCCCAGCCTGAGACCTTCAAACAACAAGGTGCATCTG CCCCAACCATCCAGCTGCATGTTGGTCTGAGAACAGCCTTTATGGGCTTGCA CTGAGCCATGGCATGTCTGAACACAAGGAAGAGGCCAGAGCAGCAACAGCAC GCAAAGGGTGA | 9654 |
| | 4 | MRGEEPHTRNCLPASGQMKPQEESISNMKVHLPQPIQPA CWC* | 9655 | ATGCGTGGGGAGGAGCCACATACGAGAAACTGCCTCCGTCTTCGGGTCAGAACAA GCCCCAGGAAGAGAAATATTCAAACAACAAGGTGCATCTGCCCCAACCCATCCAGCCC TGCATGTTGGTGCTGA | 9656 |
| | 1 | MYLIAKDFSTLFSYVFFNCKLLGF* | 9657 | ATGTATCTGATAGCTAAGGATTTTTCAACTTTATTCTCTTACGTATTTTTCAACTGTA AATTATTGGGCTTTTAA | 9658 |
| | 2 | MDGINCC* | 9659 | ATGGATGGAATTAATTGCTGTTAG | 9660 |
| hsa-mir-20a | 3 | MELIAVRRLENSKYRFGRW* | 9661 | ATGGAATTAATTGCTGTTAGGAGAGTTGGAAAATAGCAAATATAGATTTGGACGGTG GTAG | 9662 |
| | 4 | MPYLFFPYFSLFQSYTWT* | 9663 | ATGTTTTATCTTTTTTCCTTATTCTGTCCTATTCCAGTCATACACGTGACCTAA | 9664 |
| | 1 | MGQGGSECAILARMPVAPAPATASAWAAVPGAPLIK DSSLGEERRENADCGPPVGNWGSVGFSLWRGGGGSVS* | 9665 | ATGGGACAAGGTGGTAGTGAGTGCGCCATCCTGGCCCGATGCCGGTGCCACCCGC ACCGGCTCCGGCCACGGCTCTCGCAGGCCCGTCCCAGGCGCGCCTTTAATTAA GGACTCCAGCTTGGGGAAGGAAGAAATGCGACTGGCCGTTCGCCGTTGG GTAACTGGGGCTCGGTGGGTTTCGCTTTGGCGGGTGGGGTTCCGTTTCCTAA | 9666 |
| | 2 | MPTAVRPWVTGARWGFRFGGVGVPFPNSCAGRVGGG GLFSLGY* | 9667 | ATGCCGACTGCCGTCCGCGTCCGGTTCTGAACTGGGCTCGTGGGGTTTTCGTTTGGC GGGTGGGGTTCCGTTTCCTAATTCCGTGTGCCAGGGGTGGGCGGGGCGGGCT TTTTTCCTTGGGCTATTAA | 9668 |
| hsa-mir-20b | 3 | MCARGLDFFSGRFFSLLFPFWLRGRLRSHPAPERSSCAL GHWVYVWRGHPERAARAGSPRSPPARGGPELGPARGF PSGWLGKKGALRWGSCDPVELTGWVGGDGAGGT* | 9669 | ATGTGCGCTCGCGGCTTGGACTTCTTCAGTGGACGCTTTTTCACTCTTCCCT CTGGGACACTGGTATACGTGTGGAGGGGACACCCGGACGCGGCCCGTGCGGG ATCCCCGCGCTCTCCACTCGCGGGCGGACGCCGAGCTGGTCCCGCGCGGTT TCCCGAGCGGTGACTGGTTGGGTGGGGACGCGGACGGAGGGGAGGGCGGGACTGA | 9670 |
| | 4 | MRGCTWREEKRDSPPSWLLSHQPGNGGGGRRGLGAFLV L* | 9671 | ATGAGGGGGTGCACGTGGAGGGAATGGAGGGGGAGGGGAGGGACTCCCTCTTGGCTTCTATCC CACCAACCCGGGAATGGAGGGGAGGGGAGGGGCGTGGGCTTGGCGGTTTTTGGTGCT TTGA | 9672 |

Figure 1 (Continued)

| | | | | |
|---|---|---|---|---|
| hsa-mir-210 | 1 | MDGVCLSGQQGRRVGVSEIRGLCCPPLGGAEAGPDTL LEGTFFSSLCVQGTSVRSSCCQAEGGRPGQAQVWSYLQPT GPSSGGPPLGTSYGKRVTDLVLLCVSAASVGPLRETAG GSSSSLSAEPAFSSLLLKSGPGRVRAYRPCLRSPGLQELR AAPARWRGRGRFSGRLAWTRTGLWKLPALTGLPVTTA K* | 9673 | ATGGACGGGGTGTGCCTGTCTGGCCAGCAGGGACGGCGGTGGGGTAAGCGAAAT CATTCGGGGGCTTGCTGCCTCCGCTGGTGTCCCCTTCTTTCTTTGTGTCCAGGTACCAGGGGCTGGGTGGGCTGGGGTA AGGACCATCCCGAGGGCCACTCTGGGACTTCCTACGGGACAAGAGAGTGACAG ATTTGGTGCTTCTGTGTTTCTGCCGCTTCAGTGGGCGCTGCGGGAGACAGCCG GTGATCCTCCAGCAGCCTGTCGCAGCTACAGGCCTCTGTCTGCCTTCAAGTCTACTGTTAAAT CAGGAGGCTGCTCACCTGCTGCTGGAAGAGGGCAGAGGACAGATTTAGTGACGCCTG GCATGGACTCGGACTGGCCTTTGGAAGCTCCCGCTGACGGGGTTGCCTGTCACC ACTGCGAAGTGA | 9674 |
| | 2 | MDSDWPLEAPCPDGVACHHCEVRLGRTCT* | 9675 | ATGGACTCGGACTGGCCTTTGGAAGCTCCCGCTGACGGGTTGCCTGTCACCAC TGCGAAGTGAGGCTTGGCAGGAACTGCACCTGA | 9676 |
| | 3 | MSRNSGRGGSQRRPSIQPGSALCPYLHQVGSLPCIAWGL AGLGPALLWWMFSGSPAPPHYNTVFNIVFKVQFKIQ K* | 9677 | ATGAGTAGGAACTCTGGCGAGGAACTACACCAGGTGGATCCTGCCTGCATTGGGG CTGCCCTCTGGCGCCCTTGGGCCGCCTCGCCGCTGACTTACACCAGGTGGGAACTGATGTTTCAGGGAGCCAGCC ATTGGCTGGGCTTGGGACCCCGCGCTGGTGGAACTGATGTTTCAGGGAGCCAGCC CTTCCTCATGTCAACACAGTTCACAATATAGTTTCAAAGTACAGTTAAAACTCAA AAGTAA | 9678 |
| | 4 | MSTQFTI* | 9679 | ATGTCAACACAGTTCACAATATAG | 9680 |
| hsa-mir-212 | 1 | MPWHLTHSLSHVSP* | 9681 | ATGTTCTGGATCCATCTTACCCACTCCCTCCCATGTCTCCCATAG | 9682 |
| | 2 | MSPHSHLTLEAVRSQRGKRRPPELPVSREGGPRHLARGT CCGLRWKLRSVEGRWRGSS* | 9683 | ATGTCTCCCATAGCATCCTCACTTTAGAAGCAGTGAGGTCCAAAGAGGAAAACGG AGGCTCCAGGACAGAGCATCCCGGTCTAGGAAGGCGACCGACATCTCGCCGAGG GACGTGCTGGGCCTGAGGTGGAAGTTACGAGGTGTTGAGGGAGGTGGAGAGCT CCTCATAA | 9684 |
| | 3 | MNRSSTEQEGICE* | 9685 | ATGAATAGGAGTTCTTCTACCGAGCAGGAAGGCATTGTGAATAA | 9686 |
| | 4 | MQGLSDPISFHFSLFEDRVRSPTPDFQRAPPPHYSCAVESV HC* | 9687 | ATGCAGGGCCTCTCTGACCCCATCTCTTTCATCTTTTCTCTTTTTGATAGAGTCAGAT CCCCCACCCCAGACTTCCAAAGAGCCCTCCCGCCCATGTATCTGTGCAGTGGAGT CTGTGCATTGCTAA | 9688 |
| | 1 | MCGRGGGQD* | 9689 | ATGTGCGGGGGATTAGGGGAGGGGCAGGATTAG | 9690 |
| | 2 | MNQPMKGAGESRREGACKRRRKGRGVCANRLWRPHK DWPRTEGEDREVGGNWGGRGHPLLPCPRDRPPPGSR SPSPGASARAGTRCPSGSLTAPHPLALYPSHSLHSMGIA LPLLFPPHPLRLL* | 9691 | ATGAACCAGCCGATGAAAGGGGCTGGAGAGAGCAGGAGGGAGGCTGGAAGAG GGAGGAGGAAGGGGACTGGAAGGGAGAGGGAGGCTGCGGCCCACATAAGGAC TGGCCACGGACTGGACTGAACTTGCCTTGTCCAGGGAACTGGGGTGGGGGCCACCACTGGCCTTGTCCAGGGACAAGCCACCCCATCCGGCAGCCGCAG CCAAGTCCGGGAGCCTCAGCTGCCGGGGGACAAGCCACCTCATCCTGGCAGCCGCAG TGCCCCACCCCTCTCTTCCTCCATCCCTCGTTTACTCTAG | 9692 |
| hsa-mir-219-1 | 3 | MPIRVSNCPPPRPVSLSFPTLNGDRSAPSSSLSSPSPSFT LESSKRLLPTSHSRHSAPVYPTHTRTPPSQWELHLVYVP VSAWCLHSPFPPVRLPFPAPGRGS* | 9693 | ATGCCCATCAGGGTCTCTAACTGCCCTCCACCCCGCCCGCCCCTGTATCCTCTCATTCC CTACACTCAATGGGGATCGCTCGAAGAGCTCTGCCACCCCCTCTCCGCTCCTTTCC GTTTACTCTAGAGTCCTCCACCCACCCCTGCCCCACTCCAAATGCCCAAGGGAGCTCCATCTGTG TATGTCCCCTGTTTCCGCGTAGTCCCCAAGCACCCCTTTCCCCGTTCTCCAATTCTGCC CCTTCCCCGCCCGGGCGGGCCGGCTCCTGA | 9694 |

Figure 1 (Continued)

| | | | | |
|---|---|---|---|---|
| | 4 | MGAPSCYCPCFRVVSPPPLSSRAPPSLPRPGPRLLJVQTQ FSSLWLRPRVESGRPEFPPPNLERESGSEGLRAKAEGG GSPQGGKGNPGHIGT* | 9695 | ATGGGAGCTCCATCTGTATGTCCCTGTTCCGCTGTGTCTCCATTCCCCTTT CCTCCCGTGCGCCTCCTCCGGACCCCGGACCCGGGTCGCGGCTCCTGATTGTCAAA CGCAATTCTGAGTCTATGGCGCCGAGAGCGGGTTGAGTCTGGACGTTCCGAGCGC CGCCCCCAAACCTGAGCGGACAGCGGGTCGGAGAGCGGGTCTAGGGAGAGCCAAGCA GAGGGTGGAGGGAGTCCCAGGGTTGGTAAGGGGAATCCGGGCACATCGGGACCTA G | 9696 |
| | 1 | MEGESGVRAATPSPSGRRRGGGGRGASGRGAWTGRVS VSGATRKESGTGVVAEGLAEWRGAGGEPRGRAGGGS PGGPRSEDTGAGHLAWGGSGPPERAARRCFASAGVHW VRASSAPWQGRGRWAGRPLLSFSPGIDVM* | 9697 | ATGGAGGGTGAAAGTGGGGTCGGGGCGGCCACACCCAGCCCTTCCGGAGGAGAAG GGGCGCGGGGCGCGGCAAGGGCACGCGGCAGCGGGATCTGGGACGGAGAAGGGCTGG GTGTTCAGGAGCTACGAGGAAAAGAGTCTGGGACGGAGAGGGCGGGAGGGCTGG CGAGTGGCGCGGCCGCGGGGGAGACGCGAGGGGCGAGGGCGGGCCATCTAGCTCGGGAGGGT ACCYGGCGGCCCCCGTCTGAGGATACAAGGGCCGGCCATCTAGCTCGGGAGGGT CTGGACCCCGAGCGGGCGGCGGCCCCTGAGGAGGTGCTTTGCCTCTGCGGCGTTCACTGG GTCAGGGCCAGTTCAGCGCTGCAGCGGAAGGGGTCGCTGGGCGGCGCGGCCCT CCTCTCGTTCTCCAGGGATGTTATGTAA | 9698 |
| hsa-mir-22 | 2 | MLCKGGGERSRGRRCRGLMQPKG* | 9699 | ATGTTATGTTAAGGGGGGAGGGGAGAGGAGTAGGGGCGGCGGTGCCGGGGCCTTA TGCAACCCAAAGGTTAG | 9700 |
| | 3 | MASGEAVTPTSLRPWFQPPTPLACHPGCQIGLGAVRVP EG* | 9701 | ATGGCCTCGGCGGAGGCTGTCACCCCACCTCCTCGGCCCTGGTTCCAGCCTCCA ACTCCCTTTGCCTGTCATCCTGRCCGGCTGCAGATTGGGCTAGGAGGCTGTCAGAGTGCCA GAGGGTTGA | 9702 |
| | 4 | MEQLVRGSVPWAHPALQPRAPAWHRLSAAAESSGLMR AISDRGRSDGVGLVTQGKEDTQSSCLPRGFRNLNRTPY PPIFLTIL* | 9703 | ATGGAGCAGCTGGTCAGGGAGTCAGTGCCTTGGGCCCACCCCGCTGCAGCCAAG GCCACTGCCTTGGCACAGAGGGCGCTCTCAGCCGCCGAGTGCCAGCGCTCTGGTTGAACAGAGC TATTCAGACAGAGAAGGTCGGACGGGGAGTTGGACTCGGTACCAGGGGAAGGAAG ATACACAAAGTTCATGCCTCCAAGAGAGGGTTCGGAATTTGAACCGCACCCGTATC CCCAATCTTCTTACCCTCTGA | 9704 |
| | 1 | MANGWTGSRPGRRNPEL* | 9705 | ATGGCCAATGGCTGGACTGGCTCCCGCCTGGGCGGAGGAATCCGAGCTGTGA | 9706 |
| | 2 | MAGLAPALGGGIPSCEAAGIRAHVLLCLLRAEAMAGAG VGCGGGVRWRRSR* | 9707 | ATGGCTGGACTGGCTCCTGCCCATGTGCTCTTGTTTACTAAGAGCGGAAGCGATGCGGGAGCGG GGGTGGGGTGCGGTGCGGGGAGCGGCGGGAGGTCCGGTGA | 9708 |
| hsa-mir-25 | 3 | MCFFVY* | 9709 | ATGTGCTTCTTTGTTTACTAA | 9710 |
| | 4 | MLDGPVHCJHGLFILRWLEITDL* | 9711 | ATGTTGGATGGCCCTGTGCACTGCACGGGCTCTTTATTCTTGCGTGGTTAGAAACA GACTTGTGA | 9712 |
| | 1 | MDSSAVITQISKEEARGPLRGKGTGAAGRGPKPGRRGR REGAGHFFRGAAAAAPGGRLSCARSSQPEKEQGESLNSE EAQRRGAGPGAFCALLFARGEETEAGIEREEFGGFLAGI AWCMGAPPLAPMGLGDGGAEEGAYGPPAETPFHPPPP PPRAAVR* | 9713 | ATGGACAGCTCGGCCGTCATTACTCAGATCAGCAAGGAGGAGGCTCGGGGCCGCT GCGGGCAAAGGTACCGGGCTCGGGAGCTGGAGGCGCCGCCGCCGCCGCCCGGCGG CCGGGCCTTAGCTGTGCCGAAGCTCCCAGCCGAGGCCGAGAGGAGCAGGGAGAGTTGA ACTCAGAGGAGCTCAGAGACGGAGGCCTGGCGCCTTTGGGCGCCTCCTG TTCGCTCGAGGTGAGGAAACTGAGGAATAGAGGGAACCATTGGCGCCAATGGGCT CCTGGCAGGGCATTGCGTGGTGCATGGGGCCTATGGCGCACCCGTGACGCAATGGGCT GGGAGATGGGGAGCTGAGGAGCTGAGACTCCCCCCGGGTGCGGTCCGGTAG | 9714 |

Figure 1 (Continued)

| | | | | | |
|---|---|---|---|---|---|
| hsa-mir-26b | 2 | MGELRRAPMGHPLRLRPTPHPHPPGLRSGRVLGGGAEV TAGWGGLEGSPANTQLRSPQTSRHAWRRPPRRHRED GRHFQESLGARGESRAPSGHAPPLKASPPRRGCVPQRG WAGVGGSVFSFSPCGPQDLDAAPRSAHPRLGLAAPELR ARWKG* | 9715 | ATGGGGGAGCTGAGGAGGGCGCCTATGGGCACCCGCTGAGACTCCGCCCCACCCC CCACCAGCAGGCTGGGGAGGCCCCGGCTGCGGTCCGGTAGGGTCTTGGGAGGGGGGCCGAGG TGACAGCAGGAGGCTGGGGAGGCTGGAGGGATCTCCCGCCAACACAGCTACGTTCC CCACAAACTTCGCGTCACGGTGGAGGCGCCGACCCCTCGGAGGCACAGAGAGGA CGGCCGGCACTTCCAAGAGTCCACTTGGCGCCGCGGGAGAGTCGTGCGCCTAGTG GGCACGCACCACCCGCAAAGCTCCGCAAGCTGCCCGACGAAGGCTGCTCCCCAGCGT GGCTGGGCCGGGGTGGGGGGTCGTCTTCTTCCCCGTGGACCTCAGGAT CTGGACGCTGCCCCAGGTCTGCCCACCCTCGCCTCGCCCGTGCCCCGGAACTG AGGGCAAGGTGAAAGGCTAG | 9716 |
| | 3 | MATGHWPQAAGLHPCLWAQPQ* | 9717 | ATGGCCACTGGACACTGGCCCCAGGCCGCGGGACTGCACCCTGCCTCTGGGCCCA GCCGCAGTGA | 9718 |
| | 4 | MEGGQGWTALGPRPWLS* | 9719 | ATGGAGGGAGGCAGGGTGACTGCCTGGCTACGCCCGCTGA | 9720 |
| | 1 | MEAEVDKLELMVSAK* | 9721 | ATGGAGGCCGAGGTCGATAAGCTGGAACTGATGGTGAGTGCAAGTGA | 9722 |
| hsa-mir-30a | 2 | MASEVGHNLESPETPGGGGWTRVEFPPPAPKGAAATYW CLNRLG* | 9723 | ATGGCTTCGGAGGTGGGGCACAATTTGGAGTCGCCGAACTCCGGCGCGGAGG CTGGACCAGAGTCGAGTTCCCTCCTCCTGCACCAAAGGGAGCCGCCACCGTCTGGTG TCTAAACCGCCTCGGGTAA | 9724 |
| | 3 | MAGDAEGAGPLEFLYPCPHLYTPYETAPGADRILCLYQ KRCFWNGP* | 9725 | ATGGCAGGAGATGCGAGGTGCGGGCCTTTGGAATTCCTTGCCTGTTCCTTGCCCTAC CTTTACACCCTTACGAAACTGCGCGGTGCAGACCGCATTCTGTGTTTGTACCAA AAAGATGTGAATGGAACGGTCCCTAA | 9726 |
| | 4 | MLRVRGLWNSLFLALTFTPLTKLRRVQTAFCVCTKKDV NGTVPKRPKGEVVHTPRKGNGGWGGE* | 9727 | ATGCTGAGGGTGCGGGGCCTTTGGAATTCCTTGTTCCTGCCCTCACCTTTACACCC TTACGAAACTGCGCCGGTGCAGACCGCATTCTGTGTTGTACCAAAAAGATGTGA ATGGAACGGTCCCTAAGCGTCCCAAGGGTGAAGTGGTTCACACTCCAAGAAAG GGGAACGGAGGGTGGGGTGGGGAATAA | 9728 |
| | 1 | MGFQSDVCSCLLPRTSRGYFRSNYLVY* | 9729 | ATGGGCTTTCAGTCGGATGTTTGCAGCTGCCTACTGCCTCGACTTCAAGGGCTAC TTTAGGAGCAATTATCTGTTTACTAA | 9730 |
| hsa-mir-30c-1 | 2 | MFAAAYCLGLQGATLGAHLPTKTEYLAISLIHFYKAELK WYKLNHFKTMSVHF* | 9731 | ATGTTTGCAGCTGCCTGCCTCAAGCTGCACATTTCAAGGGCTACTTTAGGAGCAATTATC TTGTTTACTAAACTGCAATTGTCTGTATCTCTTTGATACATTTTACAAAGCTGAAT TAAAATGGTATAAGAATTTGCAATATCAAAAGAAAGTATTCGTAAGAAAATGAGGAAATG TGTTTACAGTATATTTTATTTTTTAATTTTTTTTAAAAGCGTAG | 9732 |
| | 3 | MHRICNIKKKVFVREMRKCVTVPLFFLKA* | 9733 | ATGCATAGAATTTGCAATATCAAAAGAAAGTATTCGTAAGAAAATGAGGAAATG TGTTTACAGTATATTTTATTTTTTAATTTTTTTTAAAAGCGTAG | 9734 |
| | 4 | MCYSIFIFFKSVVGQYFPEKSMK* | 9735 | ATGTGTTTACAGTATATTTTATTTTTTAAAAGCGTAGTAGGGCAATATTCCAGAAA AATCTATGAAGTGA | 9736 |
| | 1 | MEKLDVLVYILS* | 9737 | ATGGAAAAATTAGATGTCTTGGTGTACATTTTATCCTAA | 9738 |
| hsa-mir-30d | 2 | MSWCTFYPNRFSSFYNHKIGSGKTVDVFPKYLFLTYI* | 9739 | ATGTCTTGGTGTACATTTTATCCTAATAGATTCTCTTCTTTCTATAATCATAAATAG GTTCTGGAAGACTGTTTGATGTTTTCCAAATACCTTTTTTGACATATATTTGA | 9740 |
| | 3 | MFFQNTFF* | 9741 | ATGTTTTTCCAAATACCTTTTTGA | 9742 |
| | 4 | MLVNYIKSEHYAPSIM* | 9743 | ATGCTTGTTAATTACATCAAATCTGAACATTATGCTCCATCAATGTGA | 9744 |
| | 1 | MEKLDVLVYILS* | 9745 | ATGGAAAAATTAGATGTCTTGGTGTACATTTTATCCTAA | 9746 |
| hsa-mir-30e | 2 | MSWCTFYPNRFSSFYNHKIGSGKTVDVFPKYLFLTYI* | 9747 | ATGTCTTGGTGTACATTTTATCCTAATAGATTCTCTTCTTTCTATAATCATAAATAG GTTCTGGGAAGACTGTTTGATGTTTTCCAAATACCTTTTTTGACATATATTTGA | 9748 |
| | 3 | MFFQNTFF* | 9749 | ATGTTTTTCCAAATACCTTTTTGA | 9750 |
| | 4 | MLVNYIKSEHYAPSIM* | 9751 | ATGCTTGTTAATTACATCAAATCTGAATAATATGCTCCTCCATAATGTGA | 9752 |
| hsa-mir-320 | 1 | MLRRSGVLASGRWRGGAKIRVPGFVGHHAAM* | 9753 | ATGCTGCGGCGCTCGGGGTCTGCGCTCCGGGCGGTGGCGTGGAGGCGTGGAGGCGCAAGAT CAGGGTCCGGGTTTTGTCGGCCACCACCGCGCAATGTGA | 9754 |
| | 2 | MGRGARRGAESFWT* | 9755 | ATGGGGCGAGGGCGCCGCCGCGGCGGCAGAGTGAGACCTGGACTTAA | 9756 |

Figure 1 (Continued)

| | | | | | |
|---|---|---|---|---|---|
| | 3 | MVTLEWSLPPGSDLAHFRGPLPCAPGGVLG* | 9757 | ATGGTGACCTTGGAGTGGTCATTACCTCCGGCAGCGACCTGGCCCACTTTCGGGGA CCCTTCCTGTTCCTGTGGAGTCCTGGGTGA | 9758 |
| | 4 | MLSPIPQTV* | 9759 | ATGTTATCCCCATCCCAGACCGTATAA | 9760 |
| | 1 | MSSFGAG* | 9761 | ATGAGTTAGTTTGAGCTGGGTGA | 9762 |
| | 2 | MVSPLF* | 9763 | ATGGTTTCTCCCTTTCTGA | 9764 |
| | 3 | MGKGSVEACLLG* | 9765 | ATGGGGAAGGGCTGGGTGGAAGCTTGCTTGTTGGGGTGA | 9766 |
| hsa-mir-330 | 4 | MGLVSVPDLWGCPGRGWLRENVPEGPGCAHDDPRRAG THLQPGHTLLGAAFLPAQAGVGVSFCWNLLGAPIPPGGN RKAVKAAQACNLSTLLGGSFEAKSLRPAWATHKTSTARS RAMWPEWDWCI* | 9767 | ATGGGGCTGGTGTCAGTGCCTGACCTCTGGGGGTGTCCTGGCAGAGGATGGCTCCG TGAAAATGTTCCTGAGGGGCGCTCCTGGCGCCATGATGATCCAGACGAGCTGGCAC CACCTACAGCTTGGAACACGCTTGGAAGCTGCCTCTGGCGCTCAAGCTGGAGT GGGTGTATCCTTTTGCTGGAATCTCCTTGGTCTCCCCATCCCCCAGGAGGAAATAG AAAGGCGGTCAAGGCAGCTCAGGCTGTAATCTCAGCACACTTTGGAGGATCGTTTG AGGCCAAGAGTTTGAGACCTGCTGGGCAACACACAAAACAAGCACGACGTTCA AGGGCTATGTGGCCAGAGTGGGATTGGTGCATTGA | 9768 |
| | 1 | MGGALPQPRPAATGGRSRGRPWRPDAAAGPAPPCRPR AGRAALLGAPLRAGPRAGPGRSRALLPLTLLGAQGRAA GGRVGVQALQALRALERPRNRPCSPALWGRTGPPAAM QQPPGETRALRTLGGLESSAAA* | 9769 | ATGGGAGGGGCCCTGCCCCAGCCCGCCCGGCCGCCGACCAGGTGGGCGCTCCCGTGG GAGGCCGTGGGCCTGGCCGTCCAGACGCTGCGCAGGGCCCCCGTCCGCCTGCAGACCCCGGG GGACGGTCCGCGCGCTTCCTGGGGCTCCGCTGCGCGCTGTGGCGCCAGGGCCCT CGGGTGGTCCAGCCAGCCCTGCAGGGCCTGCAGGGCCACTGCTCGGAGCGCGAAA CAACCGGCCAGGGGCTCCCCAGCCCGCAGGAAAACCCCAGGCCCTGAGCGGCCCG AGCAGCCCCGGGGAGACACGAGCTCTGAGGACCCTGGGTGGGCTGGAGTCGTCG GCCGCGCGTGA | 9770 |
| hsa-mir-339 | 2 | MMKTIGHASLGSLPEDGGAGRQLLQEALPLLRRGSAGF GLESAEVLLGVGLLSSEEAVARAGGGPVLVLRCVLGASS AAARTAGGRGPGVRTDTRTGLPSLLLGLTAAETAGMV TVASESPAYE* | 9771 | ATGATGAAAACAATTGGGATAGTTCACTCGGGAGCCTTCTGAGGACGGCGAGC TGGGTCGGCAGTCCTTGAAGGAGGCGGAGCGTCTGCTTGGTCGGGCTCAGCGGGTT CCGGTCTGGAGGCGAGAGGAGGCTGGAGCCCGTTTATCTTCTGAGGAGGG TGGCCCGGGCAGTGGGGCCCCGTGGGGTCAGTGCCGGGAGCACCGCTGCCAGAGTCTCT CAGCTGCTGCTGCAGCACCACCTGGGCAACAGTCCGCCAGCCACCACTGCCATCAACGCA ACCGGTGCTAGCTGTCCTCAGAGTCCTTTGCTTTATGAGTAA | 9772 |
| | 3 | MSNSPN* | 9773 | ATGAGTAACTCACCGAATTGA | 9774 |
| | 4 | MNSLCSLRSCGKVRKPNPYLVPRCECFKLCVTTNKIDM MHHFTDI* | 9775 | ATGAATTCGTTCGTTGTTTCACTGAGGAGTTGTGCAAAGTGAGAAAACCTAACCGTAC TAGTTGTCCAGATGTGAGTGTTTAAACTATGTGTAACAACTAACAAATTGACATG ATGATACACTTCACGGACATTTAA | 9776 |
| hsa-mir-33b | 1 | MDCTEGIPGGLPTSPLYNASVSCRFSWGGRACGLRNL SRKEPLPEGEGVTVTSSLGKWRATSWQISVPCNSRGKGL LRDPKAASRPKRVWRERVVFSTFSAPALGQDQEEAGRR ARCPSATASALFSTPAYCGHLRLFRKTVGALDCQNCQF FPQASVSPIYRRGSHGLG* | 9777 | ATGGATTGCACTTTCGAAGGTATTTTGGAGGCGTCCTCGCACCACCCCCCTTATACAAT GCCTAGTGCACTTCTCTGCAGGTTCCTGGGTGGCGGACATGGCGGCTACGCAACTTG AGCAGGAAAAGAGCCCCTTCCGAGGGAGAAGGTGTGACAGTTACCAGCTCGCTGGG GAAGTGGAGGGCTACCTGCAACAAATTAGTGTCCCTGCAACTCAAGGGGAAGG GTTTGCTTAGAGACCCAACATCCGACCATCCGCCTTTGGACAGGACCAGGAACAGG GTGGCCTTCTCTACATTTGTCCGTGCACCGGCCTATCGCAGCACCCCTGCCTAT TGTGGGCATCTAGACTTTTCAGGAAGACAGTGGGCCTTCAGAATGTCAAAATTGT CAGTTTTTCTTTCAGGCCTCAGTTTCCCCATCTATGGAAGAGGGCTCACGGACTG GGGTAA | 9778 |
| | 2 | MPPSPAGSPGVGGHAGYAT* | 9779 | ATGCCTCCGTCTCCTGCAGGTTCCTCGGGTGGCGGGCATGGGGGCTACGCAACT TGA | 9780 |
| | 3 | MRATQLEQERAPSRGRRCDSYQLAGEVEGYLQPN* | 9781 | ATGCGGGCTACGCAACTTGAGCAGGAAAGAGCCCCTTCCGAGGGAGAAGGTGTGA CAGTTACCAGCTCGCTGGCGAAGTTGGAGGGCTACCTGCAACCAAATTAG | 9782 |

Figure 1 (Continued)

| | | | | | |
|---|---|---|---|---|---|
| hsa-mir-340 | 4 | MGNPAVESPL* | 9783 | ATGGGAAACCCTGCAGTTGAAAGTCCATTATGA | 9784 |
| | 1 | MAMT* | 9785 | ATGGCTATGACGTGA | 9786 |
| | 2 | MDFGHGWQ* | 9787 | ATGGACTTCGGGATTGGATGGCAGTGA | 9788 |
| | 3 | MAVTHQC* | 9789 | ATGGCAGTGACACATCAGTGTTAA | 9790 |
| | 4 | MEINFVCRKIPHRG* | 9791 | ATGTTTATAAATTTGTTTGTTAGGAAAATACCACATATTCGTGGTGA | 9792 |
| | 1 | MGCGDE* | 9793 | ATGGGCTGCGGGGATGAATGA | 9794 |
| | 2 | MNESRV* | 9795 | ATGAATGAGAGCCGAGTCTGA | 9796 |
| hsa-mir-345 | 3 | MRAESDSAPQESLTFAVARDCPGPCGASHSVTSHQFFPSASGGPDCQVGAWEQGRARRFLFAVGVRSALLGRAQLPSLGPAGRQGHTVCHYSRPRVTWFFYPNSSGYLPPGGAGRKVLCIWY* | 9797 | ATGAGAGCCGAGTCTGACTCGGCCCCCCAGGAGTTCCTGACATTGCAGTTGCCAGTGGCAAGCAGCCCCCTCGCAGCAGTCCGCTCAGGAGTCTGGGTCCATTCGGTGACTTCCACCAGCCTTCCCGGGCGCCTTGCAGATCTCCAGAGTTCTTCGCTGTAGGAGTCAGATCACCCTTAGGCGTGGCCCAGTTCCTTCTTTAGGCCTGCAGGCAGGCCACAGTTGCCACGTGTGCCACGTTTCCAGGTTAGGGTCACATGGTTCTTTATCCAAATCCAGTGGGTACCTACCTCTGGAGTGCAGTCAGGTCGAAAAGTTCGTGTATTGGTACTAG | 9798 |
| | 4 | MVLLSKFQWVPTSWRCRSKGSVYLVLGHTGRCCQ* | 9799 | ATGGTTCTTTTATCCAAATCCAGTGGGTACCTACCTCTGGAGTGCAGGTCGAAGGTTCTGTGTATTGGTACTACGGACACACAGGTAGGTTGTTGTCAGTAG | 9800 |
| | 1 | MGQGGSECAILARMPVAPAPATASAWAAVPGAPLIKDSSLGEERRENADCGPPVGNWGSVGFSLWRGGGSVS* | 9801 | ATGGGACAAGGTGGTAGTGAGTTGCGCATCCTGGCCCGGATGCCGGTTGGCACCGCTACCGGCTCCAGCTGCCTCTGCCTGGGCGTGTCCAGCTGCGACTGCGATCCGCCCGTGGGTAACTCCAGCTTGGGGAGGACAAGAAGGGAAAATGCGACTGCGATCCGCCCGTGGGTAACTGGGGCTGGTGGCGTTTCGCTTGGCGGTGCGGGGTTCCGTTTCTAA | 9802 |
| | 2 | MPTAVRPWVTGARWGFRFGGGVGVPFPNSCAGRVGGGGLFSLGY* | 9803 | ATGCCGACTGCGGTCCGCCGGCGTGGGCTGGGCGTCGGGGTGTTTCGCTTGGCGGGGTGTTCCTAATTCCTGTGCGGGCCGGGCGGCTGGCTTTTTCCTTGGGCTATTAA | 9804 |
| | 3 | MCARGLDPFSGRPFSLLFPFWLRGRLRSHPAPERSSCALGHWYYVWRGHPERAARAGSPRSPPARGGPELGPARGFPPSGWLGKKGALRWGSCDPVELTGWVGGDGAGGT* | 9805 | ATGTGCGCTCGCGGCCTTGATCCATTTAGTGGACGCCTTTTTCCACTTCTCTCCCTTCTGGCTCTGGGAGACTTACGGTCGCATCGCCGGCCCTGAAGGCTCCAGCTGCGCGCTGGGACACTGGTATTATCGTGGAGGGACACCCGGAGATCCCGGCTCGCCAGGGGACCTGGTGCCGCCGCGGTGCTGGAACTGGGGGCTGTCGAGGAGAGAGCAGCGTCGAGCCGGGACTTGA | 9806 |
| | 4 | MRGCTWREKRDSPPSWLLSHQPGNGGGGRRGLGAFLVL* | 9807 | ATGAGGGGCTGGACGTGGGAGCGGGAAAAAGGGATGGCCTCCTCTCCTTGGCTTCTATCCGGGGAGGGGGTGGAATGGAGGGGAGGGAGGCGTGGAGCTTGGCGCGTTTTTGGGTGCTTTGA | 9808 |
| | 1 | MRRKGAWGSGLSRT* | 9809 | ATGAGGAGAAAAGGTGCGTGGGAGCGGGAGTGCGCTTTCAGAACCTAG | 9810 |
| | 2 | MEHSPNLGAQQI* | 9811 | ATGGAATCATTTCCCAACTGGGGCGCAGCAAATTTGA | 9812 |
| | 3 | MRDD* | 9813 | ATGAGAGACGATTAA | 9814 |
| hsa-mir-365-1 | 4 | MGWGELYEAPRTPDLSAAKGRLGHPSCCPGSP* | 9815 | ATGGGGTGGGGGGAACTGTACGAGGCACTCGGACACCCGGGACCTGCTAAGGGACGTTGGGCACCCCTCGTGTTGTCCGGGAAGCTTTAG | 9816 |
| | 1 | MGAEGWVFAGEMRVSDQLAYKVPVLGPRDQRLLPGPRFPRPASSRAGVRSGQAASQVHAGEGVVRCARPGCVR* | 9817 | ATGGGAGCTGAAGGCTGGGTCTTTGCGGGCGAGATGAGGGTGTCGGATCAACTGGCCTACAAAGTCCAGTTCTCGGCCCGCGGACCAGCAGCTCTTCCGGGACCAAGCAGCTCTTCCGGGCGGCGCCTGGACAGCTGCCTCTCAGGTCCACCCCTGGAGAAGGAGTTGTGAGGTGCGCCCGGCCGGGGTGA | 9818 |
| hsa-mir-365-2 | 2 | MGQALPLTEACPAVLSRAATLSLGVGRTGPDF* | 9819 | ATGGGCCAAGCCCTGCCACTTACGGAGGCCTGCCCTGCTGTTCTGAGCCGGGCCTGAGGAGCTAG | 9820 |
| | 3 | MDLCGCVPNGRSFVP* | 9821 | ATGGATCTTTGTGGATGTGTTCCCAATGGCCGGTCTTTTGTTCCTTGA | 9822 |
| | 4 | MCSQWPVFCSLTDAT* | 9823 | ATGTGTTCCCAATGCCCCGTCTTTTGTTCCCTGACCGATGCAACATAA | 9824 |

Figure 1 (Continued)

| | | | | | |
|---|---|---|---|---|---|
| hsa-mir-371 | 1 | MMTCALVFFTEPLFIKCSIKS* | 9825 | ATGATGACATGCGCTTGGTCTTTTTCACTGAACCTCTTTTTATAAAGTGTTCAATAAAAAGCTGA | 9826 |
| | 2 | MRFGLFH* | 9827 | ATGCGCTTTGGTCTTTTTCACTGA | 9828 |
| | 3 | MYSLHLA* | 9829 | ATGTATTCTTTGCATCTGGCATAG | 9830 |
| | 4 | MQEDHLSPGVPVQPGLTGRTPSLERKKCKKAFFVYYFFETGSPSIPQTGVPWYHHSLLQP* | 9831 | ATGCAGGAGGATCATTTGAGTCCAGGAGTTCCAGTCCAGCCTGGTAACCCCTTCTCTGGAAAGAAAAATGTAAAAGGCATTCTTTGTGTATTATTTTTTGAAACAGGGTCTCCCTCTATACCCCAGACTGGAGTGCCTTGGTATCATCACAGCTTACTACAGCCTGA | 9832 |
| hsa-mir-372 | 1 | MMTCALVFFTEPLFIKCSIKS* | 9833 | ATGATGACATGCGCTTGGTCTTTTTCACTGAACCTCTTTTTATAAAGTGTTCAATAAAAAGCTGA | 9834 |
| | 2 | MRFGLFH* | 9835 | ATGCGCTTTGGTCTTTTTCACTGA | 9836 |
| | 3 | MYSLHLA* | 9837 | ATGTATTCTTTGCATCTGGCATAG | 9838 |
| | 4 | MQEDHLSPGVPVQPGLTGRTPSLERKKCKKAFFVYYFFETGSPSIPQTGVPWYHHSLLQP* | 9839 | ATGCAGGAGGATCATTTGAGTCCAGGAGTTCCAGTCCAGCCTGGTAACAGGTAGAACCCCTTCTCTGGAAAGAAAAATGTAAAAGGCATTCTTTGTGTATTATTTTTTGAAACAGGGTCTCCCTCTATACCCCAGACTGGAGTGCCTTGGTATCATCACAGCTTACTACAGCCTGA | 9840 |
| hsa-mir-373 | 1 | MMTCALVFFTEPLFIKCSIKS* | 9841 | ATGATGACATGCGCTTGGTCTTTTTCACTGAACCTCTTTTTATAAAGTGTTCAATAAAAAGCTGA | 9842 |
| | 2 | MRFGLFH* | 9843 | ATGCGCTTTGGTCTTTTTCACTGA | 9844 |
| | 3 | MYSLHLA* | 9845 | ATGTATTCTTTGCATCTGGCATAG | 9846 |
| | 4 | MQEDHLSPGVPVQPGLTGRTPSLERKKCKKAFFVYYFFETGSPSIPQTGVPWYHHSLLQP* | 9847 | ATGCAGGAGGATCATTTGAGTCCAGGAGTTCCAGCTGTCCAGCCTGGTAACAGGTAGAACCCCTTCTCTGGAAAGAAAAATGCATTCTTTGTGTATTATTTTTTGAAACAGGGTCTCCCTCTATACCCCAGACTGGAGTGCCTTGGTATCATCACAGCTTACTACAGCCTGA | 9848 |
| hsa-mir-374a | 1 | MLWPDPLEINPES* | 9849 | ATGCTGTGGCCAGATCCACTAGAAATTAACCCAGAAATCTTAG | 9850 |
| | 2 | MRRR* | 9851 | ATGAGGAGGCGATGA | 9852 |
| | 3 | MMTLQKVAAAGGA* | 9853 | ATGATGACTCTGCAAAAGGTTGCGGCAGCTGGCGGTGCGTAG | 9854 |
| | 4 | MRKKGALGDRPHLGSTHSEGSLAFRSWVAVLGSEYSHPRVAKHCGCSVRIQC* | 9855 | ATGCGTAAAAAGGGAGCACTTGGAGACAGGCCACATTGGGCAGTACGCATTCGGAGGCTCTCTGGCTTCCGATCTTGGGTCTGTACTTGGCTCTGAATACAGTCACCCCATCAGAGTAGCAAAACACTGTGTTGTAGTGTGAGAATCAATGTAA | 9856 |
| hsa-mir-374b | 1 | MLWPDPLEINPES* | 9857 | ATGCTTGTGGCCAGATCCACTAGAAATTAACCCAGAATCTTAG | 9858 |
| | 2 | MRRR* | 9859 | ATGAGGAGGCGATGA | 9860 |
| | 3 | MMTLQKVAAAGGA* | 9861 | ATGATGACTCTGCAAAAGGTTGCGGCAGCTGGCGGTGCGTAG | 9862 |
| | 4 | MRKKGALGDRPHLGSTHSEGSLAFRSWVAVLGSEYSHPRVAKHCGCSVRIQC* | 9863 | ATGCGTAAAAAGGGAGCACTTGGAGACAGGCCACATTGGGCAGTACGCATTCGGAGGCTCTCTGGCTTCCGATCTTGGGTCTGTACTTGGCTCTGAATACAGTCACCCCATCAGAGTAGCAAAACACTGTGTTGTAGTGTGAGAATCAATGTAA | 9864 |
| | 1 | MAGNDCGALLDEELSSFFLNYLADTQVRPAGAAGPGPGVLSCGGRSCSRGGREAAVGALG* | 9865 | ATGGCGGGAACGACTGCGGCGGCTGCTGGACAGCAGAAGGCTGCTCCTCCTCCTCCTCAACTATCTGCTGACAGCAGCAGCTTCTTCCTGAACTACCTGGCCGACACGCAGGTCCGCCCTGCGGGCGCTGCGGGGCCTGGACCTGGGGGCCAGGGGTGCTGAGCTGCGGGGGCCGCAGCTGCAGCTGCAGCTGCAGCGGGGAGGGCAGCGGTGGGAGCCCTGGGGTAA | 9866 |

Figure 1 (Continued)

| | | | | |
|---|---|---|---|---|
| hsa-mir-378 | 2 | MRSVTGAGSRRSPGCACRSAGGATAAGEGLALAAWSLP PRGQMWGVPRFLWEVEARHGVGYPQAGAGCWRRAVS ARHLLPYFHVDLWPRHGCMPGSPESPPGCSPQSAVA GPPRLSTRARSAEPPASCRLK A* | 9867 | ATGCGCTCCGTTACCGGGCAGGGAGCCGGAGGAGCCGGAGGTCTCCGCGCCGTGCCGAGCGC TGGGGGCGCTACGGCCGCCGCTGGGAGGGTCTAGCCTTGGCCGCTTGGGAGGTGGAGGCGCGCAC CCGCGCGGGCAAAACTGGGCGGTACCCTCAGCTGGCGCTGCGCTGGGTGCTGAGGCCCGTCAGCGCCG GGTGTGGGTACCCTCAGCTGGCGCTGGGCGACTTTCACGTGACTGTGCCCCGGCACGGGTGCATGCCGG GCACTTGCTGCCGTACCTCCGCGCCCAGGCCTGTAGTCCCAGAGTGCTGTTGCTGGCC GTCCCGGAGTCCCCTTTCTACCGGCCAGCGCGGAGTTCCTGCCAGTTGCCGGCTAA GGCATAA |
| | 3 | MRAETASSWFRYRAEPPGKSQAGWGRKDCLGAPGSP CGARPRCALHDAGGREGEAESQALAEPGSPTGDTRVTG EGALVCRGAGERGSWWLGDWERGAAGTSSHQKCCQHE ACAAPTPSPEPTQCLLQA* | 9869 | ATGCGGGCGGAGACAGCGTCTTCCTGGTTCGATTCCGAGAGCCGGGCCAGCCGCCTGGGGG GAAAAGCCAGCTGGATGGGGCGCGAAGGACTCTGCAGTCCACGATGCAGGGGAAGGAAGGCGAGGC GCGGTGCGCGGCCGGTCACTGGCTCGAGCCGGAGCCCACTGGCGACACCGCGTGACAG GGAGTCCCAAGCACTGGCTCGAGCCGGAGCCCACTGGCGACACCGCGTGACAG GAGAGGGTGCTCTGGTGTGGCCGGGCGCGAGCAGGAAGGAAGCTGGTGGCTTGG AGACTGGGAGAGGGGTCTGCTGGGACAAGCAGCCACCAAAATGTCAGCACGAGG GTGCGCGGCGGCCCCACCCCTTCCCATTTCCCAGCAGCCAATGCCTGTTGCAAGCATA A |
| | 4 | MGAEGLSGGAWVPLRCAAPVRAPRCRGKGRRGGVPGT G* | 9871 | ATGGGGGCTGAAGGACTGTCTTGGGGCGCCTGGGTCCCCTGCGTGCCGGGCCCC GGTCGCGCGTCACGATGCAGGGGAAGGCGAGGCGGAGTCCCAGGCACT |
| | 1 | MAIPGRQ* | 9873 | ATGGCGATTCCGGCAGGCAGTGA |
| hsa-mir-423 | 2 | MRNYGDCIFCRGVLNALEVKGLCRQG* | 9875 | ATGAGAAACTACGGCGACTGTATCTTCGGCGAGGAGTTTAAATGCGCTGGAAGTG AAGGGACTGTGTCGTCAAGGGTAG |
| | 3 | MRWK* | 9877 | ATGCGCTGGAAGTGA |
| | 4 | MEARSLREKLYFK* | 9879 | ATGGAAGCGCAAATCTAACATTTAAGTTGAGGAGAAAACTTGTGAGGAAATAA |
| | 1 | MGANLTFKVFNK* | 9881 | ATGGGGGCAAATCTGACATTTAAGGTTAACAAATGA |
| hsa-mir-424 | 2 | MSAAGKPSGNGLGKKKQQLTWRGGERKLSKGQ* | 9883 | ATGAGTGCGCGGCCGGAAATTCTCAGGAAAACGGACTGGGAAAAAACAACAACT AACATGGAGGGCGGGGGAGAGAAAACTGAGTAA |
| | 3 | MEGRGEKTE* | 9885 | ATGGAGGGCGGGGGAGAGAAAACTGAGTAA |
| | 4 | MNFSSYLQEVSYVLERNV* | 9887 | ATGAACTTTCCTCTTATTTGCAAGAAGTTAGTATGTCTTGAAAGAAATGTCTGA |
| hsa-mir-425 | 1 | MGGF* | 9889 | ATGGGCGGGTTCTGA |
| | 2 | MWPQGE* | 9891 | ATGTGGCCCCAGGGCGAGTGA |
| | 3 | MGCP* | 9893 | ATGGGGTGCCCCTGA |
| | 4 | MGVDVGEPRLVAISGTLGRGEGGWTQDLWVGLQW* | 9895 | ATGGGTGTAGACGTGGGAGAGCCGAGGCTGGTTGCCATCTCTGGAACCCTGGGGAG GATTGGCGAGGAGGGTGGACCTGGACCTCTGGGTAGGCTGCAATGGTAG |
| hsa-mir-429 | 1 | MGCRQPGQRPGELRSLQTQAGAGPSPPQGKVGPCADA AGFRVWSHLGPTGCVFRARAQCVGSRHGVPSEGQGLGR GQAPRGYTFLPPT* | 9897 | ATGGGCTGTCGCCAGCCGGGTCCTTCCCCCCACCAGGGAGCTCCGTTCACTGCAGACACA GGCTGAAGCGGGTCCTTCCCCCCACCAGGGAGCTCCGTTCACTGCAGACACA CTGGGTTCGGCGTTGGGGCTCAGGCATGGGGTGCCCTCAGGGAGGGCTGGCAGAGGG CAGGCTCCAGAGAGGGTCACGTTCTTCGCGCCTACCTGA |
| | 2 | MRLGFGCGAILDPRAASSGHGHSVWAPGMGCPQGRAW AEGRLREGSRSCRLPDSRPSRKFSPEAATAVLRHFVRRR EAVASEVGA* | 9899 | ATGCGGCTGGGTTCGGCGTGGGCGCCATCTTGACCCACGGGCTGCTCTCCGG CACGGGCACAGTGTGGGCTCCAGCATGGGGTGCCCTCAGGGAGGGCTGGCAGAGGG AGAGGGCAGGCTCCGAGAGGGTCACGTTCTTCGCCGCTACCTGACAGCAGGCCTT CTAGAAAGTTCTCTCCGCCTCAGAGAGTCGGAGAC GGGAAGCTGTCGCCTCAGAGTCGGTCGTGA |

Figure 1 (Continued)

| | | | | | |
|---|---|---|---|---|---|
| | 3 | MTASPLQSSGVCGGKGLVSAPSGQRPAEPMGGEVGAWG RGWSGTGGAQPGEAGAGSQAPRYDWGGGNVSREVFY LNVKRLSTVAAGNKVRPTEAQP* | 9901 | ATGACCGCGTCTCCTTGGGCTCTGGAGTCTGCGGTGGGAAGGGCTTGTTTCAGCA CCCTCTGGTCAGAGGCCGGCCGGCCATGGGCGGTGAGGTTGGTGCCTGGGGTCG TGGCTGGTCGGTACAGGTGGGGCTCAGCCCGAGAAGCTGGAGCCGGTTCCAGG CCCCGGCTATGACTGGTGGTGGGGGCAACGTCTCTGTGAGGTTTTTACTTAAATG TGAAACGGCTCAGTACGGTGGCCGCAGCCGGGAACAAGGTCCGACCACCGAGCCG CAGCCTTGA | 9902 |
| hsa-mir-449a | 4 | MTGVGATSLVRFFT* | 9903 | ATGACTGGGGTGGGGGCAACGTCTCTCGTGAGGTTTTTACTTAA | 9904 |
| | 1 | MVLGDGTPGV* | 9905 | ATGGTTCTGGAGGACGGGACTCCAGGGTTTGA | 9906 |
| | 2 | MEWKLERTAPRRVRTEEEMLWVSNTLFCILPNSLMRGR RPRS* | 9907 | ATGGAGTGGAAACTGGAGCGCACCGCGCCGCGCTGGAGGTCCGCACGGAAGAGGAGAT GCTGTGGGTGAGTAACACCCTTTTCTGCATTCTCCCTAACTCTCTAATGCGGGGCCG AAGGCCCCGTTCATAA | 9908 |
| | 3 | MIFLNSFSLNMLSVPSKESIMRVLSKDLKQKRSQDSANV SPGLVLVLCFNSDLEQTNSW* | 9909 | ATGATTTTCCTAAATAGTTTCTCCCTCAATAGTTATCTGTTTCAAGGAAAGTA TCATGCGTGTCCTCAAAGACTTGAAGCAGAAGAAGTCAAGATTCGACCCAAC GTGAGTCAGGGCTGTCTTGTTCTGTTTTAATTCGATCTGAACAAACGAATT CTTGGTAA | 9910 |
| | 4 | MRILVSYYILKKISL* | 9911 | ATGAGAATTTAGTATCTTATTACATACTAAAAAAATTTCTTATGA | 9912 |
| | 1 | MVLGDGTPGV* | 9913 | ATGGTTCTGGAGGACGGGACTCCAGGGTTTGA | 9914 |
| | 2 | MEWKLERTAPRRVRTEEEMLWVSNTLFCILPNSLMRGR RPRS* | 9915 | ATGGAGTGGAAACTGGAGCGCACCGCGCCGCGCTGGAGGTCCGCACGGAAGAGGAGAT GCTGTGGGTGAGTAACACCCTTTTCTGCATTCTCCCTAACTCTCTAATGCGGGGCCG AAGGCCCCGTTCATAA | 9916 |
| hsa-mir-449b | 3 | MIFLNSFSLNMLSVFSKESIMRVLSKDLKQKRSQDSANV SPGLVLVLCFNSDLEQTNSW* | 9917 | ATGATTTTCCTAAATAGTTTCTCCCTCAATATGTTATCTGTGTTTCAAAGGAAAGTA TCATGCGTGTCCTCAAAGACTTGAAGCAGAAGAAGTCAAGATTCCGCCAAC GTGAGTCAGGGCTGTCTTGTTCTGTTTTAATTCGATCTGAACAAACGAATT CTTGGTAA | 9918 |
| | 4 | MRILVSYYILKKISL* | 9919 | ATGAGAATTTAGTATCTTATTACATACTAAAAAAATTTCTTATGA | 9920 |
| | 1 | MGANLTFKVFNK* | 9921 | ATGGGGGCAAATCTGACATTTAAAGTGTTTAACAAATGA | 9922 |
| | 2 | MSSAAGKFSGNGLGKKKQQLTWRGGERKLSKGQ* | 9923 | ATGAGTGGCGCCGGGAAGTTCTCAGGAAACGGACTGGGAAAAAAAAACAACT AACATGGAGGGGCGGGAGAGAGAAACTGAGTAAGGGGCAGTGA | 9924 |
| hsa-mir-450a-1 | 3 | MEGRGEKTE* | 9925 | ATGGAGGGGCGGGAGAAAACTGAGTAA | 9926 |
| | 4 | MNFSSYLQEVSYVLERNV* | 9927 | ATGAACTTTTCCTCTTATTGCAAGAAGTTAGTATGTGTTGAAAGAAATGTGA | 9928 |
| | 1 | MGANLTFKVFNK* | 9929 | ATGGGGCAAATCGACATTTAAAGTGTTTAACAAATGA | 9930 |
| hsa-mir-450a-2 | 2 | MSAAGKFSGNGLGKKKQQLTWRGGERKLSKGQ* | 9931 | ATGAGTGCGGCCGGGAAATTCTCAGGAAACGGACTGGGAAAAAAACAACT AACATGGAGGGGCGGGAGAGAAAACTGAGTAA | 9932 |
| | 3 | MEGRGEKTE* | 9933 | ATGGAGGGGCGGGAGAAAACTGAGTAA | 9934 |
| | 4 | MNFSSYLQEVSYVLERNV* | 9935 | ATGAACTTTTCCTCTTATTGCAAGAAGTTAGTATGTGTTGAAAGAAATGTGA | 9936 |
| | 1 | MLGTPGGACPRGPAASSGSVPSR* | 9937 | ATGCTGGGAACCCCTGCTGCCCTCGGCTTTTTTTCCTCTCGCCCTGCAGCCTCGTCAGGCTC AGTCCTCCGATAA | 9938 |
| hsa-mir-484 | 2 | MKNPYPSAFFFSSLGSRHVMYLLYF* | 9939 | ATGAAAAACCCCTGCTCCCTTGTTTCCCCAGCAATCCTAAATCTAGTGCAACCTAG | 9940 |
| | 3 | MAHPQHPKSSAT* | 9941 | ATGGCACATATTCCCAGCAATCCTAAATCTAGTGCAACCTAG | 9942 |
| | 4 | MNTAPPVTGWASRKEJLRLVSSNTLCFRWPDMILCGLL* | 9943 | ATGAATACTGCGTTCCAGTTCCAGTGGACAGGTTGGGCGAGCAGAAGGAAATCTTACGGTT AGTTTCAAACACTTTGTGTTTTAGGTGGCCAGATATGCTGTGTGGTTTGCTTTAA | 9944 |

Figure 1 (Continued)

| | | | | |
|---|---|---|---|---|
| hsa-mir-497 | 1 | MSKPPHRPEHPSSRFLSCSPMHSNKDTLRSEGEGPGPDIQ PRGPWSAIPGQLYTLPSPNPGSPCLAAGPESSTPSPNELC LACPQCYLPKQNMRV* | 9945 | ATGTCAAAGCCACCTCAATGTCCTGAATTTCCCAGTTCCCGGTTTCCTGAGCTGTTCTT TCATGCATTCAAATAAGAGACACACTTCCAGTCTCGGAGGGAGGGCCTGGGCCTGAT ATCCAGCCCGGTGAACCATGTCGGGCATTCCTGGCCAACTGTACACTCTCCCCAGCC CCAAATCCGGGGGAGCTTCTGCCTGCCCGGCCAATGTCCCCAGCTGATTCAGCTGCCTTCTCA AATGAGCTTTGCCTTGCCTTGCCTGCCCGCCAATGTCTCCGAAACAAATATGAGGGTGTGA |
| | 2 | MVGHSWPTVHSPQPKSGELLPCSWIQL* | 9947 | ATGGTCGGCCATTCCTGGCCAACTGTACACTCTCCCCAGCCCAAATCCGGGGAGCTT CTGCCTTGCCAGCTGGATTCAGCTCTAG | 9948 |
| | 3 | MSFALPARNVSRNKI* | 9949 | ATGAGCTTTGCCTTGCCTTGCCGCAATGTCCCGCAAACAAAATATGA | 9950 |
| | 4 | MSPETKYEGVIHAHLSDQGLQIRVVKPPPALSPSSLFSLL VYPTQF* | 9951 | ATGTCTCCCGAAACAAAATAGAGGGTGATCCATGCCAGATCTCAGATCAGGGA CTTCAAATTAGGGTGGTTAAGCCCCCTCCTGCCCTCTCCTCAGTCTCCTTGTTTTCCC TTCTCGTTTACCCCACCCAATTTTAA |
| hsa-mir-503 | 1 | MGANLTFKVFNK* | 9953 | ATGGGAGCAAATCTGACATTTAAAGTGTTTAACAAATGA | 9954 |
| | 2 | MSAAGKFSGNGLGKKKKQQLTWRGGERKLSKGQ* | 9955 | ATGAGTGCGGCCGGAAATTCTCAGGAAACGGACTGGGAAAAAAAAACAACT AACATGGAGGGCGGGAGGCGGGAGAGAAACTGAGTAAGGGGCAGTGA | 9956 |
| | 3 | MEGRGEKTE* | 9957 | ATGAGCGGCGGCGGGAGAGAAACTGAGTAA | 9958 |
| | 4 | MNFSSYLQEVSYVLERNV* | 9959 | ATGAACTTTCCTCTTATTTGCAAGAAGTTAGTTATGCTTTGCAAGAAATGTGTGA | 9960 |
| hsa-mir-505 | 1 | MFRRSLNRFVSTLAAAPRYPVCLLASPFAGSLTIH* | 9961 | ATGTTCCGCCGGAGCTTGAATCGTTTTGTAAGTACACTGCTGGCTCCGCGGTG CCGGTTTGCTCGCCAGCCCTTCGCCGGCCTCACAACAATTTCTGA | 9962 |
| | 2 | MAFYSQGGCFLLPLPRAHGGKPRPVTVAQKKSWGLRE PEIRARLSLA* | 9963 | ATGGCGTTTATTCTCAGGAGGTTGCTTTCTTTGTTTCCTCTGCCAGCAGCACATG GAGGTAAACCTAGAGCCGTCACGGTGGCCCAAAAGAAGAGCTGAGGAGG CCGGAGACTAGGGCAAGACTCAGCCTTGCCTAG | 9964 |
| | 3 | MEVNLDLSRWPKRRAGG* | 9965 | ATGGAGGTAAACCTAGACCTGCACGGTGGCCCAAAGAAGAGCTGAGGGCTGA | 9966 |
| | 4 | MCSREEAAPPLPVLPISGLKPRGGLSTPDLEPMGEGGL* | 9967 | ATGTGCAGCCGCCGGAGGAGCTGCGCCGCACTGCCCGTGCTGCCGATCTCTGGTCTG AAGCCTCGCGGAGGACTGAGCACTCCAGACTTGAACCCATGGGAGAAGGCGGACT GTGA | 9968 |
| hsa-mir-542 | 1 | MGANLTFKVFNK* | 9969 | ATGGGAGCAAATCTGACATTTAAAGTGTTTAACAATGA | 9970 |
| | 2 | MSAAGKFSGNGLGKKKKQQLTWRGGERKLSKGQ* | 9971 | ATGAGTGCGGCCGGAAATTCTCAGGAAACGGACTGGGAAAAAAAAAACAACT AACATGGAGGGCGGGAGGCGGGAGAGAAACTGAGTAAGGGGCAGTGA | 9972 |
| | 3 | MEGRGEKTE* | 9973 | ATGGAGGGCGGCGGGAGAGAAACTGAGTAA | 9974 |
| | 4 | MNFSSYLQEVSYVLERNV* | 9975 | ATGAACTTTCCTCTTATTTGCAAGAAGTTAGTTATGCTTTGCAAGAAATGTGTGA | 9976 |
| | 1 | MLWPDPLEINPES* | 9977 | ATGCTGTGGCCAGATCCACTAGAAATTAACCAGAATCTTAG | 9978 |
| | 2 | MRRR* | 9979 | ATGAGGAGGCGATGA | 9980 |
| | 3 | MMTLQKVAAAGGA* | 9981 | ATGATGACTCTGCAAAGGTTGCGCAGCTGCCGGTCGTAG | 9982 |
| hsa-mir-545 | 4 | MRKKGALGDRPHLGSTHSEGSLAFRSWVAVLGSEYSHP BRVAKHCGCSVRIQC* | 9983 | ATGCGTAAAAAGGGAGCACTTGGAGACAGGCCACATTTGGGCAGTACGCATTCGGA GGGCTCTTGGCTTCCGATCTTGGGTCTGTACTTGGCTCTGAATACAGTCACCC CATCAGAGTAGCAAAACACTGTGGTTGTAGTGTGAAGAATCCAATGTAA | 9984 |
| | 1 | MSLDWACLSSWGRATSWGPAHTRTHVERVCKSTPVLL TEGDYSTVFLGLFFTSGLTLAARGSPPGLGCWIPATRG KHWRHDPGSTSRGARTGRGAAGLAAAAAARGWAGL GCGEMTSPSPRAPW* | 9985 | ATGTCTCTGGATTGGGCTTGCCTCTCTTCCTGGGGAAGAGCYCACTCTTGGGCCT GCACAAGGTGATTACAGCAGCCGTGGTGTAATTTACGTCAGGCCTC ACGCTCGCTGCACTGGGATCGCGCAGGAGCTGCTGGATCCCGGGCACTG GGGAAGCACTGCGGCACGATCCCGATCGACCTCGGCCCGGCCACTGGCC GCGGGCTGTGGGACTGGGGCCGGGCCGGCGCGGGGTGGGGCCCGGCT TGGCCTGCGGGAATGACGTCCCCGGTTCGCTAA |
| | 2 | MWKGSVNRHPFC* | 9987 | ATGTGGAAAGGGTCTGTAAATGACACGCCCTGCTAA | 9988 |

Figure 1 (Continued)

| | | | | |
|---|---|---|---|---|
| hsa-mir-548b | 3 | MSPPIPAAARPVSSSLRSLAESSVRAASGTRGAALSSTPP PGAGRGASKSWPGPRPPPPNPGHLPRAVVPAASGRRBR PVPSRGIDPGVAGGTAPAAESGGRRVSGREAAAATLASR ASLLHGPASTRGDRCPGWGLLGRWRPRA* | 9989 | ATGTCCCCGCCTATCCCCGCGCAGCCGCCCGTCTCTCCTCCGCAGCTCG CCGAGTCCTCGGTGCCGGCGTGCGAGCGGGACCCGGAGCTGCGTCCTGACG CCTCCCGCCAGGCGGCCATCTCCGAGGAGCTCGCCGTTGTCCCGCCTGGTC GCGGCCCAACCCCGGCATCTCCCGCCGTTGTCCCGCCTGGCTTCGGGCCGGC GGACCCGCCTCCTCCAGGGGTGACCCCGGGTGCCGCGGTTGGGACGGCGCCTG CGGCCGAGTCTGGGCGCGCCGTCCACGGCCGTGCGGTCGCCTCCACCGACCCGGACTCTT GCCTCCCGGGTCGTTGGGAAGATGGCGACCCGGACATGA GGCTGGGGTCTGTTGGGAAGATGGCGACCCGGACATGA | 9990 |
| | 4 | MATPGMSWQQHYYGGSAAKEAPSPATAQLAGHSMDY SQEMHLKMSKKIAQLTKVRGAATGQVATPCGPRRTHL SPREAVRPAPAARGTLLRRSNSRRHLQNPANFGGTLA I* | 9991 | ATGGCGACCCGGCATGAGCTGGCAGCAGCACTATTACGGCGGCTCGGCGGCCAA ATTCGCGCCCTCGCCGCCACCGCACAGCTGGCTGGGCACAGTGACTACAGCC AGGAGATGCACCTGAAAATGAGCAAGAAAATGCCCAGCTCACCAAGGTAAGGGGG CGGGACGACGGGCAGGTGGCGACCCCGTGCCGGGCCGGGACTCACCTGTCTC CGGGAGGCAGTGCGCGCTCCAGCGAGGGGAACTCTACTCCTCCGCGAA GCAACAGCCGGAGACCTGAACACCCTGCAAACTTTGGTGGAACGCTGCAACA TGA | 9992 |
| hsa-mir-548c | 1 | MVKRQ* | 9993 | ATGGTGAAAGACAGTAG | 9994 |
| | 2 | MINACKGASLLYDKSWLI* | 9995 | ATGATAAATGCATGCAAAGGAGCTTCTCTATGACAAGTCTTGGCTAACTTAG | 9996 |
| | 3 | MHAKELLFYMISLG* | 9997 | ATGCATGCAAAGGAGCTTCTCTATGACAAGTCTTGGCTAA | 9998 |
| | 4 | MQRSFSSI* | 9999 | ATGCAAAGGAGCTTCTCTATGA | 10000 |
| | 1 | MPGGTDPSPRTRARSSRGCTWAVAAGYFYPSPFLLLPG RRGLPPGPARVGLHPGRNPALNTGGAATA* | 10001 | ATGTTTGGAGGTACGGACCCTCGCGCACCCGCGCTCTCGGTCTCGCGGCTGC ACGTTGGGCCGTGCCGCCGCCGGCTATTTTACCCTTCCGGCCGCCGTCTCCGGCCGGGCC GCCGGGGCTGCCTCCCGGGACCCAGCCCCGCTGCGGTCTCCATCCTGGAAGAAACCCG GCGCTTAACACCGGCGGTGCCGCTACCGGCATAG | 10002 |
| hsa-mir-550-1 | 2 | MTGANVVLQQTDETALVLVVVFSTRKSGGDQLLNVVLS GDSSGEQFLKAKSQSVSNEH* | 10003 | ATGACTGGAGCAAATGTGTTTTTACAACAACCGACGAAACAGCCCTTGTGGTTGTG GTTTTTAGTACCAGGAAGTCAGGAAGTCAGGAGAACCAGTTGCTAAATGTAGTTCTATCTGGG GACTCGAGTGGGGAACAGTTTTAAAGGCCAAAAGTCAAAATGAACA CTGA | 10004 |
| | 3 | MLFYNKPTKQPLWLWFLVPGSQEETSC* | 10005 | ATGTTGTTTTACAACAAACCGACGAAACAGCCCTTGTGGTTGTTGGTTTTTAGTACCA GGAAGTCAGGAGGAGACCAGTTGCTAA | 10006 |
| | 4 | MNTELPCLDRLLV* | 10007 | ATGAACACTGAGTTACCATGTTTGACCGACTTTTAGTATAA | 10008 |
| hsa-mir-550-2 | 1 | MAAVTAAAGEEAVGRPGAPSATAESGGPSWRTETSGS RTAT* | 10009 | ATGGCGGCCGTAACAGCGGCGGCGCCGAGGAAGAGGCCGGTGGGAGGCCCGGGCGC CAAGCGCCGACGGCAGAAAGCGGCAGCGGCCGTCATGGCACCGAAACCAGCGGC AGTCGCACGGCCACCTGA | 10010 |
| | 2 | MAHRNQRQSHGHLSRPFLLEPARGACSRDTFLSASPRLP RPRQAASLAHRPEKSAPGADCPSGRRAAALDVRGPLWA GRGASALPSSSRVRSYPLCSRGTARGPVRSKADRSARQS GLAAANGARARTRLGSTFQ* | 10011 | ATGGCCGCACGAACCAGCGGCACGGCACGTGCCAGCGGACACCTTCCTCTCGCCTCTG GAGCCAGCCGTCAGGCGCCAGCTTGCCCACCGCCCGAGAAGAGCGGCCGCCCT CGGACTGCCCTCGGGGCCCTGGCCCTGGACGGTGGGTCCGGTTCGCTCTACCCTC TTGGCTCTCGGGGGCACAGCGGCCAGGCGGCGGACCAGGGGACGAGGCGCC AGGCAGAGCGGCCTGCCCGCCCGTAACGCGCACGGCGCGCTACTCCGGCTCCGGATC TACCCTTCCAGTAG | 10012 |

Figure 1 (Continued)

| | | | | | |
|---|---|---|---|---|---|
| | 3 | MGPGPGLGAGGPPRCGSRLRCPALTSPAPRAAPRWPR QPRAAVSWGAWRRGPARRSPPSASRTAAAVRRTRRTR CTAALRMAAAASTGRWAGAPAGRAW* | 10013 | ATGGGACCGGGACCAGGCTGGGGCGGGGGCCCGCCCGCCGCGGGGAGGTTCCC GGCTCAGGTGCCCAGCGCTCACCAGCCCAGCTGTTTCCTGGGGGCGCCTCGGGGCGCGCCTGCCCT CGGCAGCCCCGGCCCAGCTGTTTCCGAACAGCAGCAGCGGTCCGCAGGACTCGGAGGACTCG CAGTCCTCCTTCAGCATCCGAACAGCAGCAGCGGTCCGCAGGACTCGGAGGACTCG GTGCACAGCAGCCCTGAGGATGGCGGCGGCCAGCAGCCGCGCTGCTCCGGCGCTGC GAGCCCCGGCCGGGCCGCTGGTGA | 10014 |
| | 4 | MFGGTDPSPRARARFSRGCTWAVAAGYFYRSPFLLPPG RRGLLPGPARQGLLPGPARAGLHPGKKPGT* | 10015 | ATGTTTGGAGGTACGGACCCTCGCCCGGCTATTTTACCGTTCCTGTTCTCCGCCTGC ACGTGGGGCCGTGCCGGCCTCCCGCGCCCCAGCCCCAGGCGCTGCTTCCCGGGCCGCCGGGGC GCCGGGGGCCTGTTCCCGCCGCCCCAGCCGCGGCTGCTTCCCGGGCCGCCGGGGC GCCGGTCTCCATCCTGGGAAGAAACCGGCACGTAA | 10016 |
| hsa-mir-553 | 1 | MNQGF* | 10017 | ATGAACCAAGGTTTCTGA | 10018 |
| | 2 | MAGPRVEVDGSIMEGVSTERSORGCSLTKEGSSHHRCA YFSSPCTPTFAGRPDPESLYGLIELSPRPPLAGAEDFSRPE HARPEVNLAGHGVGP* | 10019 | ATGGCGGGGCCGGTGGAGGTCGATGGCAGCATCATGGAAGGGTGAGTACAG AGCGAAGCGGCCGGGCTGCAGCTCAACTAAGGAGGGGAGCTCTCACCACCGGTGT CTTACTTCTCTCCCGTACCCCAACCTTTGCAGGGCGGCCAGATCCGAGAGT CTCTACGCCGCCTTGAGCTGTCTCCTAGGCTCCCTTGCGGTGCAGAAGATCCGAGC CGGCCGAGCACGCCAGCCTGAGGTAAATCTGCTGAGGGGAGTGGGCCGTG A | 10020 |
| | 3 | MAASWKG* | 10021 | ATGGCAGCATCATGAAGGGTGA | 10022 |
| | 4 | MGDPGRGTLPGRWPGL* | 10023 | ATGGGGATCCAGGCGGGCACTCTGCCGCGTGGCTGGGTTGTAA | 10024 |
| hsa-mir-554 | 1 | MNGTRNWCTLVDVHPEDQAAVRKSALAVFSVLYSRFL SPPLPCPAPCWLTSPGARLARSALRGASLFFFCLRRAV GVAG* | 10025 | ATGAACGGGACGCGGAACTGGTGTACCCTAGTTGAACGTGACCTAGAGGACCAGGC GCGGTAAGAAAAGCGCTCTCGCCGTGTTTGTATTCCGGTTTCTAAG TCGCCCCTTCCGTGCCCGCCGGCCCGTGTTGCCATCACCTGGTGCCGGCTCGC GCGGTCAGCCTGCCGGCGCTTCTCTTTATTCTTTGCCTGCGACGGCAGTG GGAGTCGCGGGGTGA | 10026 |
| | 2 | MSSSDWVPERLWTLCPAEEA* | 10027 | ATGAGCTCAAGTGACTGGGTCCCTGAGCGCCTTTGGACGTTGTGTCCTGCCGAGGAG GCTTAG | 10028 |
| | 3 | MVLWMISNKKNGRVNYRAWTGKRGASRGR* | 10029 | ATGGTGCTTTGCATGATCAGTAACAAGAAAAATGGTAGAGTAAATTACAGGGCTTG GACTGGAAGGGGCGGGGAAGTAGGGGACGGTAG | 10030 |
| | 4 | MQNPGREGEGSDPSEGFWTGRGLRRKGAFSSAGWSTP LSSFSGSQSQFSPP* | 10031 | ATGCAAGAACCGGGTTGCGGAGGCCGAGAAGGAGGGAGCGTTCTCCAGTGCAGGCGAAGGCTTCTGA CGGGAGAGGGTTGCGGAGGCCGAGAAGGAGGGAGCGTTCTCCAGTGCAGGCTGGTCTACCCCT CTCTCCTCTTTCTCTGGCTCCCCAGTTCCCAGTTCTCCCACCCTAG | 10032 |
| hsa-mir-559 | 1 | MAPPQVLAFGLLLAAATATFAAAQEGEARIGAELWSW AGLGLGSGPRFSAPETGHGRGPRGRAFQRGDRTVRPCSG SGPPRGRKRRGPSRGAASLRSFARLGREMALGGGGGQA GNGVATSRFFAATEPVPRALAHPRPFGVDLGFQNSPSR WRSLYDRDQRARPCPC3GPRMWA8GGDRRPQGGLQGR YAPARGRRPGPHRACCGFPFSKDHMSNARLJVGENAEHT VKSKNI* | 10033 | ATGGCCCCCCCGCAGGTCCTGCGTTCGCGTTCGGGCTTCGTTGCCGGCGACGGCGACT TTGCCGCCAGTCAGGTCGGGAGGTGAGGCGTCGATTGAGCAGAGTTGTGAACTGGGC TGGGGGGGCCCAGCTCAGGAACGTCCAGGTGAGACGGGCAGGGGCGGGCAGAGGGCATAATAGGAA GGGACCAAGAGGCCGCCGCCTTCCAGCTGGAAACGGCAGGGCGGCCGTCCGGGAGCAGCTC GGCTCAGGCGCCCTTGCCGCCGTCGCGTGGTAGGAAACGGGAGGCCCGTCCGGGAGCAGCTC ACTTCGCAGCTTTGCCGCCGTCGCGTGGTAGGAAATGGCCTTGGGGAGCGGGGGAC AGGCAGGGAACGGAGTGCCCACCCACGTGGCACGCCACGGGAACGTCAGGGAGCCAGTGGGGACTTGGGGTTCAAAACAGC CCCAGCGCCTGCGAGTCTTACCAGCAGGGACCAGGGACGCGCCCGTTGGGGACTTGGGGTTCAAAACAGC AGCGGGCCGCCGATGGCTGGGCTCCAGGGGGGACAGGGACGGCCCCCCCGGAGGAGCGGGCGCCCCCCGCCCCCGAGAGCCTCCA GGGCGCCCGGCTGATCACTTGCGGCCGGACCAGAGGCTCCTCAAGGCTCTTCAAGGCCGGTGGCCGGTGGGGCCCCGATCATAGAGTAAAAAACATGTA AATAATAACCGTAAAGAGTAAAAACATATAA | 10034 |
| | 2 | MHLRAAGGPDHTGRVGVFPFLRII* | 10035 | ATGCACCTTGCGCGCGGCAGGCGGCCCGGACCACACAGGCGTGTGGGTGTTTTCCC TTTTCTCAAGGATCATATGA | 10036 |

Figure 1 (Continued)

| | | | | | |
|---|---|---|---|---|---|
| | 3 | MPGLL* | 10037 | ATGCCAGGCTTATTGTAG | 10038 |
| | 4 | MARSRLTATFASRVQVILLPQPPE* | 10039 | ATGGCGCGATCTCGGCTCACTGCAACTTTCGCCTCCTGCCCGGGTCAAGTGATTCTCCTG CCTCAGCCTCCTGAGTAG | 10040 |
| hsa-mir-561 | 1 | MWAWGWGGAKLRGRAADTLKLRGRAQRKGRRPHG YPSAARVK* | 10041 | ATGTGGGCATGGGGGTGGGGAGGGCGCGAAGCTCAGAGCTGGGTAGGAGGCCAAAGGAAGGGGCGCGTCCACATGGTTACCCTT CTGCTGCGCGGGTCAAGTAG | 10042 |
| | 2 | MGVGRREAPRPGRGYFKAQSWEGPKEGAASTWLPFCC AGQVASSGGRKARRG* | 10043 | ATGGGGGTGGGGAGGCGCGAACTCCGAGGCCGGATACTTTAAAGCTCA GAGCTGGGAGGGGCCCAAAGGAAGGGCGCGTCCACATGGTTACCCTCTGCTGCG CGGGTCAAGTAGCTTCTCTGGAGGCGCAAGGACGCGGGGGTGA | 10044 |
| | 3 | MVTLLLRGSSSFFWRAQGAAGVMSPWVLAPTAKFAWP GPPSRGLTRHTDQNPEQAVLSILRLLRLPR* | 10045 | ATGGTTACCCTTCTGCTCGCGGGGTCAAGTAGCTTCTCTGGAGGCGCAAGGACGCG GCCACCCTTCTGCGCCTCACTCGCCACACGGATCAGAATCCGAGCAGGCAGTTCTC TCTATTCTGAGGCTCCTGCGCTCGCCGGCTGA | 10046 |
| | 4 | MCLRC* | 10047 | ATGTGTTTACGATGTGA | 10048 |
| hsa-mir-563 | 1 | MRRRKPQGWARGRGSGGAGESAGVRACGGRPGVPAPR RCRLRRGRRSSPGRRWRGEVGNGPGLARGGGARTPPSA RARLRSWVRDRKGWKGWAPGGCGEWRWASRTCTWR KRENVPLGLGRVGSQQVG* | 10049 | ATGCGGAGGAAGCCGCAAGGTTGGCGCGGCAGGCCGCCGCTCTGCGGGGCGGGGG AGTCGGCAGGGTGCCGGCCGTGTAGGCGCCCGGGGCGGAGTTCCGGGAGTGGCGCG TGCCGCCTCAGGCCCGGCGACTCGCACGTTGAGGTGAGGGACGGCGACCCTCAGCCAGG GAACGGCCCGGGACTCGCACGTTGAGGTGAGGGACGGCGGGAGTCCGGGGCACCTG GCAAGACTAAGGAGGCTGGGGTGGCGGACGTGGTGGCGGGAAGCGTGGGCACCTG GCGGCTGCGACGAGTGCGGATGCGCAGGCCGGACTTGCACGTGGAGAAAGCGTGA GAATGTGCCCTGGGTTGGGGAGCGTGGAGAAAGCGTGA | 10050 |
| | 2 | MGEPDLHVEKA* | 10051 | ATGTGCCCTGGGTTTGGGAGGACCCAAGGAGTGGGATGGAGAGGTGGTC | 10052 |
| | 3 | MCPWVWGGWGAKEWDERWSRNGGRCCPPRGLQAET G* | 10053 | ATGTGCCCTGGGTTTGGGAGGACCCAAGGAGTGGGATGGAGAGGTGGTC ACGGAATGGGGGGGCTGCTGTCTCCCCGGGGCGTCAGGCCGAGACCGGGTGA | 10054 |
| | 4 | MRGBHGMGGAAVLPGGCRPRPGEGRG* | 10055 | ATGAGAGGTGGTCACGGAATGGGGGGCTGCGAGAATGGGCGCAGCCGGTTGA GAGACCCGGTGAGGGTCGGCCACGCGCAGGCCGTTGA | 10056 |
| hsa-mir-564 | 1 | MDSVGRRGAR* | 10057 | ATGGACTCGGTGGGCCGGCACGGAGCCGTTAG | 10058 |
| | 2 | METAKPREVYLLPQRPQYPAWPQASGPDVLPRAQTYY RLGRRPPQPPRVSATWPAPSEAPESDSQGACRSVASQER RVT* | 10059 | ATGGAGACAGGCTAAGGCCTCAGGCCGAGAAGTTTACTTCTACCCAGAGCACAAACTTACTACAGG TTAAGCCGGAGCCGGAGGCCGCCACAGCCAGGGTCTCTGCCACCTGGCCGCCCTCGAG GCCGCGGAGGAGCCGATTCCCAAGGGCCTGCCGCGCTCACAGGAGCCGTCG CGTCACGTGA | 10060 |
| | 2 | MAERPGPPGGAVSATAYPDTPAEFPPHLQAGAMRRRF WGVFNCLCAGAFGALAAASAKLAFGSEVEPGALLVLLI RAGGRGAAGRRRGAAGPAGLLGWGGGGRRAPPHPRRS VPPGPRAAGGAAVSWGGRECFASNHARPSSSVGGKRR RGLRPLPLPGT* | 10061 | ATGGCCGAGAGGCCGGGAGCCCGGGAGCTCCTCGGCACTCCGGCACGCCGTACCCTGA CACCCCCGCGGAATTCCCTCCGCAGCGCAGGGCACCCGGAGGCCGGGATGGGCGGGCGCGGCGGCTTTG GCCCTCTAACTTCAACTCTGTGCGCCAGCGGAGGTCGAGCCGGGCCGCGTTGGTTGGCTGCTGC CAAGCTGGCCTTCGGCAGCGAAGGTCGAACGCCTGGGGCGGAGGGGCCGCGGCACCCTGGC GCCTCTTGGGGTCGGGGGTCAGGGGCGCAGGGCGCGGCCGCGTCAGCGGGGTGGCAGAGAG TGTTTCGCTCTAATCACGCAAACCCTCGTCAGTGAGGTAGTAAGAGAGAGCGTCGG GGACTGAGGCCCTCTTCCCTTACCCAGGGAACCTAA | 10062 |
| | 4 | MFSLPHYQENWEFGIL.* | 10063 | ATGACCAGTCTGCCCCACTGCCCAGGAAAATTGGGAGTTGGATACGTGTAG | 10064 |
| | 1 | MPFTRRVGVRRRAP* | 10065 | ATGCCGCCTACGCACGGCGGTTGGAGTGCGACGAAGAGCGCCGTGA | 10066 |

Figure 1 (Continued)

| | | | | | |
|---|---|---|---|---|---|
| hsa-mir-565 | 2 | MDRWYPEARSNCIRVISYHGEGPSKSGPVAQWITRLTI DQKILGSTPGWLAMSVLPHLTHVLLGLVKMYIHNVKV LQDLGKVYG* | 10067 | ATGGATCGTTGTACCGGAAGCCCGTTCAAACTGTATAAGGGTGATCAGCTATCAC GGAGAAGGCTTTAGCAAGTCGGGGCCAGTGGCCAATGGATAACCGCGTCTGACTAC GGATCAGAAGATTCTAGGTTCGACTCCTGGCTGGCTCGCGATGTCTGTTTGCCACA CTTGACCCATGTACTACTGGGTCTTGTAAAGATGTATATTCACAATGAAAGTATT ACAAGACCTTGGAAAGGTGTATGGTTAG | 10068 |
| | 3 | MDNASDYGSEDSRFDSWLARDVCFATLDPCTTGSCKD VYSQCESJTRPWKGVWLECES* | 10069 | ATGGATAACGCGTCTGACTACGGATCAGAAGATTCTAGGTTCGACTCCTGGCTGCT CCGGATGTCTGTTTGCCACACTTGACCCATGTACTACTGGGTCTTGTAAAGATGTA TATTCACAATGTGAAAGTATTACAAGACCTTGGAAAGGTGTATGGTTAGAATGTGAA AGTTAA | 10070 |
| | 4 | MYYWVL* | 10071 | ATGTACTACTGGGTCTTGTAA | 10072 |
| | 1 | MAPGGR* | 10073 | ATGGCCCCGGGGGGCGCTAG | 10074 |
| hsa-mir-566 | 2 | MDVWMMWPAGSPMCKATFSCKVLGGCSHTPPPSRFW SGSSDPPSASALSPINARGSALPRRCACPTSVSLLEDWPA RREAVYWQSPRGGSPTSAEWEDLQS* | 10075 | ATGGATGTTGTGGAATGATGTGGCTCCGGGGTCACCCATGTGCAAAGCAACTTTTCC TGCAAGGTTCGGGTGGGTTCTCATACACCCCACCTTCACGCTTCTGGAGCGGG AGTTCGATCCCCCTTCTGCCTGCCTACACCTCCAGTCTCTTCCATTAACGCCGAAGGCAGCGCTC TTCCCGTAGATGCGGTTGCCTACCTCAGTCTCTACTTGAGGACTGGGCAGCC GAAGGGAAGCGGTATACTGGCAGTCCCACGTGGGGGTCTCCACATCAGCAGAG TGGGAGGACCTCCAGTCCTGA | 10076 |
| | 3 | MRLPYLSVST* | 10077 | ATGCGCCTTGCCTACCTCAGTGTCTCTACTTGA | 10078 |
| | 4 | MGQEGIKVGLGMRQCWRELAGAGAGGPTG* | 10079 | ATGGGACAGGAGGGTATCAAAGTTGGCTAGGAATGAGGCAGTGCTGGCGGGAGTT GGCTGGAGCTGGGGCTGGGGCTGCCCCACTGGATAA | 10080 |
| hsa-mir-570 | 1 | MTIKFCTSFPEAPDRLAWSIYYWTYS* | 10081 | ATGACTATCAAATTCTGTACCTCATTTCCAGAGGCTCCTGACAGACTTGCTTGGTCA ATATACTACTGGACATATTCATGA | 10082 |
| | 2 | MRLSHTGISNPVCPTLFLSMPVPLPLPHMSVTVHLLSLS PSPFGS* | 10083 | ATGAGACTGTCTCACACAGCATCTGAACCCAGTGTGTCCACAATTCTCTTCCTA TCCATGCCTGTTCCTCTCCACTGCCTCATATGTCGGTGACTGTCCACCTTCTCTC TCTCCCCCTCCGTTTGGCTCATAG | 10084 |
| | 3 | MAHTLLQIMIFNHWNDGNNLIGFHLSSI* | 10085 | ATGGCCATTACCTATTACAGATCAACACTTCAATCACTGGAAATGATGGCAATAAT CTAAATTGGGTTCAITTTATCCTCTATCTAA | 10086 |
| | 4 | MMAH* | 10087 | ATGATGGCAATAATCTAA | 10088 |
| | 1 | MGS* | 10089 | ATGATTGGTAGCTAA | 10090 |
| | 2 | MVSVYRGRASQG* | 10091 | ATGGTGAGTGTCGGGCGCAGGGCGTCCAAGGCTGA | 10092 |
| hsa-mir-571 | 3 | MAAGPSLRTESPLPLSPGASVPSGFGPGLLSVPAQRLW PSLQPSLCSSAPAAPHLPQAVG* | 10093 | ATGGCGGCGGGAACTGAGTCTGCGAACGGAGTCCCGGCTGCCGCCTGCAGCCTGG GGCCTCAGTACCCCCAGTGGAGGGACCTGGCCTCTGCAGCCTCCCGCACCAGGGCT CTGGCCCAGCCTGCAGCTGCAGGAGCTGTGCAGCTGCGGCCCGCAGCCCCGCACCTTCC CCAGGCTGTGGGGTGA | 10094 |
| | 4 | MPAWEELWEKLWSGDPVALPCSE* | 10095 | ATGCCGGCGTGGGAGGAGCTGTGGGAGAAGCTGTGGTCTGGGGATCCGGTCCCCTGC TTTACCCTGTTCGGAATGA | 10096 |
| hsa-mir-574 | 1 | MHTPTRPHSGSAPSACVNLRGACLDLPKYPVLAPSKSG KVPPMARGQVRGGLQGPPARARREQVPVRQRPRPVR LPSALAQGAQALTSPLPSPYSSPNSRPTPCLLPQSSQHSK QAPPPLAAPGMGPTPYRRSPGPLHPVG* | 10097 | ATGCACACACCACGCCACACTCAGGTCTGCCCCCTGGCCTCGGTGAACCTC CGGGAACGCCCCACCCTGGATCTCCAAGTATCCAGTACTCAGCCTGGCACCAAGCTGTGA AAAGTGCCCCCAATGCTCTCGGGCCAGTTGGGGGCCCCCTGTAAGACAGAGGTCGCCCAGCGC CCGGCACGAAGGCGAGCAGGTCCCCTGTAAGACAGAGGCCTCGTCCGCCAGGGTGCGCC TGCCCTCGCCTTGGCACAGCCACCTCAGGCTTGAGCCCTGCCTGCCTGGCCTCAGCCCC ACTCCTCCCCAACAGCCGACCCACGCCCACCTCCAGCCCGGATGGGTCTGCTTCCAGCCAACACT CTAAGCAGGCACCGCCCCCTCCACCACCAGCGGCTAG | 10098 |

Figure 1 (Continued)

| | | | | | |
|---|---|---|---|---|---|
| | 2 | MGCESITYALLIPSFPILMLKDTGRWLLKSVCSELPVTS AML* | 10099 | ATGGGCTGTGAGAGCATTACCTATGCCCTACTGATCCCATCATTCCATCTAAAC ATCTTGAAGGACACAAGGCAGGTGGCTTCTTAAATCAGTGTGCTCTGAACTCCCTGTG ACCTCAGCCAACCTGTGA | 10100 |
| | 3 | MRQALSSEPLFALSAA* | 10101 | ATGAGACAGICTCTATCCTCAGAGCCTCTTTTGCCCTCTCGAGCTAG | 10102 |
| | 3 | MDLRHK* | 10103 | ATGGATTTGAGGCACAAGTGA | 10104 |
| | 4 | MSAAGL* | 10105 | ATGTCAGCCCTGGACTGTAG | 10106 |
| | 1 | MPLQP* | 10107 | ATGCCCTTGCAGCCTTGA | 10108 |
| hsa-mir-586 | 2 | MGINERTVFCNELYPCTQGASSKAIWLLAVAQLATCVC VAA* | 10109 | ATGGGAATAAATAGAAGGACTGTATTTTGCAACGACTGTATTTTGCCCTGTGCACGCAGGG GGCCTCCAGCAAAGCCATTTGGTTGCTTGCTGCTTGCAGCTGGCTACGTGTGTTTG CGTGCGCGCTAA | 10110 |
| | 3 | MKGLYFATSFTRABRGPPAKPFGCLLSLSWLRVFASPPK SELLSAYLC* | 10111 | ATGAAAGGACTGTATTTTGCAACGAGCTTTACCGTGCACGCAGGGCTCCAGCA AAGCCATTTGGTTGCTTGCTGCTTCAGCTGGCTACGTGTGTTGCGTCGCGCCT AAAAGCGAGCTGCTTTCAGCTGTCTCTGCTGA | 10112 |
| | 1 | MFQL* | 10113 | ATGTTCCAGCTTGA | 10114 |
| | 2 | MNFARVWQIQPQ* | 10115 | ATGAACTTTGCCAGGGTCTGGCAGGACTCAACCCAGTAG | 10116 |
| hsa-mir-587 | 3 | MGTVCYVRIPLRWSSVPASQQPAPRGMSSAPPCHLQNEL VYYPFFSVKSLLLPKPKVISSSSSDLASLGPRTAGRNADSQ APPQITS* | 10117 | ATGGGCACAGTTGCTACGTACGGAGATCCCTCCGTGGTCCAGTGTGCCTGCCTC CAGCAGCCGCACAGTTGCTACGTACGGAGATCCCTCCGTGGTCCAGTGTGCCTGCCTC CTGTTATGTTCCCTCTTTCGTGAAGTCTTGCTACCTAAACCAAGGTCATTT CTTTCTCCCCTGATCCTCGCAGCCTGGGTCCAAGAACAGCTGTAGAAATGCAGATT CTCAGGCTCCACCCCAGACATCCTAA | 10118 |
| | 4 | MYSSKPCLCSLLFCCEVFAT* | 10119 | ATGTATTCTTCAAAACTGTTGTTTATGTTCCCTTTTCTGTGAAGTCTTGCTACCTAA | 10120 |
| | 1 | MASSGEVLSATVSALLPRRPRSPWVLPSRPGPPCILSIP TPTPRPRSHPDPGLAPAPVLPASCPQDSYPVSEGTSCLPL RSCIPDRQSCPRLSVP* | 10121 | ATGGCCAGTCCAGGGAGTCCCGGAGAGGTACTGTCCGCGACTGTCTCCGCTTCGTCTGCTGCTCGG CGGCCGTCCGGTCTCCGCTACCCGCCGCTCCATCCGACCCGGGTTCCCTGGCATCCTTTCTA TCCCGACCCCGTACCCCGTCCTGCCATCCTGACCCTGGCCTTGCCCCCTGCTC CGCTCCTTCCCGCATCTCTGTCATTCTGATCGCAGCCTCTACCTGTGTCCCGTCTCTCCGTCCC TCTCCCCCTTGCTCCAGAGTTGTCCCGTCTCTCCGTCCCTGA | 10122 |
| hsa-mir-589 | 2 | MLSFSPSPLLPGACLLNDVGGG* | 10123 | ATGCTCAGTTTCAGCCCCGACCTCTGCCTGAATGACGTG GGGGTGGGTGA | 10124 |
| | 3 | MTWGVGDGGKAISPEGLTTYPGILSQHSPNLGPMEKPA ASL* | 10125 | ATGACGTGGGGTGGGTGGGTGGATGGTGATGGAATGGAGCATTTCACCTGAGGGACTTACGAC GTACCTCGAATTCTTTCCAACACTCGAAATCTGGGTCGCAGATGGAGAAGCCGGC CGCGTCCTGTGA | 10126 |
| | 4 | MEEKPFHLRDLRRTLEFFPNTPQJWVRWRSPPRPCNVV QSIVSAERGAAGTLDSD* | 10127 | ATGGAGGAAAAGCCATTTCACTTGGGGACTTACGAGCGAACCCTGGAATTCTTTCC AACACTCCCAAATCTGGGTCCGATGGAGAAGCCGCCGTCCGTATGTAATGTGGTG CAAAGTATTGTCTCTGCAGAAGGGGTGCAGCGGGACTCTAGACTCTGACTGA | 10128 |
| | 1 | MADFDTYDDRAYSSFGGGRG* | 10129 | ATGGCGGACTTCGACACCTACGACGATCGGGCCTACAGCAGCTTCGGCGCGGCAG AGGGTGA | 10130 |
| hsa-mir-590 | 2 | MARSEVGRRRLGSRGLACGADPFHCLPFTTCWFLPCL GRGGADARRAPASSPIPPTVGPVRG* | 10131 | ATGGCGAGCGTCGGACGACGGCTGGGATCCCGCGGCCTGGCTCCCGGCGCTCCGG GCGGATCCCTTCCACTGCCTCCCGCCAACGACAACGTGTTGTTTTGCCTGCCTT GGCCGCGGCGGGGCCGATGCCGGACCAGCCGCCGCCCGCTTCCAGCCCATCCCCC TACGGTAGGACCAGTGCGTGGGCTGA | 10132 |
| | 3 | MPGDERPLPAPSPLR* | 10133 | ATGCCCGGAGACGAGCGGCCGCTTCCAGCCCCATCCCCTACCGTAG | 10134 |
| | 4 | MVRLLAGGGRPRR* | 10135 | ATGTACGGACTCCTTGCGGCGGCGGGGGAGACCAAGGAGATAA | 10136 |
| | 1 | MWTFVL* | 10137 | ATGTGGACTTTTGTCTCTAA | 10138 |

Figure 1 (Continued)

| | | | | | |
|---|---|---|---|---|---|
| hsa-mir-594 | 2 | MTYQRGK* | 10139 | ATGACGTACCAAAGAGGAAAATAG | 10140 |
| | 3 | MLCERVVCRSPSGLMDKALAS* | 10141 | ATGTTGTGTGAGCGCGTCGTTTGCAGAAGCCCAGTGGCTAATGGCCTAATAAGGCATTG GCCTCCTAA | 10142 |
| | 4 | MPTLLFFFLNGKCVCVFTSWWAAIFENLHTMSFV* | 10143 | ATGCCAACTTCTACTTTTTTTTAAATGGAAGTGTGTGTGTTTTACTAGCT GGTGGGCTGCAATTTCGAGAATCTGCACACCATGTCCTTGTCTGA | 10144 |
| hsa-mir-607 | 1 | MNFSVEIAPPQSLFKQK* | 10145 | ATGAACTTCTCCGTCGAAACTGCTCCTCCCAGAGCCTGTTTAAGAAGCAGAAATAA | 10146 |
| | 2 | MPVDALTSKIFPKGEVDTRY* | 10147 | ATGCCGGTGGATGCACTGACCTCTAAGATTTTCAAGGTGAAGTGGATACACGTTATT AA | 10148 |
| | 3 | MSKPLGHESP* | 10149 | ATGAGCAAGCCTCTTGGAATAATGAATCACCTTAA | 10150 |
| | 4 | MGNERRKGKEMGWKEKSRRDRPIPVGLVP* | 10151 | ATGGGAAACGAAAGGAGAAAGGAGAAAATGGGTGGAAAAGAAAAAGCAGAA GAGATCGCCCTATACCAGTAGGCCTAGTACCCTAG | 10152 |
| hsa-mir-609 | 1 | MAQCRERDEGPHSAGGASLSVRCCGVHGPATDLGLAEP PAPSPLLPPLPPVP* | 10153 | ATGGCGCAAGGCGGGAGCGCGGAGCGCGGAAGGCCCCACTCCGCCGGCGGCGTCCTT GTCCGTGAGGTCGCGGTGTTCACGGCCGCCGACCGATCGGGTCTCGCGGAACCTCC TGCCCCAAGTCCCCTCTCCCCTCCCCTCCGGTTCCTTAG | 10154 |
| | 2 | MSRGFSPNQCPSLAFSTFKHTFNI* | 10155 | ATGTCTCGAGGTTTCTCACCAAACCAGTGTCCTTCACTGCCTTTCCACCATCTTCA AGCATATCCTTTAATATTTAA | 10156 |
| | 3 | MFFLCASLSFTSTSFLLFSTFICFKSKIWPHTLHLCK* | 10157 | ATGTTCTTTTTGTGTGCTAGCCTTTCATTCAGTGACTTCATTCCTTTATTTCTAC GTTTATCTGATTTTAAATCAAATATGCCACATACTCTTCATCTGTGTAAATAA | 10158 |
| | 4 | MATYSSSV* | 10159 | ATGGCCACATACTCTTCATCTGTGTAA | 10160 |
| hsa-mir-611 | 1 | MVRALRGVPDGDARTPRGLTHETALISSDAGDPEG* | 10161 | ATGGTGAGAGCGTTGAGGGGAGTTCCTCAGACGGAGATGCGAGGACCCTCGGGGTCT GACCCACACCGGCTTATCTCCGGGGTCTGA | 10162 |
| | 2 | MRGPLGV* | 10163 | ATGCGAGGGACCCTCGGGGTCTGA | 10164 |
| | 3 | MNSLGFSARDF* | 10165 | ATGAACTCTTAGTTTCTAGCTCGGATTCTAA | 10166 |
| | 4 | MPWANVYW* | 10167 | ATGCCCTGGGCAAATGTTTATTGGTGA | 10168 |
| hsa-mir-612 | 1 | MRVEKGRGLVRDTVWVGVVGNAG* | 10169 | ATGAGGGTGAAGAAGGGAGAGGGTTGGTTAGAGATACAGTGGGTGGTGGGGG TGGTAGGAAATGCAGGTTGA | 10170 |
| | 2 | MQVEGNSLIGLWGI* | 10171 | ATGCAGGTTGAAGGGAATTCTCTGGGCTTTGGGGAATTTAG | 10172 |
| | 3 | MPSHRQGKCLYQLPPCGQDSLFQRVVLFGVWVLSSEL VT* | 10173 | ATGCCATCTCACAGGCAAGGCAAGTGTTTTACCAGCTTCCTCCTGGTGCCAAGAC AGCCTGTTTCAGAGGGTGTTTGTTGGGGTGTGGTGTTATCAAGTGAATTAGTC ACTTGA | 10174 |
| | 4 | MSLPASSWWPRQPVSEGCFVWGVGVIK* | 10175 | ATGTCTTTACCAGCTTCCTCCTGGTGCCAAGACAGCCTGTTTCAGAGGGTGTTTT GTTTGGGGTGTGGTGTTATCAAGTGA | 10176 |
| hsa-mir-615 | 1 | MSSSYVANSFYKQSPNIPAYNMQTCGNYGSASEVQASR YCYGGLDLSTFPPPAPSNSLHGVDMAANPRAHPDRPA CSAAAAPGHAPGRDEAAPLMPGMYSQKAARPALEERA KSSGEJKEEQAQTGQPAGLSQPPAPPQTYPWMTKLJHMS HGKL* | 10177 | ATGAGTCCTTCCACTTAGCCAATTCATTCATTCTATAAGCAGAGCCCAATATCCTACTAT AACATGCTACGGCGGATTGACCATGGAACTATGGCCTCAGAGGTGCAGGCATCCAGGTA CTGCTACGGCGGATTAGAACATGGCTGCCAACCCCCCGGCTCACCCGCCGCCCCGCTG TCTCCACGCGGGTAGACATGGCTGCCAACCCCCCGGCTCACCCGCCGCCCCGCTG CAGCGCCGCGGATGACGAAGGCCGCGCCAGGAGGAGGCAGGCAGCGCAGGAGCAGCGACAGGAGGAGGACTAAG ACCCGGGATGACGGGAGATCAAAGAGGAGGCAGCGCAGAGCAGGAGCAGCGCCGGACTGA AGCAGTGGGGAGATCAAAGAGGAGGCAGCGCAGAGCAGCGCGCCGGACTGA GCCAGCGACGGCGCCACAGATTTACCCGTGGATGACCAAACTGCACATGAGCC ACGGTAAACTTTAG | 10178 |
| | 2 | MDRPQRCRHPGTATADWT* | 10179 | ATGGATCGGCCTCAGAGGTGCAGGCATCCAGGTACTGCTACGGCGGATTGGACTTAA | 10180 |
| | 3 | MRGK* | 10181 | ATGCGGGGCAAATAA | 10182 |

Figure 1 (Continued)

| | | | | |
|---|---|---|---|---|
| | 4 | MARKTVH* | 10183 | ATGGCTCGTAAAACTGTCCACTAA |
| hsa-mir-616 | | | 10184 | |
| | 1 | MLKMSGWQRQSQNQSWNLRREASTDSHLPFTLPSPQS WGVRSLGSASLLHSEVRDRPREEWGIESLILGWCLQTPH ASDDGVSPPLPGAGTRALLCAAGQRDLGCPWEIHSFP* | 10185 | ATGTTAAAGATGAGCGGTGGCAGTGACAGGCAGAGCCAAAATCAGAGCTGAACCTGAG GAGAGAGGCGAGTACTGATTCCCATCCAGCCTCACTCCTTTACCCTCCGTTCCTCAAAGTTG GGGCGTCCGCTCTTTAGGATGGGATCGCCCTCACTCCTCACAGTGAAGTTAGGACGCGTC GAGAGAGGAATGGGGAGAGTCCCTTATTCTGGGGTGGTGCTTACAAACCCTATTG CTTCGGACGACCGGCGTTCTCCACCCTGCCCGGAGCCGGAACACGGGCCTGCTCT GTGTGCTGGCAAGGACCTCGTTGCCCTTGGGAAATTCATTCTTTCCCGCTAG | 10186 |
| | 2 | MGRVPYSGVVLTNPYCFGRRRLSTPARSRNTGPALLCCW AKGPRLPLGNSFFPVANFRPHR* | 10187 | ATGGGGAGAGTCCCTTATTCTGGGGTGTGCTTACAAACCCTATTGTTCGGACGA CCGGCGTTCTCCACCCTGCCCGGAGCCGGAACACGGGCCTGCTCTGTCTGCTGG GCAAAGGGACCTGCTTGCCCTTGGGAAATTCATTCTTCCCGCTAGCCAACTTCAGG CCTCATCGTTAG | 10188 |
| | 3 | MAILVAGATGPCSG* | 10189 | ATGGCTCACCTTGGTAGCTGGGCTACTGGACCCTGCAGCGGATAG | 10190 |
| | 4 | MDREWCVFLLP* | 10191 | ATGGACAGGGAGTGGTGTTTCCTTTTGCCGTAG | 10192 |
| hsa-mir-618 | 1 | MLKPSVTSAPTADMATLTVVQPLTLDRGKGAARSPGH RVPSPLLPSPPANSQRDMGRAQAGGEGERGRARKAFAP RTEHFLPLSLPATFPLPLPTVLAPPRGRLLLALGSPLPLPA PRRVVSGPLALLEPLRGDGYRRQLGVGEGQRASSPGQ SPEFTGEGAACQLAWRRGPGGRKFVQAPEGEGRSNCW SPGGHSGGGLGAPLGCRAHSGGAAAGRELPSAERAROS AGSRAPAAEIGSPRLRDRKRRGSRLLPPPAAPCR* | 10193 | ATGCTGAAGCCTGAGCGTCACTTCGGCTCCACGGCAGACATGGCGACATTGACAGT GGTCCAGCCGCTCACCCTGGACAGAGGTAAGGGAGCGGCTCGCTCGGCCAGGCCACC GCGTCCCCTCCTCCCCCGCCTCCCCGCCTGCCAATTCCAACGAGCAGGAAGCTTCGCGCC GAGAACAGAACACTTTCTTTCCCGCTCCCGGCCCCTCCCGGCACGTTCGCGCC ACTGTACTGCGCCCCGCCGCGGGGCTCTGGCCGCCCGCGCCACCTCGCTCGCGGT CTGCCGGAGTATCTAGGGCCGCAGGGGCTCCAGGGGGTTGGAGAGGGCAGAGAGCAAGCT CGCCCGGCCAGAGCCAGCCAGGGGGCGAGGAGACCGGCGAGGAGCCGCTCAGTTGCTGG CGCAGGGGCCCGGAGAGGAAGGAAGTTGTCAGCGCGCCGGAGGGCGAGGGTCGGT CCAACTGCTCGGAGTCCGGCGCTGCACTCGGGGCGGGCGCGGCCTGGGCGCACCCTGGGC TGCCGGGCGACAGTCCGGGGCTCAGCAGCCAGGAGCTGGCGAGATCGGCTCCGGCCGC TTCGAGATCGAAAGCGGCGAGGGTTCCTTCCTGGCTGTGCAGAGGAGGACACCCTCAGTGA CGATAG | 10194 |
| | 2 | MESSAAIGASLVHPCGVIPVPECVGPLPGSSVQ* | 10195 | ATGGAGTCCTCCGCTCGCTGCGATCGGGGCCTCACTGGTGCACCCTGTGGGGTTATACCT GTCCCTGAGTGTGTGGGTTTCCTTCCTGGCTCCAGCGTCCAGTGA | 10196 |
| | 3 | MKALESYGSAEIDTL* | 10197 | ATGAAGGCGCTCGAGTCCTACGGCTCTGCAGAGGAGGACACCCTCTAG | 10198 |
| | 4 | MVYSEENDLVRCTSKNFLSRGLN* | 10199 | ATGGTGTACTCAGAAGAAAATGATTAGTCGATGTACCTCTAAAAATTTCTTTCT AGAGGATTAAACTGA | 10200 |
| hsa-mir-619 | 1 | MALVTLQRSPTPSAASSSASNSEVSPGLAAPGLGRRTPR RGRRSWGRACGAGGRLRGLLGAPP* | 10201 | ATGGCCCCTGGTTGACCCTGCAGCGTTCGCCACGCGCACGGCGCCTCTTCGGCC AGCAACAGCGAGGTGAGCCCGGCTGCCCGGAGCCTGGGGCGCCGCCGCCGGACGCC GGGCTCCTCGGAGCCGCGCGTAG | 10202 |
| | 2 | MQCDPSGSVCRILCVRCDPHQGVTPHLG* | 10203 | ATGCAGTGCGACCCTTCTGGGAGTGTCTGCAGGATACTGTGTGTGCGTGTGACCCA CATCAGGGGGTTACCCCATCTGGGGGTGA | 10204 |
| | 3 | MCNWDP* | 10205 | ATGTGCAACTGGACCCTTGA | 10206 |
| | 4 | MPGCAM* | 10207 | ATGCCTGGCTGTGCGATGTGA | 10208 |
| hsa-mir-619 | 1 | MPVLLLMTLESSMRQSWPCVSLWRVTSMGSSARSLMTL MSLSCSRETEIEALKEELLFMKKN* | 10209 | ATGCCCGTCTTACTGCTGATGACCTTAGAGTCAAGTATGAGACAGAGCTGGCATGC GTCAGTCTGTGGAGAGTGACATCCATGGCCTCTGCAAGGTCATTGATGACACTAATG TCACTCAGCTGTAGCAGGAGAGATCAGGAGACAAGAATGAGGCTCTCAAAGAGAAGAACTAG | 10210 |

Figure 1 (Continued)

| | | | | | |
|---|---|---|---|---|---|
| hsa-mir-622 | 2 | MRQSVESDHGLCKVIDEYTNVTQL* | 10211 | ATGCGTCAGTCTGTGAGAGTGACATCCATGGGCTCTGCAAGGTCATTGATGACACTAATGTCACTCAGCTGTAG | 10212 |
| | 3 | MEIEAPKSQDLTKIMADIRPNTMSWLGRTERSWTSTGLSRLRRAPQWSSHSLLRLELLR* | 10213 | ATGGAGATAGAAGCCCCAAATCGCAGGACTTCACCAAGATCATGGCAGACATTCGGCCCAATACGATGAGCTGGCTGGGAAGAACCGAGAGAAGTCTGGACAAGTACTGGTCTCAGCAGATTGAGAGGAAGGCACCAGTGGTCATCACACAGTCTGCTGAGGTTGGAGCTGCTGAGATGA | 10214 |
| | 4 | MTLTELRHTV* | 10215 | ATGACACTCACGGAGCTGAGACATACAGTCTAG | 10216 |
| | 1 | MEEGL* | 10217 | ATGGAGGAGGATTGTAA | 10218 |
| | 2 | MAAAGSSLL* | 10219 | ATGGCGGCAGCCGGCAGCTCCTCCCTGCTCTGA | 10220 |
| hsa-mir-624 | 3 | MDELAGGGGGGPGMAAPPRQQQGPGGNLGLSPGGNGAAGGGPPASEGAGPAAGPELSRPQQYTIPGILHYIQHEWARFEMERAHWEVERAELQVPRWGRCAGAAAAAGFPAGGWGWGLHSAGAGALGGRAEPTCAAQVVMVLSTAFPGVPLPLSRISLLPNLHWLRGAGLLGAARLAFSMASAGAPPEAAPPGLRGLGPSTSLWESPVWGLSTLSLLLFVPLEMKSPKRGTRIGILPPFSGPPPFPIWRIWPPPSDLVRACPLTATLLSWAARVHSDLGLTCEVLFPIVNFKYFLT* | 10221 | ATGGACGAGCTTGCCGGAGGCGGTGGTGGCGGCCCGGGAATGGCGGCCCCTCCCCGGCAGCAGCAGGGACCTGGGGGAAACCTGGGCTTTGCCCTGGGGAATGGGGCGGCTGGGCCACTACAGCACACTGAGCCCCTGGTTGCCAGCAGATGAGGCTGGCCATCTCCGGAGGATACTGGCACTACCACCAGCACGAGTGTCCGGATGGTGAACTGCTGGGCGGCCGAACTGCAGGTACCTCGGTTGCTGTGGGGTCGGCGGTGCGGGAACTGCAGCCGGAGCCGGAGTCGCTGCTGGGTTGGGAGGCCAAGCGGAACCTACCTGTGCTGCTCAGCCATATAAGCTTGCTCCCAACCTTGTGATGGTCCTCTCAAGGCTTTCCTGGAGTCCCCTCCCTTCTCGGAGCAGCCATTTGGCTTTAGTATGGCGTCCTCTGGGAGTCCCTGGGGCCCTCCAACACTGAGTTTGCTCTGTTGTCTCTGAGATAAGAGCGCGAAGAGAGGACTTAGGATAGGCATCTTCCGCCACCCCCCTTCCGAATTTGGCGTATCTGGCCCCCTCCAGAGTTGGTACGGCGTTGCCCCTTGACAGCCACGCTTCTTTCCCATCGTCAACTTAAGTACTTTCTCACCTGAGTTTTATTCCC* | 10222 |
| | 4 | MLPYSLGFSVVIPYLVTHQRFQH* | 10223 | ATGCTGCCTTACTCACTTGGATTCTCTGTAGTTATTCCTTAGTGACTCATCAACGCTTTCAGCACTGA | 10224 |
| | 1 | MAVLLKGL* | 10225 | ATGGCTGTGTTGTTGAAGGGCCTGTAG | 10226 |
| hsa-mir-627 | 2 | MHDAFEPVPILEKLPLQIDCLAAWGEPRGRGAEAESAQERSGSFLRPGKWTGVHPCGLRLDATREGLRMREGREMFTGYRHRCLWGYLGDPSDPVI* | 10227 | ATGCACGACGCTTTCGAGCCAGTGCCGATCTGGAAAAGCTGCCTCTGCAAATGACTGTCTGCTGGCTGGGGTGAGCCAGGTGACCGAGCGAGTCAGCACAGGAGGGTTCGGGATCTTTCTCACGAGAGCGGAAGGCGTCCATCCGTGTGGGCTTCGGTTGGATGCTACAAGGAGAGAAGGCAGAGATGAGAGGAGAGAAGGCAGAAGTGGATCCAGTGATCCAGTCATTTAG | 10228 |
| | 3 | MLHERGLG* | 10229 | ATGCTACACGAGAGGGCTTAGGATGA | 10230 |
| | 4 | MSYGLLG* | 10231 | ATGTCTGTGGGCTACTTGGGTGA | 10232 |
| | 1 | MYPQRHPVSNCNSVVYLSIYHGRVNEAVYLAPPFCLLLPLWCVCLCVCSHTKGDAAGGRR* | 10233 | ATGTATCCGCAGGGCAGGACATCCGGTGAGTAATTGCACTCGGTTTATTTAAGCATCTATCATGGCAGGGTAAACGAGGCAGTTTATCTGGCACTCCATTTGCTTGTGCTACCTTTTATGTGTGTTGTGCTCTCACACAAAGGGGATGCGGCGGGGGGCGCCGTTGA | 10234 |

Figure 1 (Continued)

| | | | | |
|---|---|---|---|---|
| hsa-mir-629 | 2 | MVCVFVCVLSHKGGCGRGAPLREEVNSARVARGAACV PGGAVHAVPGPALKSPNSPGLSPAPALLGRGRPLVKGM GAPLPTGRDGAPPLRPVGELRNLLGRFWAEGGLFWLGA VGEGPGPL* | 10235 | ATGGTGTGTGTTTGTGTGTGTCTCACACAAAGGGGATGCGCGCCGGGGGC GCCGTTGGAGAGAGGAGGTTAATTCCGGCGGCAGTGGCGCGGGGGCTGCTGTGTTC CAGGGGGAGCTGTTCACGGCGGTCCCGGTCCCCCCGCCTCTGAAGTTCTCCAACTCACCCG GCTTGTCTCCGCCCGCCGCCTTACTGGGGAGGAGGAGGCCCTTGTGAAAGGCATG GGAGCCCCGCCTGCCGACGGGGAGGAGAGATGGGGCCCCCTCCGCCCGTCGGAGA GCTGAGAAACTTGCTGGGAGCTTCTGGGCTGAGGGCTTCTGGGGGCCCTCTTTTGGGTGGGGC CGTTGGGGAGGGGCCGGGGCCGCTCTGA | 10236 |
| | 3 | MRPCGAVERGG* | 10237 | ATGCGCCGGGGGCGCTGTTGAGAGGAGGTTAA | 10238 |
| | 4 | MGRPPSAPSES* | 10239 | ATGGGGCGGCCGCCCTCCGCTCGTGAGAGCTGA | 10240 |
| hsa-mir-631 | 1 | MAAAPALKHWRTTLERVEKFVSPLYFTDCNLRGRCGP WSPAACBRPQPCASSFPSGEKPKLQPPGPRDKVPAAGRA ACCTAAGCTGCAGCACCTGGGACCACCCGGGACGCCGGAGGACTGCCGGACGCCG GAGEEGVGNGLCRGAARQPSWRRIQGKCGPTGQLAPK RKRGGLQHVPTGPSHAGFLGPAALWLCSPAS* | 10241 | ATGGCCGGCTGCGCCGCTCCGGCCTCTACTTTACCGACTGTAACCTCCGCGGACGTGGAGCGGGTGGGCCCTG GTCCCCGGCAGCTGCAGCACCTGGGACCACCCGGGACGAGAAGTGCCCGCCGCGGCAGGGCAG AACCTAAGCTGCAGCACCTGGGACCACCCGGGACGAGAAGTGCCCGCCGCGGCAGGGCAG GGGCCGGGAGGAGGGGGTAGGAATGGACTGTTGGCCGCGGAGGCCAGCCAGGGCCCCAGCC CTCTTGGCGGAGGATCCAGGAAACGTTGGCCGCCACGGCCAGCTGGCCCCCAGGGC GGAAACGGGCGGCCTCCAGCATGTGCCCCACCGGCCGTCCACGCAGGCTTTTG GGGCCCAGCTGCCCTGTGGCTGCGTGCTCTCCAGCTCCTGA | 10242 |
| | 2 | MDCAAERPGSPLGGGSRESAAPPASWPGGNGAASSM CPPARPTQAFWGQLPCGCALQLPDAGETSLPGGSPAGL PPRAGRRQLRTHVGNAQRVGGATGLGEVPTQLPATPSL SALCRRQLRGHEQHPLLGAAPSAGNSSLVPGSSGDGFHS HVAASGHPLGRAP* | 10243 | ATGGACTGTGCCGCGGAGCGGCCAGGCAGCCCTCTTGGCCGAGGATCCAGGGAGAAAG TGGCGCCCCACCGGCGCCTGGGCTCCCCAACGGGGCGGCTCCAGCATGT GCCCAGCCCCGCCTGACGCTGAGCTTCCCTACCAGGAGGCAGTCCAGCGGGACTTC TCCAGCTTCCTGACGCTGGAGAGACTTTCCTACCAGGAGGCAGTCCAGCGGGACTTC CGCCCCGCCTCGGCTCGGCGACAGTCTCGGACGCCACGTAGGTAAGCCCAGCGGGTG GGGCGGGCCACAGCCTAGGGAGCCAACCAGCCCCAGCTCCAGCACACCTTCGTT GTCTGCCCTCTGCCTGCTGGGAACAACAGCTCTCTGGCTTCCTGGGATTGTTTTCA AGCACCCTCTGCCTGCCCACCGTGGCGGCGCTCCGACATCCCTAG | 10244 |
| | 3 | MVFIPTWPLDIP* | 10245 | ATGGTTTTCATTCCACGTGGCCGCTCTGACATCCCTAG | 10246 |
| | 4 | MLGEFQAPADTLSKEGYQDRTSTSRPITTALLQMVDLL VPGGADHPRGMGPGSSPLLGK* | 10247 | ATGCTTGGAGAGTTTCAAGCCCTGCCGACACTTATCCAAGGAAGGATATCAGGAT AGGACTTCTACCTCAGCCTGACCTGCAGACACAGCTCTCTTGCAGATGGTGGACCTGCTG GTTCCGGGTGGAGCTGACCATCCCAGAGGCATGGGTGGCCAGGAAGTTCACCTTT GCTGGGAAAGTGA | 10248 |
| hsa-mir-632 | 1 | MGRKKKQLKPWCWYPLSV* | 10249 | ATGGGTGCAAGAAGAAGAAGCAGCTGAAGCCGTGGTGCTGGTATCCTTGTCGGT TTGA | 10250 |
| | 2 | MGFPRGFAVVGRVIL* | 10251 | ATGGGGTTCCGAGGTTGGACAGTCTTTGCAGTGTGGTCGTGACTCTGTGA | 10252 |
| | 3 | MEGWGQLHSLSPTFSVFIYFMCVLCLFFRIGGLVKNQVS QPWFRTFPFFFFSGREEN* | 10253 | ATGGAGGGTTGGGGACAGCTTCACAGTCTGTCACCCACTTTTGTTTATTTACT TATGTGTTTGTTGTTATTTTTGCGAATTGGCGGTTTAGTAAGAACCAAGTTAG TCAACCCTGGTTTCGAACCTTTTTTTTTTTCTTTCGGGAGGAGAAGTTAG TAG | 10254 |
| | 4 | MLFLEALIFFTLKLILFFTVLYVKAACYSTAFM* | 10255 | ATGCTTTTTCTGGAAGCCGTTAATATTCTTACATTAAAATTGATTTATTTACTGTTT TGTACGTAAAGGCGGGCTTGTTGTTACAGTACTGCGTTTATGTAA | 10256 |

Figure 1 (Continued)

| | | | | | |
|---|---|---|---|---|---|
| hsa-mir-636 | 1 | MSYGRPPPDVEGMTSLKVDNLTYRTSPDTLRRVFEKYGRVGDVYIPRDRYTKESRGPAFVRFHDKRDAEDAMIDAMDGAVLDGRELRVQMARYGRPPDSHHSRRGPPPRRYGGGGYGRRSRR* | | ATGAGCTACGGCGCCCCCCCTCCGGATGTGGAGGGTATGACCTCCCTCAAGGTGGACAACCTGACCTACGGCGACGTGTACGACATCCCGCGGGACCGCTACACCAAGGAGTCCCGCGGCTGCGCCTTCGTTCGCTTCACGACAAGCGCGACTGGAGGACGCTATGGATGCCATGGACGGGGCCGGTGCTGGACGGCGCGGAGCTGCGGGTGCAAATGGCGCGCTACGGCCGCCCGGACTCACACCAGCACCACACCGCAGCACAGGACGCTCCGGGTGCAAATGCGGGCCCCGGACTCACACCAGCACCACACCGCAGCCCCCGGACTGCGGACTCGGACGCCGGAGCCGGCAGGTAA | 10258 |
| | 2 | MWRV* | | ATGTGGAGGGTATGA | 10260 |
| | 3 | MPWTGPCWTAASCGCKWRATAAPRTHTTAAGDRHPAGTGAVATDAGAAGKRG* | | ATGCCATGGACGGGCCTGTCTGGACGGCCGTGAGCTGCGGTGCAAATGCGCGCTACGGCCGCCCGGACTCACACCAGCACCACACCGCAGCCCCCGGACTGCGGACTCGGACGCCGGAGCCGGCAGGTAAACGGGCTGA | 10262 |
| | 4 | MASGGEIMAAAWAGARGRGRPRCLELTPLCLLVPPAALGGVAAADPGVGVVPGLAADLATAARSLGPALVLDLGRPPSPDPHEGPSPSPRRSPDLVRGPGPGLGPGVLPQCPRGNPNPGRDRRVFPSLLKRKERCPLKKMVMSGNPRHITLHKWDLG* | | ATGGCGTCTGGGGCGGAGATAATGCGGCTGGGCGGAGCGCGCGGGGCGCGGCCCCGCTGTGTCTGCTGGTTCCCGGCTCCCGCGGCCGCTGGCGGCGTGCGGCAGCCGTCAGCGCGGGAGCTGACTACCCCTGCCTGGAGCTCACCCCGCTGTGCCTGCTGGTCCCGGCCGCCCTGGGCGGAGCCGGCTCCGGGAGCTCCCCGGGTGCCCCCGAGCCCCGAGCCGCGGCCCCAGCCGCCCCGCCCGCCCCCCAGTGCCCCCGGGGAAATCCCAGCACAAGTCTCCTTGGAATCCGAGACACATAACCCTAATTCATAAATGGATTTGGGGTAG | 10264 |
| | 1 | MSTPRQEDVEDHYEMGEELGR* | | ATGTCCACGTTCAGGCAGGAGGACGTTGAGGACCATTATGAGATGGGGGAGGAGCTGGGCAGGTGA | 10266 |
| | 2 | MRWGRSWAGELSARTAGLQG* | | ATGAGATGGGGGCGGAGGAGCTGGGCAGGTGAGCCCAGGCGCGCACGGCTGGGCTGGGCGTGGGGGGATAG | 10268 |
| hsa-mir-637 | 3 | MLRRNESVSCGGGTNLGRGVRQPRL* | | ATGCTGAGAAGGAATGAGTCAGTATCATGCGGTGGGGAACGAATTTGGGCGTGCGGCTCAGGCCGCGGCGGTGGGCGTGGGGGGCTGTGAGTCAGACAGCCCCGGCTGTGA | 10270 |
| | 4 | MSQYHAVGERWAVESDSPGCEFLLGNPLCYSCGEKSN* | | ATGAGTCAGTATCATGCGGTGGGGAACGAATTTGGGCGTGAGTCAGACAGCCCCGGCTGTGAATTCCTGCTTGGGAATCCTCGTGTGTTCTGTGGGAGAAAGTAATTGA | 10272 |
| | 1 | MVKPLLFSPSYRRSAPFDWSRKLIGQSPGASPSLGSDRPQGAGANVGASCPDWPTGRARPGAGRTQSRV* | | ATGGTCAAGCTCCTGCCCCTTCGGCGTTCGCGCCCCCTTGGTTCGATTGGTCTCGCAAGGAGCTCCGGCGTCAGTCCTAGTCCTGGACCGGCCCCAAGGAGCACCAGTGGGAGCGTGAACGGTCTACGACAGGGCCGGGGCGCGGCGGGCCCGGAGACGCGGGACCAGAGCCGCGTTTAG | 10274 |
| | 2 | MKHYEVRSEKQEPCCHC* | | ATGAAGCATTACGAGTGAGAAGCTAGAAAGCGAGAAAGCAAAATCTGCAACCCAGGCTGTTTTGGGGTGCTGCTGA | 10276 |
| hsa-mir-639 | 3 | MRMCAGSIYKSATQAVLGVLPLGGLCRGWDACRFLAAPPAG* | | ATGCGCATGTGCGCCAGGAAGTATTTATAAATCTGCAACCCAGGCTGTTCCTTGCAGCTCCCCAGCGGGCTGA | 10278 |
| | 4 | MGATKVRDPCSQSEGVLHKSCATPSPA* | | ATGGGAGCCACGAAGGTGCGGGACCCTTGCTCCCAATCGGGGAGTGCTGCACAAATCTTGCGCCACGCCGCGTCACCAGCGTAG | 10280 |
| | 1 | MGGGRAPPERLGGGR* | | ATGGGTGCGGCCCCGGAGCGCCTGGGTGGCGGCCGGTGA | 10282 |
| | 2 | MVASGPPAVPRWAVPPVPGGGTAALEPLLQELSGGGRAGAVGPASGGRGGGGGPYH* | | ATGGTCGCGTCGGGACCGCCGGCCGTCCCGCGATGGGCTGTACCACCCGTGCCGGCGGGGGACCGCGCCTTCGAGGAGCTAGTGGGGGGGCCGAGGCCGGCATACCACTGA | 10284 |

Figure 1 (Continued)

| | | | | |
|---|---|---|---|---|
| hsa-mir-641 | 3 | MGCTTRARRGDRGPRAPPSGAEWGWPSGGGGTSLGGP GRWRRAPLRRWGERCKFAGRGAQAAACAGRGLDLSG AAGRSSLACAG* | 10285 | ATGGGCTGTACCACCGTGCCGCTGCCGGGGGGACCGCGGCCCTGAGCCCTCTCA GGAGCTGAGTGCGGCGGCGGGGCCGGAGCGGTGGCGAGCGGTGGCGGCGGACGGG GGCGGTGGCGCGGGGAGCGCAGGCGCAGCGTGCGCAGCGTGGCGGGCGGGGCGAAGTTGCG GGACAGGGGAGCGCAGGCGCAGCCTGAGCCTGGCGTGCGCGGGCTGA | 10286 |
| | 4 | MLPQLWLGYTTFALGEPCLERRGTQRGL* | 10287 | ATGTTCCCAACTGTTGCTGGTTTATATCACCACGCGTTGGCGGAGCCTGCTTA GAACGTAGGGAACCAAATCAGAGGACTGTGA | 10288 |
| | 1 | MSLSACFHLWLAAR* | 10289 | ATGTCTCTGTCTGCGTGTTTCCATCTCTGTTAGCTGCTAGATAA | 10290 |
| | 2 | MLCKGCSTYSGLYLPPAGKVL* | 10291 | ATGCTGGAAAAGGTTGTTCCACTTACTCTGGGCTTTATCTACCCCAGCGGGGAAA GTTTTGTAA | 10292 |
| hsa-mir-642 | 3 | MCARKPFGLGEWELGWAPQVLHQAVGTQMGVSSTPL GGTENLQVFQFPIEKGSRLTVSTPSSPRRSPGSQESVGPD FGDTDTSAQRSSRATARSANTPPFHLCCPNNSQGRPGN HLRGPAHHRSSTHSACLSLPPDHHAWELRERVRCLGVP RVYGSPAVCPCV* | 10293 | ATGTGTGCTAGAAAACCCTTTGGCTTGAGAGTGGAGCTCGGATGGCGTTTCA AGTTCTCACCAGCTGTGGAACTCAGATGGGCGTTTCAAGTACCCACTAGGGGG TACTGAAAACCTTCAAGTTTTCAGTTCCCATAGAAAAGGGGCTCTAGGCTGACGGT TTCTACCCCCTCCTCTCAAGGCGGTCCCCAGCGTAGCTCTAGGCAACCGCCCGCTCAGC CTTCGGTGACACTGACACTTGTCCCAACAACAGTCAGGGAGCGCGGAAA AACACCCCGCCTTTGCCAACACAGTCAGGGAGCGCGGGGAA TCACTTAAGAGGCCCCGCCAGGAGTTGCACCACTCCGCGTGCTCCCT CCCCAGATCATCACACGCTCCCCCAGAGTTGCGGAGGCGGGCTGCCGCTCGGAGTCC CGGTGTATACGGGGTACTGA | 10294 |
| | 4 | MGYSSSPPGCGNSDGRFKYPTRGY* | 10295 | ATGGGCGTTTCAGTTCTCCACCAGCTGTGGGAACTCAGATGGCGTTTCAAGTAC CCACTAGGGGGTACTGA | 10296 |
| | 1 | MAWRYGATAAREFSFV* | 10297 | ATGGCGTGGAGATATGGCGCAACTGCGGCGGTGAGTTTCCTTTGTTTAG | 10298 |
| | 2 | MAQLRRVSFPLFRLSVRLAVPSRFCTRDVGGGTDLEIPA PLSPPAVNSCVPSEC* | 10299 | ATGGCGCAACTGCGCGTCTGTACCCGGGAGTTTCCTTTGTTTAGATTAAGTGTTCGCTTAGCG GTGCCCTCACGCTCTGCACCCGGGATGTCGCGGCGGTACAGACCTTGAAATCCCC GCACCGCTCTCTCCACCCGAGTAAATTCATCGTCCCGTCAGAGTGTTAA | 10300 |
| | 3 | MWGAVQTLKSPHRSLHPE* | 10301 | ATGTGGGGGGCGGTACAGACCTTGAAATCCCACCGCTCTCCACCCGAGTAA | 10302 |
| | 4 | MRPYRVLKSP* | 10303 | ATGCGTCCCGTCAGAGTGTTAAAATCGCCTAG | 10304 |
| hsa-mir-643 | 1 | MAAFPARADADPSPTTARDTPGRQAEKSETACEDR* | 10305 | ATGGCGGCCCGCCCGCCGCGGCCGACGTGATCGTTCGCCACGTCGCCACTACG GCCGAGACACACACCAGGCCGGCAGGCTGGCAGAAAAGCGAGACCGTGCGAGGACC GGTAG | 10306 |
| | 2 | MLSARGYALPDRGQGLGFGGAAAHGAFGLPKTRVAP SSLCGGFARA* | 10307 | ATGTTGTCGCTCGGGGTGCGCTCGGGGTGCCCTGGAGCGCGGCCAGGCTTAGGATTT GGAGGTGCGCGGCGCACGGTCGCTGAAGGGGCGCTCTGGG AGCCCTCTGCGGGGGCTTTGCAAGAGCATGA | 10308 |
| | 3 | MKWGSCGGAAGGTRPHPGSSPRVAPLGAGPCAAPLGP WPSGGGGHAVPGAARGRSGRCPSLPGLKCPLGSPRGPQ EGVVPTQAPLAWVQAVTPVRNAVSQDSLRDGLRWMP QGEGCPGTGSLLSRSC* | 10309 | ATGAAGTGGGGAAGTTGTGGGGGGTGCAGCGGGGAAGAACCGGCCCCCACCGGTTC GTCACCCGAGTGGCTCGGGAGGGTGGCCGGCCGGACGGTGTCCGCGGCCCTTGGGGCCGT GCCGTCAGGGCGTGGCCAGTGCCAGTGCAAGAGGGCGCTGTGGG GCTGCCCTCCCCTGCCACTCAGCGCCTTGCTGGGTTCAGCTGTGACTCCTGTC AGAAACGTGAAGCGTGGACAGACTCCCTGAGCAGGACGGTGAGATGGCTGATGCCGCAGGG GGAAGGGTCGCGCTCAGGGCACAGGTCTCCTCCTCCAGAGCTGCTGA | 10310 |
| | 4 | MGCAGCRRGKGVPAQGRSSPGAAEQKELSPGPASLQV HTLPVGSD* | 10311 | ATGGGCTGCGCTGGATGCCCAGGGGAAGGTGTCCGGCACAGGGTCGCTCTC TCCAGGAGCTGCTGAGCAGAAAGAGCTTTCCCCTGGGCCAGCGTTCCCTTCAGGTCCA CACCCTCCCAGTGGGCAGTGACTAG | 10312 |
| hsa-mir-647 | 1 | MRMNWVLS* | 10313 | ATGAGGATGAACTGGGTTTTAAGCTGA | 10314 |

Figure 1 (Continued)

| | | | | | |
|---|---|---|---|---|---|
| hsa-mir-648 | 2 | MPFIPYLIARCTSQVRNPAPDCSSLIVSFSCAPGLEVLNL PYSVFNSLS* | 10315 | ATGCCGTTCATTCCATATTTGATTGCCAGATGTACTTCTCAGGTCAGAAATCCAGCC CCAGATTGTTCAAGTCTTATAGTGAGTTTTCTGTCTCCAGGTTAGAAGTTTAA ATCTCTTTATAGTGTATTCAACAGCTTGAGTTAA | 10316 |
| | 3 | MYFSGQKSSPRLFKSYSEFFLCSRFRSIEKSLL* | 10317 | ATGTACTTCTCAGGTCAGAAATCCAGCCCAGATTGTTCAAGTCTTATAGTGAGTTT TCTTGTCTCCAGGTTAGAAGTTTAAATCTCTTTATAG | 10318 |
| | 4 | MVCVFLL* | 10319 | ATGGTTTGTGTGTTCCTGTAA | 10320 |
| hsa-mir-658 | 1 | MEKPRLY* | 10321 | ATGGAGAAACCCGTCTCTACTAA | 10322 |
| | 2 | MPVIPATREAEAGESLEPGRRRLR* | 10323 | ATGCCTGTAATTCAGTCTACTCGGGAGGCTGAGGCAGGAGAGTCGCTTGAACCCGG GAGGCGGAGGTTGCGGTGA | 10324 |
| | 3 | MLHKRWPASRVKEDSDTGA* | 10325 | ATGCTACACAAAGATGGCCGGCTTCTCGCGTGAAGGAAGATTCGGATACGGGGGC CTGA | 10326 |
| | 4 | MAGFSREGRFGYCRGLMDLVVGGLPAASKLFKRSDFTRL NLLGIKIEIWPGAMAHACNPYTLGGRGGWMI* | 10327 | ATGGCCGGCTTCTCGCGTGAAGGAAGATTCGGATACGGGGCCTGATGGATTTAGT TGTAGGCGGTTTGCCTGCAGCGAGTAAAATTATTCAAACGTTCGGACTTCACAAGACT AAACTTACTGGGGATAAAAATTGAGATTTGGCCGGGCGCGATGGCTCACGCCTGTA ATCCTACACTTTGGGAGGCCGAGGCGGGTGGATGGATCTGA | 10328 |
| hsa-mir-659 | 1 | MEKPRLY* | 10329 | ATGGAGAAACCCGTCTCTACTAA | 10330 |
| | 2 | MPVIPATREAEAGESLEPGRRRLR* | 10331 | ATGCCTGTAATTCAGTCTACTCGGGAGGCTGAGGCAGGAGAGTCGCTTGAACCCGG GAGGCGGAGGTTGCGGTGA | 10332 |
| | 3 | MLHKRWPASRVKEDSDTGA* | 10333 | ATGCTACACAAAGATGGCCGGCTTCTCGCGTGAAGGAAGATTCGGATACGGGGGC CTGA | 10334 |
| | 4 | MAGFSREGRFGYCRGLMDLVVGGLPAASKLFKRSDFTRL NLLGIKIEIWPGAMAHACNPYTLGGRGGWMI* | 10335 | ATGGCCGGCTTCTCGCGTGAAGGAAGATTCGGATACGGGGCCTGATGGATTTAGT TGTAGGCGGTTTGCCTGCAGCGAGTAAAATTATTCAAACGTTCGGACTTCACAAGACT AAACTTACTGGGGATAAAAATTGAGATTTGGCCGGGCGCGATGGCTCACGCCTGTA ATCCTACACTTTGGGAGGCCGAGGCGGGTGGATCTGA | 10336 |
| | 1 | MRLGFINGRIMSARFNVAMGVLCCVCVCMYVCVLGGAC ASEHRGRRSEQREISLSMATSGTHLRSHLGQGS* | 10337 | ATGCGCCTCCGGCTTCATTAACGGCAGGATCATGAGCGCGCGTTTAATGTGATGGA GTGCTGTGTTGTGTGTGTGTGTGTATGTGTGCTGAGGTGCTTGCT AGTGAGCACCAGGCAGGCGCTGAGCAGGAGAGATCAGTCTTTCCATGGCCAC GTCTGGGACTCATCTGCCGAGCGTATCTAGCCCAGCGCTCTAG | 10338 |
| | 2 | MYVCWEVLALVSTEAGALSRERSVFPWPRLGLICGAI* | 10339 | ATGTATGTGTGTTGGGAGGTTGCGCTAGTGAGGCGCAGGCAGGCGCTGAG CAGAGAGATCAGTCTTTCCATGGCCACGTCTGGGACTCATCTGCGGAGCCATCTA G | 10340 |
| | 3 | MCVGRCLR* | 10341 | ATGTGTGTTGGGAGGTGCTTGCGCTAG | 10342 |
| hsa-mir-9-2 | 4 | MVLGLFWAGGQHYEQARKGRRWLWWRLLRSALGRQV CRFIVPRSPSFVFLTCSWPLGPTPARGVCACARGSGAR GGWGLSRQGHAWLSVLRLHLAGKLGAAGGAERQRLSL PPCSPRAAFTYGPLV* | 10343 | ATGGTTCTCGGCTTTGGGCCGGTGGGCAGCATTACGAGGCAGATCTAGAGCAGCAAGAAAGGG GCGCGCAGGCTGTGTCACCTCGCAGCCCCAGCTTGTTTCTGACATGTTCGTGCCATTG TTTCATCGTTCACCTCGCGAGGGAGTGGTGCCAGCCATGGCGTGTCGGCGCGGCGGCGG CGGGGCCACGCTCGCCGCCAAGGAGCACATGCGCCAGCATGCTGTCTCTCCGCGCACTT GGCGGGAAAGCTAGGGGCGCCGGGCTGCGGGGCTGAGCGCCAGCGCGTCATTACCGC CTCCCTGCTCCCGCGGGCTGCATTACATACGGGCCACTCGTCTGA | 10344 |
| | 1 | MYLIAKDFSTLFSYVFFNCKLLGP* | 10345 | ATGTATCTGATAGCTAAGGATTTTCAACTTTATCTTACGTATTTTCAACTGTA AATTATTGGGCTTTAA | 10346 |
| | 2 | MDGFNCC* | 10347 | ATGGATGGAATTAATTGCTGTAG | 10348 |
| hsa-mir-92a-1 | 3 | MELIAVRRLENSKYRFGRW* | 10349 | ATGAATTAATTGCTGTTAGGAGGTTGGAAAATAGCAAATATAGATTTGGACGGTG GTAG | 10350 |
| | 4 | MPYLFFPYFSLFQSYTWT* | 10351 | ATGTTTTATCTTTTTTCCTTATTTCCTATTCAGTCATACACGTGGACCTAA | 10352 |

Figure 1 (Continued)

| | | | | |
|---|---|---|---|---|
| hsa-mir-92a-2 | 1 | MCQGGSECAILARMPVAPAPATASAWAAVPGAPLIK DSSLGEERRENADCGPPVGNWGSVGFSLWRGGGSVS* | 10353 | ATGGGACAAGGTGTAGTGAGTGCGCCCATCCTGACCCGGATGCCGCCTGGTGCCACCCGC ACCGGCTCCGGCACGGCCTCGCTGCCTGGCCGTGTCCAGGCGCGCCTTTAATTAA GGACTCCAGCTTGGGGGAAGGAGAGAAGGAAATGCCGACTCCGGGGTCCCGCCGTGG GTAACTGGGGCTCGGTGGGGTTTCGCTTGGCGCGTGGGGTTCCGTTCCTAA | 10354 |
| | 2 | MPTAVRPWVTGARWGFRFGGVQVPPFNSCAGRVGGG GLFSLGY* | 10355 | ATGCCGACTGCGGTCCGCCCGTGGGTAACTGGGGCTCGGTGGGGTTTTGCGCTTGGC GGGGTTGGGGGTTCCGTTCCTAATTCCTGTGCGGGCCGGTGGGCCGGGGCGGGCT TTTTCCTTGGGCTATTAA | 10356 |
| | 3 | MCARGLDPFSGRFFSLLFPFWLRGRLRSHPAPERSSCAL GHWVYVWRGHPERAARAGSPRSPPARGGFELGPARGF PSGWLGKKGALRWGSCIDPVELTGWVGGDGAGGT* | 10357 | ATGTGCGCTCGCGGCCTTGATCATTTAGTGAGCTTTTTCTCACTTCTTCCCCT TCTGCCTCCGCGGGAGACTGCCTCCGACCCCGACCCCGTCGAGCTGCGCG CTTGGGACACTGGGTATACGTGTGGAGGGGACACCTCCGAGAGGGTCGCCCCTGCGGG AATCCCCGGCTCTCCACCTGCGGTCTGGTCCGGAGCTGGGCAGTGATCCGG TCCCGAGCGGTGCAAGAGAGAGCCCTTCGTTGGGACAGTGTGATCCG GTAGAGTTGACTGGTTGGTGGGAGGGAGGGAGGGGACGGAGCGGGGACTTGA | 10358 |
| | 4 | MRGCTWREKRDSPSPSWLLSHQPGNGGGRRGLGAFLV L* | 10359 | ATGTGGGGTGCACGTGGAGGGAAAAAAGGGACTCCCCTCCCTTGGCTTCTATCC CACCAACCCGGGAATGGAGGGAGGAGGAGGAGGGACGTGGGCTTGGCCGTGTTTTGTGCT TTGA | 10360 |
| | 1 | MELSGWGPEVCGRGTEVCGRGRWNVGGGVGHVLCGP LCT* | 10361 | ATGGAGCTAAGCGGGTGGGGTCCTGAGGTATGTGGAAGGGCACCGAGGTATGTGG GAGAGGACGTTGGAACGTGCGCGAGGAGTTGGACACGTTCTGTGTGAGCGTTAT GTACTTAA | 10362 |
| hsa-mir-92b | 2 | MWKGHRGMWERTLERGRGSWTRSVWAVMYLRGRSG VARWLTPVIPTLWKAEASGSQGQGFKTSLAKMVKPRL Y* | 10363 | ATGTGGAAGGGCACGAGGTATGTGGAGAGGACGTTGGAACGTGGCGGGGGA GTTGGACACGTTCTGTGTGGGCGTTATGTACCTTAAGAGGCAGATCCGCGTGCAC GGTGCTCACGCCGTAATCCAACACTTGGAAGGCGAGGCGAGTGGATCACAA GGTCAGGGGTTCAAGACCAGCCTGGCCAAGATGGTGAAACCTCGTCTACTAA | 10364 |
| | 3 | MGFTDIELSFGEQSRGDR* | 10365 | ATGGGATTTACGGACCAGACACAGAACTATCCTTTGGGAGGCAGAGTGGTATTGGGACAG GTAG | 10366 |
| | 4 | MRDSQEYCAAAVHEGRKLSQAAAARGTWVPQSQAAL* | 10367 | ATGCGCGACAGCCAAGAGGTGTGTGCGCAGCAGTGCACGAGGGGAGGAAGCTATC CCAGGCCGGCAGCACGTGGGAACTTGGGTCCCGCAGTCGCAGGCTGCGCTCTAG | 10368 |
| | 1 | MANGWTGSRPGRRNPEL* | 10369 | ATGGCCAATGCTGACTGGTCTCCCGACCTGGCGAGGCGAGGAATCCGAGCTGTGA | 10370 |
| hsa-mir-93 | 2 | MAGLAPALGGGIPSCEAAGIRAHVLLCLLRAEAMAGAG VGCGGGVRWRRSR* | 10371 | ATGGCTGGACTGGCCCCAGTGCTGTCTTTGTTTACTAAGAGCGAAGCATGCCGGAGCGG GGGTGGGTGCGCGTGGCGGGGTGCGGTGCGGAGGTCCCGGTGA | 10372 |
| | 3 | MCFFVY* | 10373 | ATGTGCTTCTTCGTTTACTAA | 10374 |
| | 4 | MLDGPVHCHGLFILRWLEIDL* | 10375 | ATGTTGGATGGCCCTGTGCACTGCCACGGGCTCTTTATTCTTCGGCTGGTTAGAAACA GACTTGTGA | 10376 |
| | 1 | MRLFPNRGRFCLASLVWTPRGAERRLCAQPGAGAGECL GPAGGRAGRSQSGAQ* | 10377 | ATGCGGCTCTTTCCAAACCGGGCTGCCGTTTTGCTGCTTCTGTGCTTGGACTCCG CGCGGAGCTGAGGCGGCTGTGCGCCAGCCTGAGCCGCAGGTGAGTGTCT GGGCCCGGAGCGCGGGAGCCAGAGCGGGGCTCAGTAG | 10378 |

Figure 1 (Continued)

| | | | | |
|---|---|---|---|---|
| hsa-mir-96 | 2 | MTRQCLLALPRLQAEAPTGRLGPGSASGVCPAPSAVPGRGRGRERLRSECGRCLRGAYPRGVWLGSGCVSPPWWAQAEAPGWEGAAESSAGAPELAPPASCQGCAAAGSRLLPWPGAAPPSLWGKAALRPPVCLHFAATHPGNPCGARE* | 10379 | ATGACGCGGCAGTGCCTACTGCTCTTCCGCGCCTTCAGGCAGGAGGCGCCACGGGGCGCCTGGGTCCCGGGTCCGGCAGTGCCCGGGTCCCAGGTCCTGCCCAGTCGCAGCCCAGCCGGTCCAGCCGGTTCCGAGGTGCGGGGGCGGGGCGGGGCAGAGCTGCCTGCGGCTCCAGCCGGTCCGAGGAGCTGCGGGGTCTGGGGAGGGCGGGCGGCGGCGGGGCTGCGCGCCGCCCGATGGGCTGCGGGAGGAGAGCGCCAGGCTGGTAGCAGGTCTCGAGCCTCCGTGCCCCGAGCCGCCCCCAGTCTGCCCAGTCGGGTGGGGGGAAAGCGGCTCTCAGACTCTCCGTGTCCCCTGCCCACCACTCATCCCGGGAACCCCGGCACGCGGAATGA | 10380 |
| | 3 | MRHRSPFSTAPFLLIALVAPREPALFQDRRLDGLPLAPHRSAHPRTMGSEGVTRGQGSPDSTVSSRLSHSFALPLTRAPGHRVQ* | 10381 | ATGAGACACCGTTCCCGCCTCAACTGCCCATTCCTGTTAATAGCGCTAGTGGCACCCAGGTTCCCAGCCTTCCTGCCCGCGCCCTTCCCAAGATCGGGCGCTGGACGCTTGCCTGCTGGCGCTCACCGGTCAGCCATCCCAGGACTATGGGCAGTGAGGGTGTCACCGGGGTCAGGGGTCGCCGGATTCACGGTGTCCTCACGGCTGAGCCATTCGTTGCTCTTCCAACCCGGCCTCCCGACACCGTGTACAGTAA | 10382 |
| | 4 | MGTESADL* | 10383 | ATGGGCACCGAGTCGGCGGATCTGA | 10384 |
| hsa-mir-99b | 1 | MAGTAGGRGEAAVRRRRGEDGERSAAVGPGLRARGGGEDPFPATREPREP* | 10385 | ATGGCGGGACGGGGAGGAAGGGCCGCCTGCGGCGAAGGCGGGAGAGGATGGAAGGCGGGCGGGAGGCCCGCCTCGCGGCCCGCCCCCGCCCAGCCCCCTCGCGACCGGGAGCCGTGA | 10386 |
| | 2 | MESARRRWGPACGPGAAEKTPSLRRGSRGSRESAEREGGGLGPALLGP* | 10387 | ATGGAGAGCGCTCGGCGGCGACGCGGAGCCCGGCCCTGCGGGGCGGCGGCAGAGAAGACCCCTTCCCTGCGGAGACGCGGGAGCCGGAGCCGTGAGTCTGCGGAAGGGAGGGTGGGGGGCTGGGCCTGGGCTGGTAGGATCGTGGCTGAAGAGACTAG | 10388 |
| | 3 | MGAGAGRIVAGRD* | 10389 | ATGGGGGCTGCGGGGCTTTGAGGGGTCAAGGGTGAGCCGTAGAGACTAG | 10390 |
| | 4 | MGLRGFEGSRVSRASGRGPRERRGRLSGLPDRPGSAAGAGDVWRRRGPASMLPRGPGIPGPRPLLPQJWEYTTQSPTHSRIRAPSPLFSRIQESEPPVCSLRPGNPHSSP* | 10391 | ATGGGGCTGCGGGGCTTTGAGGGGTCAAGGGTGAGCCGTAGCCAGTGGAGGGAGCCGAGGAGGGCGGAGGGTCTGGAGGAGGAGGAGCCCAGAGGTCAGCAGGCCAGGGTCAGCCGTGGGACCCGGGATTCAGTTGCCAGACCGTTCAGATCTGGAGTACCACCACCAGTCCCCACCCCATTCCAAGAATCCGAGCCCCGAGCCCTTTTTCAGGATCCAGGAGTCGTGAGCCCCCAGTCGTGTCTCTCAGGAATCCACACTCCAGCCGTGA | 10392 |
| | 1 | MPLLPAAKCSLPS* | 10393 | ATGCCCCTGCTCCCGGCGGCCAAGTGCAGCCTGCCCCTGA | 10394 |
| | 2 | MSLASNALRSFNFLQ* | 10395 | ATGTCCTTGGCCAGTAATGCCCTTCGGTCTTTCAACTTTTACAGTAG | 10396 |
| | 3 | MPPGLSTPYSRFCVRGNGMYSSTYRFLKN* | 10397 | ATGCCCCTTCGGTCTTCGTCTTCAACTTTTACAGTAGATTCTGTGTCAGAGGTAATGGTATGT | 10398 |
| | 4 | MVCHLQLTGP* | 10399 | ATGGTATGHGATTCTTCAACTTACCGGTTTTAA | 10400 |
| hsa-let-7a-1 | 1 | MSEPVSDGYSCADFCHSLAASSARSCAWHKCKYACYTPGL* | 10401 | ATGAGCGAGCCTGTTTCTGATGCTTACAGCTGTGCAGACTTCTGCCACAGCCTTGCTGCTTCAAGTGCACGATCTGTGCGGCACAAGTGTAAATATGCCTGTTACACGCCTGGGTTATATAA | 10402 |
| | 2 | MATAYVQISATALLLQVHDPVRGTSVNMPVTRLLGYKIWEBQRRRSFPLYFSFSVLPSSLSISTTPPPTQRPCNSN* | 10403 | ATGGCTACAGCTGTCAGTGCACAGATTCTGCCACAGCTTGCCTGCTTCAAGTCACGATCCTGTGCGGGCACAAGTGTAAATGCCTGTTATACGCCTGGGTTATAGCCGTCTATTTTTCTTTTCGTAATCTTACCTCTCCCTTTCTACTCTACCACCCGTAATGTACACCAACTTCACTGGCTTAA | 10404 |
| | 3 | MNIKLLGKNPF* | 10405 | ATGAATATAAAGCTATTAGGAAAAAATCCTGACTTTTAG | 10406 |
| | 4 | MLDFMWLGLLQGRRP* | 10407 | ATGTTGGATTTTATGTGGCTGGGACTTCTGCAGGGGAGACCATAA | 10408 |
| hsa-let-7a-2 | 1 | MLPQLMVHQLSLA* | 10409 | ATGCTGCCTCAGCTAATGGTACCACCAACTTCACTGGCTTAA | 10410 |
| | 2 | MFQDPFKNILNVIFSSH* | 10411 | ATGTTTCAAGATCCGTTTAAAAACATTATTTAAATGTATTTTTAGCAGCCATTAA | 10412 |

Figure 1 (Continued)

| | | | | | |
|---|---|---|---|---|---|
| hsa-let-7c | 3 | MLFLAAIMLYTLNYLIKLHAK3KSLFSFRYFIVQNLVASL FAIVLSLSKLLL* | 10413 | ATGTTATTTTAGCAGCCATTAATCTCTACACTCTTAATTATCTTATTAAGCTCCATG CCAAATCCAAATCTCTTTTCAGCTTTCGCTACTTCATTGTGCAAACCTAGTGCTTC TTTAACAGCCATGTCTCTTTCACTTTCAAAACTGTACTGTGA | 10414 |
| | 4 | MPNPNLFSAFATSLCKT* | 10415 | ATGCCAAATCCAAATCTCTTTCAGCTTTCGCTACTTCATTGTGCAAAACCTAG | 10416 |
| hsa-let-7d | 1 | MPLLPAAKCSLPS* | 10417 | ATGCCCCTGCTCCCCGCGGCCAAGTGCAGCCTCCCTTCCTGA | 10418 |
| | 2 | MSLASNALRSFNFLQ* | 10419 | ATGTCTTGGCCAGTAATGCCCTTCGGTCTTTCAACTTTTACAGTAG | 10420 |
| | 3 | MPFGLSTFYSRFCVRGNGMYSSTYRFLKN* | 10421 | ATGCCCTTCGGTCTTTCAACTTTTACAGTAGATTCTGTCAGAGAGTAATGGTATGT ATTCTTCAACTTACGGTTTTAAAAAATGA | 10422 |
| | 4 | MVCHLQLTGF* | 10423 | ATGGTATGTATTCTTCAACTTACCGGTTTTTAA | 10424 |
| | 1 | MAGTAGGRGEAAVRRRRGEDGERSAAVGPGLRARGG GEDPFPATREPREP* | 10425 | ATGGCGGGGACGGCGGGAGGAGGAGAGGCCGCCGTGCGGCGAAGGCGGGAG AGGATGGAGAGCGCTCCGCGCGGGTGGGGCCGGCCCGCGCGGGGCGGGG AGAAGACCCCTTCCTGA | 10426 |
| hsa-let-7e | 2 | MESARRRWGPACGPGAAEKTPSLRRGSRGSRESAEREG GGLGPALLGP* | 10427 | ATGGAGAGCGCTCCGCGGCGGTGGGGCCCGGCTGCGGGCCCCGGGCGGCGAAGA AGACCCCTTCCTGACGGCGGAGAGGCCCAGCATCCATGCTCCCTGGGGACCCGG GGTGGGGGCGCTGGAGCCGCACTCCTGGGTCC.CTGA | 10428 |
| | 3 | MGAGAGRIVAGRD* | 10429 | ATGGGAGGGCTGGAGCGTGGTAGGATCGTGGCTGGAAGAGACTAG | 10430 |
| | 4 | MGLRGFEGCSRVSRASGRGPRRRGRLSGLPDRPGSAAGA GDYWRRRGPASMLPRGPGIPGPRPLLPQIWEYTTQSPTR SRIRAPSLFSRIQESEPPVCSLRPGNPHSSP* | 10431 | ATGGGGCTGCGCGGCTTTGAGCGGTCAAGGGTGAGCGTGCCAGTGGGAGGGGCC GAGGAGGAGGGGAGGTTGTCTGGGCGTGCCAGACAGGCAGGGTCAGCGGTCGGG GCAGGAGAGTCTGGAGGAGGAGCCCAGCATCCATGCTCCCTGGGGACCCGG GATTCCAGGTGCAAGTGTCCCAGAATCCTCCTCAGCCCCTTTTTCCAGGATCCAGGAGTCTGA CACCCAGTCTGTTCTCTCAGACCAGGGAATCCACACTCCAGCCCCTGA | 10432 |
| | 1 | MPLLPAAKCSLPS* | 10433 | ATGCCCCTGCTCCCCGCGGCCAAGTGCAGCCTCCCTTCCTGA | 10434 |
| | 2 | MSLASNALRSFNFLQ* | 10435 | ATGTCCTTGGCCAGTAATGCCCTTCAACTTTTACAGTAG | 10436 |
| hsa-let-7f-1 | 3 | MPFGLSTFYSRFCVRGNGMYSSTYRFLKN* | 10437 | ATGCCCTTCGGTCTTTCAACTTTTACAGTAGATTCTGTCAGAGGTAATGGTATGT ATTCTTCAACTTACAGTGA | 10438 |
| | 4 | MVCHLQLTGF* | 10439 | ATGGTATGTATTCTTCAACTTACCGGTTTTAA | 10440 |
| | 1 | MKLTDSVLRSFRVAKVFREMSDKINCFDFSPNGETVISS SDDDSIVLYDCQEGK* | 10441 | ATGAAGCTGACCGACAGCGTGTTGCGGAGCTTCCGCGTAGCTAAGGTGTTCCGGA AAACTGGACAAGATTAACTGCTTCGATTTCAGCCCAACGGCGAGACGGTCATCTC AGTAGGCGACGACGACTCCATCGTGCTATGACTGCCAGGAGGGCAAGTGA | 10442 |
| hsa-let-7g | 2 | MTARRASECGGGPGPESQCLPPVAQHRSLGLPSVPTSAP SLFCTRSCQGGRLHPAAVQETFYFLLKKKR* | 10443 | ATGACTGCCAGGAGGGCAAGTGAGGGCCCTGGGCCTGAGAGCCAGTGCCTTCCTG CCTTCCTCCGGTTGCACAGCCAGCACAGCCTCGGCCTGCCTGGGGGTCCAGC CCCCAGCTATTTGCACGGGTTCTGCAGGGCGCCTCCACCCGCCAGCCGTCCA GGAGACCTTTTATTTTTTATTTCTTAAAAAAAAGATAA | 10444 |
| | 3 | MSSVSFERYASLAKPHLDLDL* | 10445 | ATGTCTTCGGTCTCTTTGAGCGCTATGCATCACTGCCAAAGCCCACCTTGACCTTG ACCTTTTAA | 10446 |
| | 4 | MHHLPNPFLTLTFKRPVRPPWAHQVAPSAPQAVKGAGL LRPRRTAGAAFLPPSAASALSCALSTVTSIPPWHSAHPL PLSFPRPFCRQTAWVALLSCQDLFVVPL* | 10447 | ATGCATCACTTGCCAAACCCCACCTTGACCTTGACCTTTAAACGCCCGGTCCGCA CCTGGGCCCACCACCAGGTAGCGTTTCAGCCTCCAGCGTGTCAAGGTGCTGTCTG CTCCTGGGCCCTGACGCAGGACTGCAGGGGCTGTTCTGCCTCTCGGCAGCGTCA CCTCCTCCTCCTGTCTCTCCACTGTGACCTGGATTCGGCACTCGCCCATC CCCTGCCCCTCCAGCTCGCCTTCTGCCGTCAGACCGCGGGTTGCACTTGA TAGCTGTCAGGATTATTGTTGTGCCCTTTGA | 10448 |

Figure 1 (Continued)

| | | | | |
|---|---|---|---|---|
| hsa-let-7i | 1 | MFWLLFGGAGGSLCGMPAGDYRRRERAGGFDSAAR VGARVPDSAAAQPPPGTRSREGRERSSGRGGSS* | 10449 | ATGCCTTGGCTGCTGTTTGGCGGAGCGGAGGGAGCCTCTGGGATGCCGCCGG CGATTATCGGTCGCTGAGAGCGGTCCGTGGCTGCGGGTTCGACAGCGCGGGGTGG GGGCCCGGTACCGGACTCCGCGCCGCAGCCCAGCCCCACCGGGGACTCGGAGCAGG GAGGGGCGCGAGCGGCGCGACGTGGCGCAGCTCTAG | 10450 |
| | 2 | MALAEVVCAVGRVVTLPAVEITAQATATALLVLVMLSA AEDMGWESPLFSGALPGDSPRSLGARPARPPRKPLVSHF PRRN* | 10451 | ATGGCCCTGGCTGAGGTAGTAGTTGTGTGTGTGGGTAGTTGGGTCGGGATGCCGCT GAGAGATAACTGCGCAAGCTACTGCCTTTGTTTCTAGTGCTGTTGGTGATCTCAGCGCGCG GAGGACAAATGGCTGGGAATCCCCTTGTTTCGAGGCCCTGCCTGCGGGACAGCCC GCGAAGCCTGGCGCCGCCGGCCGGGGCGCGCACCGGCCACCACGGAAACGTTTCACATTT TCCTAGAAGGAATTGA | 10452 |
| | 3 | MAGNPLCFPGRCLGTAREASAPGRRGHHGNR* | 10453 | ATGGCTGGGAATCCCCTTGTTTCCGGGCGGTGCCTGGGGACAGCCCGCGAAGCC TCGGCGCCCGCCGGCGCGACCACCGGAAACGTTAG | 10454 |
| | 4 | MHFKGWERAKPLDSFS* | 10455 | ATGCATTTTAAAGGTTGGGAAAGAGCTAAGCCATTGGATTCCTTTCTTGA | 10456 |
| hsa-mir-100 | 1 | MSEPVSDGYSCADFCHSLAASSARSCAWHKCKYACYT PGL* | 10457 | ATGAGCGAGCCTGTTTCTGATGGCTACAGCTGTGCAGATTTCTGCCACAGCCTTGCT GCTTCAAGTGCACGATCCTGTGCGTGGCACAAGTGTAAATATGCCTGTTACACGCCT GGGTTATAA | 10458 |
| | 2 | MATAVQISATALLLQVHDPVRGTSVNMPVTRLGYKIW EEQRRSFPLYFSFSV1PSSLSHSTTPPPTQRPCNSN* | 10459 | ATGGCTACAGCTGTGCAGATTTCTGCCACAGCCTTGCTGCTTCAAGTGCACGATCCT GTGCGTGGCACAAGTGTAAATATGCCTGTTACACGCCTGGGTTATAAAATCTGGGAG AACAACGGCGCTCCTTTCCTCTATTTTCTTTCTGTCTTACCCTCCTCCCTTC TATCTCTACCACCCCTCCCAACAAAGACCCTGTAATTCTAATTAG | 10460 |
| | 3 | MNKLLGKNPDF* | 10461 | ATGAATATAAAGCTATTAGGAAAATCTGACTTTAG | 10462 |
| | 4 | MLDPMWLGLLQCRRP* | 10463 | ATGTTTGGATTTATGGCTGGGGCTTGCTGCAGGAGAGACGACCATAA | 10464 |
| hsa-mir-103-1 | 1 | MGISAVLRGPRWGVSGNAGSPGRLARPPEGSGAEGRG VCVNVAHSLFPRPRPRPGCWRGSLAVRRRL* | 10465 | ATGGGCATTTCCGCGGTTTTGCGCGGCCCCTCGCTGGGGTCAGTGGCAACGCGGG GAGCCCCGGGCCGCTCCGCCGCCCCGGAGGAGCGGCGGGGAGCGGCGGGGT GTGTGTGTAAATGTTGCGCACTCGTCTTCCCCGCCGCCGCCGCCCGTCCAGGGTGC TGGCCGTGGATCCCTTGCCGCCGGCGACTGTAA | 10466 |
| | 2 | MLRTRFSPAPARVQGAGVGPLPSGGDCK* | 10467 | ATGTTGCGCACTCGTCTTTCCCGGCGGCCGCTGTCCCAGGGTGCTGGCGTGGGT CCCTTGCCGTCCGGCGGCGACTGTAAATAG | 10468 |
| | 3 | MLFT* | 10469 | ATGTTGTTTACATGA | 10470 |
| | 4 | MKDPAGGY* | 10471 | ATGAAGGATCCGGCGGGAGGAGAGTCTAA | 10472 |
| hsa-mir-103-2 | 1 | MKIKDAKKPCKTGAGARQVGRAPLGFV* | 10473 | ATGAAGATCAAAGATGCAAAGAAGCCCTGTAAGACGGGGGCTGGGCGCCCCAGGT TGGGAGGGCACCCTTGGCGCCCGTCTGA | 10474 |
| | 2 | MPRNPVRRGLGPARLGGHPWAPSESPLAGRSASKPVAP RRRFVRYGGGGTJ* | 10475 | ATGCCAAGAAACCTGTAAGACGGGGGCTGGGCGCCCCAGGTTGGGAGGGCACCC TTGGCGCCCGTCTGAAAGCCCCTTGGCTGGGGCGGTGGCTTCCAAGCCCGTCGTCCC TCGCCGGCGCTTCGTCGGTATGGGGCGGAGGGACCATTTGA | 10476 |
| | 3 | MGAEGPFEPRVRGPRPPHPRHAW* | 10477 | ATGGGGGCTGGAGGGACCATTTGACCGCCGTTCCGGCTTCCGTCCTCCCCATCCC CCTATTCATGATGCAGTGTAA | 10478 |
| | 4 | MHGECLPPPSLSSHFLFEIWEVPEGISDSDFCQTRLVSSP SSP* | 10479 | ATGCATGGTGAATGCCTGCCGCCCCCTAGCCTTTCCTCCCACTTTCTCTTCGAGATCT GGGAGGTGCCAGAGGGAATTTCTGATTCTGATTTGTCAAACCAGACTAGTCTCCT CTCCCAGCTCCCCTGA | 10480 |
| hsa-mir-106a | 1 | MVEREGSGFILHPFPPSLPPACLPGLSSSDPACSLVSDL* | 10481 | ATGGTGGAAAGGGAAGGGTCCGGCTTCATTTGCCACCCTTCCTCCCTTCCCTGCCC CCGGCTTGCCTTCCAGGGCTTGTCGGTCTTAAACTAAGACATCATTTATTCTACAGA TGTAA | 10482 |
| | 2 | MLNSILVRLKLRHHFILQSAVGLWP* | 10483 | ATGCTTAATTCATTTGATTGTCGTTCTTAAACTAAGACATCATTTATTCTACAGA GCGGTGCTGCGGGCTTTGGCCTTGA | 10484 |
| | 3 | MRGESKHAPYLPHCACIRWLLPLTPAKKP* | 10485 | ATGAGAGGAGAAAGCAAGATAATTGCACGTATCTTCCGCACATTTCCGCGTGTATT CGGTGGCTGCTACCGTTAACGATACCGCAAGAAACCTGA | 10486 |

Figure 1 (Continued)

| | | | | | |
|---|---|---|---|---|---|
| | 4 | MCRIE* | 10487 | ATGTGCAGAGAGTAA | 10488 |
| hsa-mir-106b | 1 | MANGWTGSRPGRRNPEL* | 10489 | ATGGCCAATGCTGGACTGGCTCCGCCCTGGCGGAGGAATCCGAGTCGTGA | 10490 |
| | 2 | MAGLAPALGGGHPSCEAAGRAHVLLCLLRAEAMAGAGVGCGGGVRWRRSR* | 10491 | ATGGCTGGACTGGCTCCGCCCTGGCGGAGGAATCCGAGTGTGAAGCGGCTGGAATCCGGACGGCCCATGTGCTTCTTGTTACTAAGAGCGAAGCGATGGCGGGAGCGGGGGTGGGGTGCGGTGCGGTGGGGTGCGGTGGCGGAGGTCCGGTGA | 10492 |
| | 3 | MCFFVY* | 10493 | ATGTGCTTCTTTGTTTACTAA | 10494 |
| | 4 | MLDGPVHCHGLFHLRWLETDL* | 10495 | ATGTTGGATGCCCTGTGCACTGCCACGGGCTCTTTATTCTTCGCTGGTTAGAAACAGACTTGTGA | 10496 |
| hsa-mir-10a | 1 | MHSLQYPLASPPRKQFPVCEAALWTASPLVDPG* | 10497 | ATGCACTCTCTGCAGTATCCTCTAGCTTCTCCTCCCCGGAAACAGTTCCAGTCTGCGAGGCCGCCCTCTGGACTGCTCCCTAGTGGATCCGGGCTGA | 10498 |
| | 2 | MHLGRKGTSQAPDHFALPKDDPGQLERWGVRTERHT* | 10499 | ATGCATCTCTAGGAGGAGAAAGGTACCTCGCAGGCCCAGACCATTTGCCTTACCAAAAGATGACCCAGCCAGTTGAAAAGGTGGGAGTCAGGACGGAAAGGCACCTAG | 10500 |
| | 3 | MTQASWKGGESGRKGTPRGEVEGKCQPVWGVAS* | 10501 | ATGACCCAGGCCAGTTGGAAAAGGTGGGGAGTCAGGACGGAAAGCACCTGGAGAAGTGGAGGGAAAAGTGCCAGCTGTGTGGGGTGTCGCCTCTGA | 10502 |
| | 4 | MIEDTLFRGSCRLVLRCMHLSNSFSFLPSESQGHPREKGNPSQGEVGVWEAIFGRKGNRKRTGCPHRRCSGPEAEAVTSR3CQ* | 10503 | ATGATAGAGGATACCCTATTTCGGGGTCTTGTCGCTGCAGGCTTGTCTTAAGTGCATGCATCTCTCAATTCGTTTCTTTTCGATAATCCAAGGAGTCCAAGGAGGAGAAAAGGAAATCCTTCCCAGGGAGAGGTGGGGTCTGGGAGCGCGATATTTGGGCGAAGGGAAACCGAAAGCACGGTTGTCGCACCGCTGCTCTGACCAGAGGCAGAGGCTGTAACATCCGGAGCTGCAGTAG | 10504 |
| hsa-mir-10b | 1 | MPPRSLGRRPPWAAQSGCSPTFPGEVGGRCLSPFPQSLRS* | 10505 | ATGCCACCAAGAAGCCTGGCGCCGACCCCCTTGGCAGTCAGTCGGCTGCTCCCGTACATTTCCCGGGGAAGTGGGGGTCGTCTAAGCCCTGTCTTCCCCCAATCACTTCGTTCCTAG | 10506 |
| | 2 | MESPSILP* | 10507 | ATGGAGAGCCCCTCAATCTACCCTAG | 10508 |
| | 3 | MCLVFESRL* | 10509 | ATGTGCTTGGTGTTTGAATCTAGGCTTTAG | 10510 |
| | 4 | MLVNF* | 10511 | ATGCTGGTTAATTTTAG | 10512 |
| hsa-mir-125a | 1 | MAGTAGGRGEAAVRRRRGEDGERSAAVGPGLRARGGGEDPPPATREPREP* | 10513 | ATGGCGGGGACGGCGGGAGGAAGGGAAGGCGCGCGTGCGGCGAAGGCGGGGAGAGGATGGAGAGCCCTCCTGACCGGGAGGCGCGGAGCCGCCCGCCTCGCGCGCCCGGGCCGCGGAGAAGACCCCTTCCTGCGACCGCGGAAGGCCGAGCGCGGGAGCCGTGA | 10514 |
| | 2 | MESARRRWGPACGPGAAEKTPSLRRGSRGSRESAEREGGGLGPALLGP* | 10515 | ATGGAGAGCGGCTCGCGGCGGTCGCGCTGCGACGCGGAGAGCGCCGAGCGTGAGTCTGCGGAAGGGAGGTGGGGCTGGGCCCACTCCTGGTCCTGA | 10516 |
| | 3 | MGAGAGRIVAGRD* | 10517 | ATGGGGCTGGGGCTGGTAGGATCGTGGCTGGAAGAGACTAG | 10518 |
| | 4 | MGLRGFECGSRVSRASGRGPRRRGRLSGLPDRPGSAAGAGDVWRRRGPASMLPRGPGPGPRPLLPQIWEYTTQSPTHSRIRAPSPLFSRIQESEPPVCSLRPGNPHSSP* | 10519 | ATGGGGCTGCGGGGGCTTTGAGCGGTGCAAGGGTGAGCCGTGCCAGTGGAGGGGGCCGAGGAGGAGGGGAGGGTTGTCTCGGGCTGCCAGACAGCCAGGTCACGCGGCGGGCGGAGAGATGTCTGGAGAGGAGAGGCAGCATCCATGCTCCCTGGGGACCCGGGAATTCCAGGTCCCACCCCCCTCCCAGATCTGGAGTACACCACCCAGTCCCCCACCCAATCCAGAAATCCGAGCCCCCAGCCCCTTTTCCAGGATCCAGGAGTCTGAGCCCCCAGTCTGTTCTCTCAGACCAGGAATCCACACTCCAGCCCTAA | 10520 |
| hsa-mir-125b-2 | 1 | MYSLRRMGLRDGGGHMLMSPLWRGEIFHSDNWLNAMVKNCKAIFSPREKHGLRSKGCFHFSLFVSAAFLFPWFLFFNYLF* | 10521 | ATGTATTCCTTATGGAGGATGGGTCTCCGTGATGGGGTGTATAATTATGTTAATGTCATTTTATGGAGGGGTGAGATTTTCATTCGATCTGATAATTGTTGAATGCTATGGTCAAAATTGTAAAGCCATATTCAGTTTAGGGAAAAGCATGGACTTAGAATCTAAGGGCTGTTTATTTTTCGCTTTTTGAGTGCGCTTTTTGGTTTTGTTTTTAACTATTTATTTTAA | 10522 |
| | 2 | MGVV* | 10523 | ATGGGGGTCGGTATAA | 10524 |

Figure 1 (Continued)

| | | | | |
|---|---|---|---|---|
| | 3 | MLWSKIVKPYSVLGKSMIDLDLRAVLFFRFL* | 10525 | ATGCTATGTGTCAAAAATTGTAAAGCCATATTCAGTTTAGGGAAAAGCATGGACTTAGATCTAAGGGCTGTTTTATTTTCGTTTTGTGA | 10526 |
| | 4 | MGNQMINRKRSYIMMHYIMEQNI* | 10527 | ATGGGAAATCAAATGATAAACAGAAAGAGATCTTATATAATGATGCATTACATCATGGAGCAGAAATATTTAA | 10528 |
| | 1 | MPVIYS* | 10529 | ATGCCTGTGACCTACAGCTGA | 10530 |
| | 2 | MHFDLYLSM* | 10531 | ATGCATTTGACCTTTATCTTCTATCAG | 10532 |
| | 3 | MHQLFKVIGLRK* | 10533 | ATGCATCAGTTGTTCAAAGTTATAGGCTCAGAAAGTGA | 10534 |
| hsa-mir-128-2 | 4 | MKLRQLPMKTTGEYPIFQAAGTETRKHSLPCDIQLRGLPRKEKPWGRERSAPRRLSILSCCCPKNAFFPELSILKHFLGLICCSRQEELLYEYKGGR* | 10535 | ATGAAACTGATCCAACTGCCCATGAAACAACAGGGGAATATCCATTTCCAGGCTGCTGGTACAGAGACCATAGAAAGCATTCCTCCCATGTGATATCCAGCTCAGGGGATTGCCTAGGAAGGAAAAGCTTGGGGAAGAGCTTGCACCTAGGAGACTTTCAATACTCTTGTCTGCTGCCCAAAATGCATTCTTCCTTTCTTATCATCTCAAGCATTTTCTGGGCTAATCTGCTCCAGGCAGGAGCTCTCTATGAATATAAAGGAGGAAGGTAA | 10536 |
| | 1 | MSLFSPAPS* | 10537 | ATGAGTCTATTTCTCCAGCCGCCCTGTAG | 10538 |
| | 2 | MQLSKYTFPKAVCCKHNAILQSVGGKRGKGMDDFFPPHLGISIVDSNRF* | 10539 | ATGCAGCTTTCAAAATATACATTTCCAAAGGCGGTGTGTTGCAAACACAACGCGATTTTGCAGAGCGTGGTGGAAAACGTGGAAGGTATGGATGATGTTTTTTTCCTCATCTGGGAATCTCATCTGGAATGCAATCGCTTCTAG | 10540 |
| hsa-mir-129-2 | 3 | MFPPLJWESPSWIAIASRALLGSSSGEGAAMPPHPLLSSACRESDQWRHAALRIQPLQRLLLGETARSLQQAETDGS* | 10541 | ATGATTTTTTTTCCTCATCTGGAATCTCCATGTGGATAGCAATCGCTTCTAGAGCTCTCCTGGGAAGCTCTCTGGGAAGGGCTATGCCCCCCCACCCCTACTTTCCTCAGCATGTAGGGAATCTGATCAATGGAGACATGCAGCTCAATGGACATGCAGCTCTAAGAATACAACCACTCCAAACGCCTTCTGCTCGGGGAGACTGCAACAGGCAGGAGCTGCAACAGACAGAGACATGGGAGTTAA | 10542 |
| | 4 | METCSSKNTTTPTPSARGDCEELATGRDRWELTGGRENBRNIWVFF* | 10543 | ATGGAGACATGCAGCTCTAAGAATACAACCACTCCAAGCGCCTTCTGCTCGGGGAGACTGCGAGGAGCTCGCAACAGGCAGGAGCAGATGGGAGTTAACGCAGGGAGGGAGGAATATAAGAAAAAGAATCCAGAGTGTATCTAG | 10544 |
| | 1 | MLEKNPECI* | 10545 | ATGTTAGAAAAGAATCCAGAGTGTATCTAG | 10546 |
| | 2 | MESSARRGASSRGGAALFLLEPRAESCRRVVGLYPPRSGR* | 10547 | ATGGAGTCGTCAGCTAGAAGGGGCGCGTCGTCCGGGTGGGCGCGCCCTTTTCTCCTGGAGCCGCGGGGCCGAGTCAGGGCGCAGGGTCGTCCGGCTGTACCCACCCCGCTCCGGGGCTAG | 10548 |
| | 3 | MDWTGALPIRPPIHG* | 10549 | ATGGACTGGACGGGAGCGCTCTGCCCACCGACCATCCATGGTTGA | 10550 |
| hsa-mir-130b | 4 | MVELPALRVLGVVGSPLLAAGALTRLHYCALRSSAMILSKHLGPALGISLPTLTSHSPGRAPWACRPSPPPYPIRSLLHGNLRF* | 10551 | ATGGTTGAGCTTCCCGCCCTGCGTGTATTGGGGTGGTTCCCCTGCTGGCCGCAGGTGCTCTGACGAGTTGCACTACTGTGCTCTGAAGAAGTGCAATGCAATTGTCAAAGCATTCTGGACCAGCCTTGGGGATCTCCGCCTTCACGCTCCACTCCCCAGGCAGGCCCCTTGGGTTGCAGGCGCCCGACCCCTACCCACTTGCCCCCTTCTCCATGGAAACTTGAGATTCTAG | 10552 |
| | 1 | MALCRAWVWGSGGP* | 10553 | ATGGCTTTATGCAGGGCCTGGGTCTGGGGTCCTGGGGGCCCATGA | 10554 |
| hsa-mir-135b | 2 | MQGLGLGFWGPMREEGCKENQRGLGLGQMAQSSGGRPQDAWLFGPEGWACLECVEGRAVLCCVLCCAVLCCAVVGECRIPVQ* | 10555 | ATGCAGGGCCTGGGTCTGGGTTCTGGGGCCCATGAGAGAAGGAAAGGAGAACCAGAGAGGGTTGGGGCTGGGCAGATGGCCCAAAGTTCAGGTCGAGGGCCGCAGGATGCCTGGTTGTTGGCCCTGAAGGTTGGGCATGTCTGAGTGTGTGGAGGGCGGTGCTGTGTGCTGTGTGCTGTTTCCTACCAGGGTTGCAGGGTACCAGTTGCTTCTTCTTACCAGGGGTTGCAGGGTACCAGTTGTTGGGGAATGCAGATTCCTGCCAGTAG | 10556 |
| | 3 | MPGCLALKVGHVWSVWRGVLCCAVCCVLCCAVLLLGNAGFLSSENRLLLPGLCREPASVALGLRVQLGWERQLLPGRGRA* | 10557 | ATGCCTGGCTGTTTGCCCTGAAGGTTGGGCATGTCTGAGTGTGTGCTGTGTGTGCTGTGTGCTGTTTCCTACCAGGGTTGCAGGGTACCAGTTGCTTCTTCAGTGAAAAACAGGTTGCTTCTCAGGGGTTCTTGCAGGGTTGGCAGGGTAGCAGCAAGTGTTGCCCTGGGGCTGAGGGAGCAGCTACTCCCTGGCAGAGGCAGGGCCTGA | 10558 |

Figure 1 (Continued)

| | | | | | |
|---|---|---|---|---|---|
| | 4 | MSGVCGGDACCAVLCAVCCAVLCCCWGMQDSCPVKTG CFYQGCAGSQQVLPWG* | 10559 | ATGTCTGGAGTGTGTGGAGGGGCTGCTGTCTGTGTCTGTGTGTCTGTGCTGTGCT GTGCTGTGCTGTGTTGTGGGAATGCAGGATTCCTGTCCAGTGAAACAGGTTGCTTC TACCAGGGTTGTGCAGGAGCCAGCAGCAAGTGTTGCCGTGGGGCTGA | 10560 |
| hsa-mir-138-1 | 1 | MTLCC* | 10561 | ATGACTCTTTGTTGTTAA | 10562 |
| | 2 | MISKSWVH* | 10563 | ATGATTTCTAAGAGCTGGGTCCACTAG | 10564 |
| | 3 | MCNVLISLILFLSLIGRIWFSLILLPGKGALTGNC* | 10565 | ATGTGCAATGTACTTATTTCTCTTATCCGTGTTCTTAAGCTTGATTGGAGATTTGGT TTTCGCTTATTCTCTTACTGCCTGGAATAGGAGCTTTAACTGGAAATTGCTAA | 10566 |
| | 4 | MYLPLLSCS* | 10567 | ATGTACTTATTTCTCTTATCCGTCTTAA | 10568 |
| hsa-mir-138-2 | 1 | MPSFFTHELGGLIKEQEVPILHWGQDADPAPVLRELTV* | 10569 | ATGCCCTTCCTTTTCACTCACGAGCTGGGCGGCTCATCAAAGAGCAGGAAGTGCCC ATTTTACACTGGGCCAGGATGCAGACCCAGTCGCTGTCCTCCGCGAACTTACAGTC TAA | 10570 |
| | 2 | MQTQLLSSANLQSN* | 10571 | ATGCAGACCCAGCTCTGTCTCCGGAACTTACAGTCTAATTAG | 10572 |
| | 3 | MHHLNPRTGSFKAKNYRLFRSVQHLLTKKNLRVIFLSL NFYPCLHLARTLNTKFAVICSSANAFLL* | 10573 | ATGCATCATTAAATCCTAGAACAGGCAGTTAAAGCAAGAACTACAGACTTTTC CGCATGTCCAGCATTTGCTGACCAAAAAAGCCTTTAAAGCAAGAACTACAGACTTTTC AATTTTTACCCTTGCCTGCCACCTAGCCAGAACCCTTAATACTAAATTTGCAGTTATAT GCAGCTCTGCCAACGCCTTCTGCTTAG | 10574 |
| | 4 | MQLCQRLPALDWISTILFLY* | 10575 | ATGCAGCTCTGCCAACGCCTTCTGCTTAGACTGATCTTACTATCTTTTCTCT ACTAG | 10576 |
| | 1 | MPGLLPASATLAHLHPRTASSFSLCLFQNSLGPSVRRVL PWPRCKNQNKKQRLLRGADAT* | 10577 | ATGCCAGGGCTGCTCCCTGCCTCGCACCTTCACCCGCTACCGCC TCTCCCCGTCGCTCGCTCTGCCTTTTCAAAACTCACTGGGCCCTCCGTGCGCAGGGTTC TTTTTTGGTTTTTCTGTAAAATCAAAACAGAGACTTTTGAGAGGAGCAG ATGCCACCTAA | 10578 |
| hsa-mir-140 | 2 | MPPKVPLJHSLQSAQMWKPVIGIFPY* | 10579 | ATGCCACCTAAAGTCCCACTGCATTCCCTGCCTCTGGCTGGGTAAGTACTGAGTTCTTCCTGG AATTGGCATTTTATTTTTAATTTA | 10580 |
| | 3 | MIPWAPSLLAGVSTEFSSWPLAFRQPRCSVLSSRVSSFP VPVLFSISPLSSTLSGHAPPEEQLQVMEFLGSWESNQAPP NHCSHPPSLKECDPKKRCP* | 10581 | ATGATCCCCTGGGCCCTCCTCCTCGCTGGCTGGGGTAAGTACTGAGTTCTTCCTGG CCCTTGGCCTTCCGTCCAGCCAGGTGCTCTTCATCTCCCCGCTGTCTTCCTCC TGTTTCCTGCCTGTCCCTCGTGTTTTCCATCTCCCCGCTGCACACTCTGCATGC CCACCAGAGCAATTACAGGTGATGAGCTGGGCAGCTGGGAAAGTAACAAGCTC CACGGAACCACTGTAGCATCCACCACCACCATGCTAAAGGAGTGTGACCCTAAGAAAA GATGTCCCTGA | 10582 |
| | 4 | MPHQSNYR* | 10583 | ATGCCCCACCAGAGCAATTACAGGTGA | 10584 |
| hsa-mir-141 | 1 | MGARDLQLFRRDPGPEAA* | 10585 | ATGGGAGCCAGGGATCTGCAGCTTTTCCGCAGGGATCCTGGGCCTGAAGCTGCCTGA | 10586 |
| | 2 | MMEAPVPVSATSASGPQPLAGCSPLPTSHAPRKPLVLS* | 10587 | ATGATGGAGGCCCCTGTCCCTGTGCCAGCGACAATATCCATGCCTCAGTCCCCAGCCC TTAGCTGGCTGCAGCCCCCCACTCCACGCACCCGGAAGCCCCTCGTCTTG AGCTGA | 10588 |
| | 3 | MGPSPSSHPVRFVTWWIQNPQSTLSLGLARPLSRDLTW PVARVPCSNW* | 10589 | ATGGGCCCCAGCCCTCCTCCCACCACCAGCCGATTGTCACCTGGATCAGAAAC CCACAGTCGACCTTGAGCTTGGGGTTGGCTGCCCCTCAAGAGACCTCACCTGG CCTGTGGCCAGGGTCCCCGTAGCAACTGTGA | 10590 |
| | 4 | MAPGWVLSAVTFREP* | 10591 | ATGGCTCCTGGGTTGGTTCTCGGCAGTAACCTTCAGGAGCCTGA | 10592 |
| hsa-mir-146a | 1 | MQIGLSCLPLPQQIRVSPERCSFSKTLDRSSFPGWHQQG RLEW* | 10593 | ATGCAAATAGGCCTTAGTGCTTCCTCTACCCCAGCAAATAAGAGTCTCTCCAGAA AGATGCTCTTTCTCCAAGACGCTTGACCGCTTCCTTCCTTCCTTGATGGCACCAGCAG GGCCGATTGGAGTGGTAA | 10594 |
| | 2 | MLFLQDA* | 10595 | ATGCTCTTTCTCCAAGACGCTGA | 10596 |

Figure 1 (Continued)

| | | | | | |
|---|---|---|---|---|---|
| | 3 | MAPAGPIGVVNPGPEGMPKGGQDGQQETVAQRGGGEQR LNWK* | 10597 | ATGGCACCAGCAGGGCCGATTGGAGTGGTAAACCCTGGCCGGAAGGCCATGCCAAA GGGTGGACAGGATGGACAGGACAGTAGCACAACGAGGAGGGGGAGAACAGCGG CTGAATTGGAAATGA | 10598 |
| hsa-mir-146b | 4 | MDRRQ* | 10599 | ATGGACAGGAGACAGTGA | 10600 |
| | 1 | MGCP* | 10601 | ATGGGGTGCCCTGA | 10602 |
| | 2 | MKVCPRELFLLHSTIPGTSNLYSGPWGIDWGARTPGLG SYLGDPYLGDSL* | 10603 | ATGAAAGTGTGCCTTCAGGGAACTCTTTCTCCACTCCACTATCCAGGTACTTCAA ATCTTTATTCAGGGTTTTGGGGAGATTTCTGGGGAGTCCCTGGGGCTGGGCT CCTATCTTGGGGATCCATATCTGGGGACTCCCTTAG | 10604 |
| | 3 | MPFSVCVFWLPPQPLTPPAPHQAPPGTHLGRKRQMDPC HGPEPPPLLTYSNSCWNLWNSCPFP* | 10605 | ATGCCCTTCAGTGTGCGTGTTCTGGCTCTTTCCCAGCCTCACCCTCCAGCC CACATCAGGCCCTGAGCCCCCCACCAGGAACACATCTGGCAGGAAGCGACAGATCCTGC CATGGCCCTGAGCCCTGCAGCCCCTTAACCTACTCCAATTCTGTTGGAATTTATGGA ACTCCTGTCCATTCCTTAG | 10606 |
| | 4 | MALSPLPS* | 10607 | ATGGCCCTGAGCCCTGCCCCTCCCTCTTAA | 10608 |
| | 1 | MERWRGVWGRMGKHFPDLLHARNSCSGAVCGGRGSA RMGDRVVAYAAGKRGCREGEKSSLGDCVQGCARTGS AGSTA* | 10609 | ATGGAACGGTGGCGAGGGGTTTGGCGAGAAGATGGGAAAGCACTTTCCAGACCTGT GCACGCGCGCAACAGCTGTTCAGTTGCGGTATGTCAGGGAAAGGGGTCTGCTAGGA TGGGGGACAGAGTGGTCGCTTATGCTGCAGGGGAAAAGGGGTGCCGGGAGGGGA GAAGACTGCTTGGGGACTGTGTGCAAGGTTGTGCGAACGGGGTCCCGCGGGAA GCACTGCCTAA | 10610 |
| | 2 | MWGEGVC* | 10611 | ATGTGGGGGAGGGGTCTGCTAG | 10612 |
| hsa-mir-148a | 3 | MLQGKGGACRGRRAVLGTVCKVVRERGPREALPNGA GRIPKSGWYERRGWDFDFSSRGWARAAGRPGIEYWE WLGKGVSGEAPQSGSFLGRPHLGAPPGPVFVPHRLTLSA PNIRIPRAAPPPPAFQMCR* | 10613 | ATGCTGCAGGGGAAAAGGTGGGTGCCGGAGGGGAGAAGAGCAGTCTTGGGACTG TGTGCAAGGTTGTGCGCGAACCGAGGGTCCGCCGGAAGCACTGCCTAATGGGGCAGGG AGAATCCCAAAGATCCAAAGAGTGGGTGGAACGGAAGGGATGGGACGACTTGCGACCGA GTTCCCGGGGCTGGGCGCCGGGCGCTGGAAGACCGGGAATAGAGTACTGGGAATGG CTGGGGAAGGGGCGTTTCCTCCTCGTCAGTGGAGGCCCCCTGTATTTGTTCCCCACCGTTTAACTCTTCAGCT CATCTTAGGGGGCTTTCGTCCTCGGGCCTGCAGCGCCCCCAGCTTTGTCCCCAGCTTTCAGAGATGGGAAGGTAA CCGAATATTCGTCCTCGGGCCTGCAGCGCCCCCAGCTTCAGATGGGAAGGTAA | 10614 |
| | 4 | MGQGESSQRVGGWNGGDGTTSTRVPGAGRGRLEDRE* | 10615 | ATGGGGCAGGGAGAATCCAAAGAGTGGGTGGGTGGAAGAGGGATGGGACGA CTTCGACCCAGTTCCCGGGCTGGGCGCTGGGCGCTGGAAGACCGGAATAG | 10616 |
| | 1 | MEALILVGAGGAAEMLWCPQGPGVRVQPEWETGKESS G* | 10617 | ATGGAGGCGCTGATTTTGGTAGGAGCTGGAGGTCAGCCGAGATGCTGTGGTGTCC ACAGGGGGCCGGAGTCAGGGTTCAGCCCAGGGAGACCGGGAAAGAGAGTTCC GGGTAA | 10618 |
| hsa-mir-148b | 2 | MDSLGYTDL* | 10619 | ATGGACTCCTTAGGATACACAGACCTGTAG | 10620 |
| | 3 | MFCRYRLLLMVSQV* | 10621 | ATGTTTTGTCGTTACAGATATTTTTCTAGACTCCTTATTCTGTTTCCTCCAAGTTGA | 10622 |
| | 4 | MDCGHFFLDSLECSPFLYPFRP* | 10623 | ATGGATTGTGGAATATTTTTTCTTGACTCCCTTATTCTGTTCCTTTTCCTCTACCCATT TAGACCTTAG | 10624 |
| | 1 | MELRARGWWLLCAAAALVACARGDPASKSRSCGEVR QIYGAKGFSLSDVPQAEISGE* | 10625 | ATGGAGCTCCGGGCCCGAGGCTGGTGGCTGCTATGTGCGGCCGCGCTGGTCGC CTGCGCCCGCGGGGACCCGGCAGCCAAAGAGCCGGAGCTGCCGCGAGGTCCGCAGA TCTACGGGGAGCCAGGGGCGGTTCAGCGCCCAGATCTCAGCGACGTCCCCCAGGCCGAGATCTCGGGT GAGTGA | 10626 |
| | 2 | MCGRSAGRLRPRGPGQQEPELRRGPPDLRSQGLQPERR APGGDLG* | 10627 | ATGTGCGGCCGCAGCGCTGGTCGCCTGCGCCCGCGGGGACCCGGCAAGAGCC GGAGCTGCGCGAGGTCCGCCAGATCTACGGGGACCCAAGGGCTCAGCCTGGGAGCGGT GTGCCCCAGGGGATCTCGGGTGA | 10628 |

Figure 1 (Continued)

| | | | | |
|---|---|---|---|---|
| hsa-mir-149 | 3 | MAPCAAAPLQPHGPRLQAPRRTPSPGSPPPRSVVLRPSP PPARRLLPCGADLAGLRARGAPPGPRLELGVFCPPLGPA RLQAGSPSPGAGCRGAVGLGVAGLSGRR* | 10629 | ATGGCTCCCTGCGCTGCGGCTGCTGCGGCTCCTCTGCAACCCACGGCCGCCTGCCTCCAAGCCCG CGCCGGCACTCCCTGCCCAGGGTCCTCTCCCTGCCGAGCTGATCTGCCGGGCTGCGGCTC CGCCGCCGCACGCGCGGCCTCCCGGGCCACCGGCTGAGCTGAGCGTCTTCTACCCCGCTCGGCC GGGGCTCCGCCTGCAGGCCGGAGTCCAGCCCGGGGCGGCTGTCGGGGCGCTGTG GGGCTCGGCGTGCCGTGGCCGGGCTTCGGGGCGCGCTGA |
| | | | 10630 | |
| | 4 | MGTQRRNAHGPGIDSEQEGSVHLGEGGLWPCLAAGGG VVGGGSRALDPCPSRRMRTHRQPLALGGSPDAPSLRPL* | 10631 | ATGGGGACTCAGCGCAGAAATGCCCATGGTCCTGGGGATTCTGAGCAAGAAGGATC CGTGCATCTGGGGTGAGGGGGGTCTGGCATGCCTTGCCGCGGGGGCGGCGAGTGG TGGGAGGAGGCAGTCGGGCTCTGGACCCTCGCCCTCAAGGAGGAACAGAACCCAC AGACAGCCCTTGCCTTGGTGGATCTCCCGATGCCCCAGCCTGAGGTTCTTGTAA |
| | | | 10632 | |
| hsa-mir-15b | 1 | MAPFFKSRCL* | 10633 | ATGGCTCCTCCTTCCCGAAGTCCGCTGCCTCTAA |
| | | | 10634 | |
| | 2 | MPRKGTQPSTARRREEGPPPPSPDGASSDAEPEPPSGRT ESPATAAGE* | 10635 | ATGCCCCGTAAAGGCACCCAGCCTCACTGCCCGGCAGAGAGGAGGGGCCGCC GCCGCCGTCCCTGACGGCGCCAGCGACGCGGAGCCTGAGCCGCCGTCCGGCC GCACGGAGAGCCCAGCCACCGCCGCAGGTGAGTGA |
| | | | 10636 | |
| | 3 | MGASKRVQL* | 10637 | ATGGGGGCGAGCAAACGGGTTCAGTGTGA |
| | | | 10638 | |
| | 4 | MVQVTNKNSISLLYSR* | 10639 | ATGGTACAGGTCACAAACAAAATTCAATATCTTTATTGTATTCCGCTAA |
| | | | 10640 | |
| hsa-mir-16-2 | 1 | MAPFFKSRCL* | 10641 | ATGGCTCCTTCTTCCCGAAGTCCGCTGCCTCTAA |
| | | | 10642 | |
| | 2 | MPRKGTQPSTARRREEGPPPPSPDGASSDAEPEPPSGRT ESPATAAGE* | 10643 | ATGCCCCGTAAAGGCACCCAGCCTCACTGCCCGGCGCAGAGGAGGAAGGGCCGCC GCCGCCGTCCCTGACGGCGACGCGGAGCCTGAGCCGCCGTCCGGCC GCACGGAGAGCCCAGCCACCGCCGCAGGTGAGTGA |
| | | | 10644 | |
| | 3 | MGASKRVQL* | 10645 | ATGGGGGCGAGCAAACGGGTTCAGTGTGA |
| | | | 10646 | |
| | 4 | MVQVTNKNSISLLYSR* | 10647 | ATGGTACAGGTCACAACAAACAAAATTCAATATCTTTATTGTATTCCGCTAA |
| | | | 10648 | |
| hsa-mir-17 | 1 | MYLIAKDFSTLFSYVFFNCKLLGF* | 10649 | ATGTATCTGATAGCTAAGGATTTTTCAACTTTATTCTCTTACGTATTTTTCAACTGTA AATTATTGGGCTTTTAA |
| | | | 10650 | |
| | 2 | MDGINCC* | 10651 | ATGGATGGAATTAATTGCTGTTAG |
| | | | 10652 | |
| | 3 | MELIAVRRLENSKYRFGRW* | 10653 | ATGGAATTAATCGCTGTGTAGGAGGTTGAAAATAGCAAATATAGATTTGGACGGTG GTAA |
| | | | 10654 | |
| | 4 | MPYLFFPYFSLFQSYTWT* | 10655 | ATGTTTTTATCTTTCCTATTCCAGTCATACACGTGGACCTAA |
| | | | 10656 | |
| hsa-mir-185 | 1 | MPRALLEGVFDNPRWRGMRGTLAGGTRLAAGRLRSAG LGAAWSLQGVWAARPWPASGTALAPGHSAPYPRPAAG QQGDS* | 10657 | ATGCCCCGGCTTACTGGAAGTGTTTTTGATAATCCCGTGGCACGGGATGCGA GGGACTCTGGCAGGTGGGACCAGAGCTGCGGGGAGGCTGAGATCGGCAGGGTT GGGAGCTGCGTGGTCCCTGCCAGGGTGTGGGCTGCTGCGGCCTGGCCAGCATCAG CAGCAGTCTGGCCGCCGGTCACTCTGCCCCCTCACCCGCGGCCTCTGCGGCCCAGC AGGGTGACAGCTAA |
| | | | 10658 | |
| | 2 | MRPSWGGLGS* | 10659 | ATGCGCCCTTCCTGGGGAGGTTTGGGTAGTTAG |
| | | | 10660 | |
| | 3 | MSHALPWPGLFALSCGSRPADHCFAATLGTVPSSMRQ M* | 10661 | ATGTCACATGCCCTGCCCTGGCCAGGCTGTTGCACTGTGTGTCCTAGACCT GCTGACCACTGTTTTGCTGCCACTCTGGCACAGTGCCCTTCCATGAGGCAGATG TGA |
| | | | 10662 | |
| | 4 | MPCPGQACLHCRVALDLLTVLLPLWAQCPLP* | 10663 | ATGCCCTGCCCTGGCCAGCCTGTTTGCACTGTGTGTGGCTCTAGACCTGCTGACC ACTGTTTTGCTGCCACTCTGGGCACAGTGCCCTCTTCCATGA |
| | | | 10664 | |
| | 1 | MSTKNFRVSDGDWICPDKK* | 10665 | ATGTCGACCAAGAATTTCCGAGTCAGTGACGGGGACTGGATTTGCCCTGACAAAAA GTGA |
| | | | 10666 | |

Figure 1 (Continued)

| | | | | |
|---|---|---|---|---|
| hsa-mir-186 | 2 | MHFCALRRVEAANRQFPGGKKAPNLLTREVFPGAFVLD MSSAFPRHYLRKVASLFRVRDGLPFCPHPPPPRPGFSD RKPLQSGQLGVGSPPRDFSLQNFTLVHGKYCFLALVLLP LIVHLVLYFYSNFSSLLFSPFPEALPSSVWEILTFSLWESP QELGFSPP* | 10667 | ATGATTTTCTGTGCCTTAAGACGGGTTGAGGCGGCGAACCGCAGTTCCTGGCGGG AAGAAGGCTCCCAATCTCCTACGAGAGAGGTCTTCCGGAGCCTCTCTTGTTCTAGAT ATGTCTTCAGCGTTTCCTGACATTACCTCCGCAAGTAGCCTCCTCTTTTAGAGTGC GAGATGGCCTACCTTTGCCCCACCCCCTCCCCGGCCAGGGTAGCCGCCAGGTTTAGCG ATAGGAAACCTCTCCAGTCAGCCAGCTTGGTGTTGGATCCCCCACGTGACTTTT CTCTGCAGAACTTTACTCTTGTTCACGGAAAATATTGCTTTCTCGCACTGTCCTTT GCCTCTATAGTCGCAGTTCACCTGTTTGTATTTTCCTATTCAGTCATACACGTGACTAA GATCATTTCTCCACAAGAATTGGGCTTTCGCTCCTAG | 10668 |
| | 3 | MAYLFAPTPLPRPGQVLAIGNLSSQASLVLDLPHVTFLC RTLLLFTENIAFSHSSFCLL* | 10669 | ATGGCCTACCTTTTGCCCCACCCCCTCCCCGGCCAGGTTTAGCGATAG GAAACCTCTCCAGTCAGCCAGCTTGGTGTTGGATCCCCCACGTGACTTTTCTCT GCAGAACTTTACTCTTGTTCACGGAAAATATTGCTTCTCGCACTGTCCTTTTGCCT CTTATAG | 10670 |
| | 4 | MPAAEKHVC* | 10671 | ATGCCTGCAGCAGAAGAAGCACGTGTTAG | 10672 |
| hsa-mir-18a | 1 | MYLIAKDFSTLFSYVFFNCKLLGF* | 10673 | ATGTATCTGATAGCTAAGGATTTTCAACTTTATTCTTACGTATTTTCAACTGTA AATTATTGGGCTTTTAA | 10674 |
| | 2 | MDGINCC* | 10675 | ATGGATGGAATTAATTGCTGTAG | 10676 |
| | 3 | MELIAVRRLENSKYRFGRW* | 10677 | ATGGAATTAATTGCTGTAGGAGGTTGGAAAATAGCAAATATAGATTGGACGGTG GTAG | 10678 |
| | 4 | MFYLFPPYFSLFQSYTWT* | 10679 | ATGTTTTATCTTTTTTTTCCTATTTTCCTATTCAGTCATACACGTGACTAA | 10680 |
| hsa-mir-18b | 1 | MVEREGSGFILHPFPPSLPPACLPGLSSSDPACSLVSDL* | 10681 | ATGGTGGAAAGGAGGGGTCCGGCTTCATTTTGCACCCTTCCACCCTCCTTGCC CCGGCTTGCCTTCCAGGGCTTTCCTTCCTCCGACCCAGCGTGCTCACTGGTCTCTGATT TGTAA | 10682 |
| | 2 | MLNSILJVRLKLRHHFILQSAVGLWP* | 10683 | ATGCTTAATTCATTTGATTGTGCGTCTTAAACTAAGACATCATTTTATTCTACAGA GCGCTGTCGGGCTTGGCCTGA | 10684 |
| | 3 | MRGESKHAFYLPHICACIRWLLPLTIPAKKP* | 10685 | ATGAGAGGAGAAAGCAAAGATAATTGCACCGTATCTTCCGCACATTTGCGCGTGTATT CGGTGGCTGCTACCGTTAACGATACCTGCCAAGAAACCCTGA | 10686 |
| | 4 | MCRE* | 10687 | ATGTGCAGAGAGTAA | 10688 |
| | 1 | MGGF* | 10689 | ATGGGCCGGTTCTGA | 10690 |
| | 2 | MWPQGF* | 10691 | ATGTGGCCTCCAGGGCGAGTGA | 10692 |
| | 3 | MGCP* | 10693 | ATGGGGTTGCCCTGA | 10694 |
| hsa-mir-191 | 4 | MGVDVGEPRLVAISGTLGRIGEGGWTQDLWVGLQW* | 10695 | ATGGGTGTAGACGTGGGAGACGCCGAGGCTGGTGGCCATCTCTGGAACCCTGGGGAG GATTGGCGAGGGAGGGTGGACCTCCAGGAGCCTCTGGGTAGGGCTGCAATGGTAG | 10696 |
| | 1 | MGAEGWVFAGEMRVSDQLAYKVPVLGPRIDQRLLPGPR PRPASSRAGVRSGQAASQVHAGEGYVRCARPGCVR* | 10697 | ATGGGAGCTGAAGGCTGGGTCTTTGCGGCGAGATGAGGGTGTCGATCAACTGC CTACAAAGTCCCAGTTCTCGGCCCCCGGACCAGCGTCTTCCTCTCGGGCTCCTCGCC CGGCCGGCTTGCTCGCCGGCTGGCGTGGCTGCCGGCTGCCTCTCAGGTCCA CGCTGGAGAAGGAGGTGTGAGGTGCGCTGCGGCTGCGGTGA | 10698 |
| hsa-mir-193a | 2 | MGQALPLTEACPAVLSRAATLSLGVGRTGPDF* | 10699 | ATGGGCCAAGCCTTGGCGCATTGGCGGAGAACGGGGCCTGACTTCTAG | 10700 |
| | 3 | MDLCGCVPNGRSFVP* | 10701 | ATGGATCTTTGTGCATGTCCGTCTTTTTGTCCAATGCGGTCTTTCTCCTGA | 10702 |
| | 4 | MCSQWPVFCSLTDAT* | 10703 | ATGTGTTCCCAATGCCGGTCTTTTTGTCCCTGACGATGCAACATAA | 10704 |
| | 1 | MEIISPNLGAQQI* | 10705 | ATGGAAATCATTTCCCCAACTTGGGCGCGAGCAAATTTGA | 10706 |
| | 2 | MRDD* | 10707 | ATGAGAGACGATTAA | 10708 |
| hsa-mir-193b | 3 | MGWGELYEAPRTPDLSAAKGRLGHPSCCPGSF* | 10709 | ATGGGGGTGGGGGGAACTGTACGAGGCACCTCGGACACCGATTTATCCGCTGCTAA GGGACGTTTGGGGCACGTTTGTCGGGAAGCTTTTAG | 10710 |

Figure 1 (Continued)

| | | | | |
|---|---|---|---|---|
| | 4 | MVWQMSPPPTATPWHFGEMNRRPEGTPSNDSFSSDPGSPNSCLKGGLPRCCQP* | 10711 | ATGGTGTGGCAAATGTCCCCTCCTCCACAGGACCCCTGGCATTTGGTGAGATGAACCGCGCCCTGAGGGAACACCCAGTAACGATTCCTCAGTGATCCCGGTTCTCCAAACTCTTGCCTCTCCAAAGGCGGCCGGTTGCTGTTGCAGCCGTGA | 10712 |
| hsa-mir-195 | 1 | MRIRLGALPLASGWSH* | 10713 | ATGAGAATTAGACTAGGGCTCTCCTTGGCATCAGGATGGAGTATTATTGA | 10714 |
| | 2 | MEYYLISCGVSVYYGVI* | 10715 | ATGGAGTATATTGATCAGTTGTGGGTCTCGTTTATTATGGGTGTGATTTGA | 10716 |
| | 3 | MVSFRYGADLEVTLVLGVLTPTIWRLCSPVSSWTISRTKVLMLIWGCSLFWGAI* | 10717 | ATGGTAAGTTTCAGGTATGGGGCTGACTTGGAAGTTACATTAGTTCTGGGGTTCTGACACCCACAATTTGGAGATTGTGTCACCTGTGTCATCTTGGACTATCAGCAGAACCAAAGTACTCATGCTGATTTGGGGTGCAGTCTATTTGGGGCATCTAA | 10718 |
| | 4 | MGLTWKLH* | 10719 | ATGGGGCTGACTTGGAAGTTACATTAG | 10720 |
| hsa-mir-196a-2 | 1 | MGVGVWLVCVSSPHSPTHSHTAFCSPCKVKIESIRL* | 10721 | ATGGGGGTGGAGTGGGTGTGGTCGTGGTGTCAAGCCTCACTCACCACCGCACTCACACACGCATTCTGTTCTCATGCAAAGTTAAGATCGAATCCATCCGCTGTAG | 10722 |
| | 2 | MSLPPSRSKNLLEVSYLYCFLLFSHPS* | 10723 | ATGTCTTTACCTCCCAGTCGTCTCAAGAATCGCTGAAGTCTGTATTTGTACTGCTTTCTGCTTTTCTCCACCCCTCTAG | 10724 |
| | 3 | MPPPNIVLSLSGSCVI* | 10725 | ATGCCCCCCCCCAAATATTGTCTGTCCTGTGTCGGGAGTTGTGTTATTTAA | 10726 |
| | 4 | MLYLLHVASLMEKKPNKFPES* | 10727 | ATGTGTATCTTTTGCATGTGAGCTTCCTTAATGAGAAAAAAACCTAATAAATTCCAGAATCATAA | 10728 |
| | 1 | MSSSAHPEAPPQPSAGHAHARKPLPAAPLRRSPELKPRPQRRQRPSSTQPCSQLSTASPAPRQAPPSLSSAPRSRWEPPR* | 10729 | ATGAGCAGCTCCGCAGCCCATCCGAAGCCCCAGCCCTGCCGCCAAGCTCCGCCACCCTCAAGCGGTCGCCGGAGCTTAAGCCCGCCCCAGCGGGGCCAAGCCCAACCTTGCAGCCAGCTTCCACGGCAAGCCCCTCCCAAGCTCTCTAAGCTCGCCCCTCGCTCCAGGTGGGAGCCACCGCACCCCGGTGA | 10730 |
| hsa-mir-199b | 2 | MHASPSLPH* | 10731 | ATGCACGCAAGCCCCTCCTGCCGCACCCTAA | 10732 |
| | 3 | MGVLTVVVLMSPMMLSASFSAWYMRSISSRRCACSSADSSISVFWSPHEYRLASSSEKMNSLVCE* | 10733 | ATGGGTGGTACATGCGCAGCATCTGTCGCCGCTGTCGCCGCTCGCCGCCGCTCAGTGTTCTCGTCCCACACGAGTTGGCCAGCAGGTTGGCCAGCAGTCCGAGAAGATGAACTCCTTGGTCTGTGAGTAG | 10734 |
| | 4 | MPVPPWPPHRALLGL* | 10735 | ATGCCTGTGCCGCCCTGGCCGCCACCGGCCCTGCTGGGACTGTGA | 10736 |
| | 1 | MYLIAKDFSTLFSYVFFNCKLLGF* | 10737 | ATGTATCTGATAGCTAAGGATTTTCAACTTTATTCTACGTATTTTCAACTGTAAATTATTGGGCTTTAA | 10738 |
| hsa-mir-19a | 2 | MIDGNCC* | 10739 | ATGGATGGAATTAATTGCTGTTAG | 10740 |
| | 3 | MELIAVRRLENSKYRFGRW* | 10741 | ATGGAATTAATAGCTGTTAGGAGAGTTGGAAAATAGCAAATAGATTGGACGGTGGTAG | 10742 |
| | 4 | MFYLFPYFSLFQSYTWT* | 10743 | ATGTTTTATCTTTTTTTCCTATTTCCAGTCATACACGTGACCTAA | 10744 |
| | 1 | MYLIAKDFSTLFSYVFFNCKLLGF* | 10745 | ATGTATCTGATAGCTAAGGATTTTCAACTTTATTCTACGTATTTTCAACTGTAAATTATTGGGCTTTAA | 10746 |
| hsa-mir-19b-1 | 2 | MIDGNCC* | 10747 | ATGGATGGAATTAATTGCTGTTAG | 10748 |
| | 3 | MELIAVRRLENSKYRFGRW* | 10749 | ATGGAATTAATAGCTGTTAGGAGGTTGGAAAATAGCAAATAGATTGGACGGTGGTAG | 10750 |
| | 4 | MFYLFPYFSLFQSYTWT* | 10751 | ATGTTTTATCTTTTTTTCCTATTTCCAGTCATACACGTGACCTAA | 10752 |
| | 1 | MVEREGSGFILBPFPPSLPPACLPGLSSSDPACSLVSDL* | 10753 | ATGGTGGAAAGGGAGGGGTCCGGCTTCATTTTGCACCCTTCCTCCTTCCTGCCCCGGCTTGCCTTCCTCCGGAGGGCTCACGTGCTCACGTCTCTGATTTGTTAA | 10754 |
| hsa-mir-19b-2 | 2 | MLNSLIVRLKLRHHFILQSAVGLWP* | 10755 | ATGCTTAATTCCATTTGATTGTGCGTCTTAAACTAAGACATCATTTTATTCTACAGAGCGCTGTCGGGCTTTGA | 10756 |

Figure 1 (Continued)

| | | | | |
|---|---|---|---|---|
| | 3 | MRGESKHAPYLPHCACIRWLLPLTIPAKKP* | 10757 | ATGAGAGGAGAAAGCAAGATAATTGCACCGTATCTTCCGCACATTTGCGCGTGTATT CGGTIGGCTGCTACCGTTAACGATACCTGCCAAGAAACCCTGA | 10758 |
| | 4 | MCRE* | 10759 | ATGTGCAGAGAGTAA | 10760 |
| hsa-mir-200a | 1 | MTMSYPAGGPGRNLWQPPVPGBSDTKCSHCAGPGVE WPHTDQLTPAGRATGPPPWRREASGATRCAPGPLTSL VGGGCRPGPPET* | 10761 | ATGACAATGTCCTACCCAGCAGGAGGACCAGGCCGGAACCTTTGGCAGCCACCAGT TCCTGGAGATTCCGACACCAAGTGCAGCCACTGTGCGGACCGGTGTGGAGTGGC CCACACCGACCAGCTCACGCCAGCTGGCAGAGCCACTGGGCCCCTCCGTGGAGG AGGAGAGAGGCCTCGGGGCCACGGCTGTGCCCAGGGCCACTCACTTCCTTGGT AGGTGGGGGATGCCGGCCTCCGAGACTTGA | 10762 |
| | 2 | MPAWASRDLSPAPALAPRETCASERPRPPLPEPCTRAVR GPCCTPERASALSHSVSNPPPSSGPQNWPSTELRGTRGP WGLGRDWPARGPPAAIPRFIQDESRAVGTT* | 10763 | ATGCCGGCCTGGGCTTCCGAGACTTGAGCCCTCCGCCCTTGCCCTGCACCCGAGAG ACCTGTGCCAGTGAGCGTCCGCACCCAGAGCCCTCGAGCCTGCACCGGGCGTG CGGGGGCCCTGCTGCACCCAGAGCGGGCATCAGCCCTCACGGACTCAGAGGCACCCGA CCTCCCCCAGCTCAGGGCCTCAGAACTGGCCATCCAGGACTGGCCAGCTCAGAGGCACCCGA GGGCCCTGGGGCCTGGTAGGGACTGGCCAGCTGGGGTCTCCAGCAGCCATACC CAGGTTCATCCAGGATGAAAGCAGGGCAGTGGGAACCACGTGA | 10764 |
| | 3 | MKAGQWEPRDWFKSR* | 10765 | ATGAAAGCAGGGCAGTGGGAACCACGTGATTGGTTTAAAAGCAGGTGA | 10766 |
| | 4 | MVAHACNPGTFGGQGRRITRGQEFETSLANTAKPLSLL KIQKLAGHGSAHL* | 10767 | CTGAGGTGGCTCATGCCTGTAATCCTGCACTTTTGGAGGCCAAGGCAGGCGGATCACC TGAGGTCAGGAGTTGAGACTAGCCTGGCCAACACGGCAAAACCCCTGTCTACTA AAAATACAAAAATTAGTGGGCATGGTAGTGCACACCTGTAG | 10768 |
| hsa-mir-200b | 1 | MTMSYPAGGPGRNLWQPPVPGBSDTKCSHCAGPGVE WPHTDQLTPAGRATGPPPWRREASGATRCAPGPLTSL VGGGCRPGPPET* | 10769 | ATGACAATGTCCTACCCAGCAGGAGGACCAGGCCGGAACCTTTGGCAGCCACCAGT TCCTGGAGATTCCGACACCAAGTGCAGCCACTGTGCGGACCGGTGTGGAGTGGC CCACACCGACCAGCTCACGCCAGCTGGCAGAGCCACTGGGCCCCTCCGTGGAGG AGGAGAGAGGCCTCGGGGCCACGGCTGTGCCCAGGGCCACTCACTTCCTTGGT AGGTGGGGGATGCCGGCCTCCGAGACTTGA | 10770 |
| | 2 | MPAWASRDLSPAPALAPRETCASERPRPPLPEPCTRAVR GPCCTPERASALSHSVSNPPPSSGPQNWPSTELRGTRGP WGLGRDWPARGPPAAIPRFIQDESRAVGTT* | 10771 | ATGCCGGCCTGGGCTTCCGAGACTTGAGCCCTCCGCCCTTGCCCTGCACCCGAGAG ACCTGTGCCAGTGAGCGTCCGCACCCAGAGCCCTCGAGCCTGCACCGGGCGTG CGGGGGCCCTGCTGCACCCAGAGCGGGCATCAGCCCTCACGGACTCAGAGGCACCCGA CCTCCCCCAGCTCAGGGCCTCAGAACTGGCCATCCAGGACTGGCCAGCTCAGAGGCACCCGA GGGCCCTGGGGCCTGGTAGGGACTGGCCAGCTGGGGTCTCCAGCAGCCATACC CAGGTTCATCCAGGATGAAAGCAGGGCAGTGGGAACCACGTGA | 10772 |
| | 3 | MKAGQWEPRDWFKSR* | 10773 | ATGAAAGCAGGGCAGTGGGAACCACGTGATTGGTTTAAAAGCAGGTGA | 10774 |
| | 4 | MVAHACNPGTFGGQGRRITRGQEFETSLANTAKPLSLL KIQKLAGHGSAHL* | 10775 | ATGGTGGCTCATGCCTGTAATCCTGCACTTTTGGAGGCCAAGGCAGGCGGATCACC TGAGGTCAGGAGTTGAGACTAGCCTGGCCAACACGGCAAAACCCCTGTCTACTA AAAATACAAAAATTAGTGGGCATGGTAGTGCACACCTGTAG | 10776 |
| hsa-mir-200c | 1 | MLPPGLAHSSVASDPAHSGAAGQRDP* | 10777 | ATGCTGCCCCCAGGACTAGCCCATTCCTCGTGGCCTCAGACCCGCCCACAGCGGA GCTGCAGGCCAGAGAGATCCCTGA | 10778 |
| | 2 | MLVIGL* | 10779 | ATGCTTGTGATCGGTTTGTGA | 10780 |
| | 3 | MPYTPGAL* | 10781 | ATGCCTGTACGCCCGGGGCTCTGTAA | 10782 |
| | 4 | MHAQPLGFGTCAVSAFPGVGASTS* | 10783 | ATGCACGCCCAGCCTCTGGGCTTTGGGACCTGTGTCTCAGCCTTTCCAGGAGTG GGCGCCAGCACTTCCTGA | 10784 |
| hsa-mir-20a | 1 | MYLIAKDFSTLFSYVFFNCKLLGF* | 10785 | ATGTATCTGATAGCTAAGGATTTTCAACTTTATTCTTACGTATTTTCAACTGTA AATTATTGGGCTTTAA | 10786 |
| | 2 | MDGFNCC* | 10787 | ATGGATGGAATTAATTGCTGTAG | 10788 |
| | 3 | MELIAVRRLENSKYRFGRW* | 10789 | ATGGAATTAATTGCTGTTAGGAGGTTGGAAAAATAGCAAATATAGATTTGGACGGTG GTAG | 10790 |
| | 4 | MFYLPFPYFSLFQSYTWT* | 10791 | ATGTTTTATCTTTTTTTCCTTATTTCCTTATTCCAGTCATACGTACACGTGGACCTAA | 10792 |

Figure 1 (Continued)

| | | | | | |
|---|---|---|---|---|---|
| hsa-mir-20b | 1 | MVEREGSGFILHPFPPSLPPACLPGLSSSDPACSLVSDL* | 10793 | ATGGTGGAAAGGGAGGGGTCCGGCTTCATTTGCACCCCTTCCTCCTTCCTTGCCC CCCGGCTTGCCTTCCAGGGCTTCCTCCTCCGACCCAGCGTGCTCACTGTCTCTGATT TGTAA | 10794 |
| | 2 | MLNSILIVRLKLRHHPFLQSAVGLWP* | 10795 | ATGCTTAATTCCATTTTGATTGTGCGTCTTAAACTAAGACATCATTTTATTCTACAGA GCGCTGTCGGGCTTTGGCCTTGA | 10796 |
| | 3 | MRGESKRAPYLPHCACIRWLLPLTIPAKKP* | 10797 | ATGAGAGGAGAAAGCAAGATAAATTGCACCGTATCTTCCGCACATTTGCGCGTGTATT CGGTGGCTGCTACCGTTAACGATACCTGCCAAGAAACCCTGA | 10798 |
| | 4 | MCRE* | 10799 | ATGTGCAGAGAGTAA | 10800 |
| hsa-mir-21 | 1 | MLVGEILVFKGLLDGVNFLFHFFF* | 10801 | ATGTTGGTGGAGAGATTTGGTTTTTAAGGGGTTGTTAGATGGAGTAAATTTCTT TTTTTTTTTTTTTTAA | 10802 |
| | 2 | MCLFLWATVPCFQCCPRHRSISAEAISGVPGGSTAEASP QKRNGHITGKTLIRPLLPSGKFRAEITFTALTHHPRQISEV GLPVFLLDRS* | 10803 | ATGTGCCTCTTCTTTCTGTGGGCTACTGTACCCGTGCTTCCAGTGCTGTCCCGCGCATAGGT CCATCTCTGCAGAAGCATTTCAGGAGTACCTGAGGCTCAACGGCCAGAAGCTTCAC CACAAAAGCGAAATGGCACACCACCACAGGTACACCACCAGGTAAGACTTTAATCCGGTTTCTTCTCCCCT CTGGGAAGTTCCGGCTGAAATTACAATTCACAGCTCTCACTCACATTTTTAGGCAAA TAAGTGAAGTTGGTTTGCCAGTGTTCCTTGACAGAAGTTGA | 10804 |
| | 3 | MGTPQVRL* | 10805 | ATGGCACCACCAGGTAAGACTTTAA | 10806 |
| | 4 | MLYWEICLCLRLESVTSVHLLLKTRVEPMESMQSVT* | 10807 | ATGCTCTACTGGGAAATTGTCTTGTCTTAGACTAGAAAGTGTAACTTCTGTACATC TTCTCCTAAAACAAGGTAGAGCCAATGGAAAGTAATGTTCTGTTACATAG | 10808 |
| | 1 | MDGVCLSGQQGRRVGVSEIIRGLCCPPLGGAEAGPDTL LEGTTFFSLCVQGTSVRSSCCQAEGGPGQAQVWSYLQPT GPSSGGPPLGTSYGKRVTDLVLLCVSAASVGPLRETAG GSSSSLSAEPAFSSLLLKSGPGRVAYRPCLRSPGHLQELR AAPARWRGRGRFSGRLAWTRTGLWKLPALTGLPVTTA K* | 10809 | ATGGACGGGGTGTGCCTGTCTGGCCAGCAGGGACGGCGGGTTGGGGGTAAGGAAAT CATTCGGGGCTTTGCTGCCCCCTGCTTGGTGGCGCTGAGGCTGGGCCCAGATACCCT CTTGGAGGGAACTTCTTTTTCTCTGTGTCAGGTACCAGTGTGCGAGTTCCTG TGCCAAGCTGAAGGTGGCCCTGGGCAGCCACCTCTGGGAACTCTCCGGGAGCTGGTTC AGGTGGTCATATCTTCAGCAAGC AGGACCATCTCCGAGGGACCTCTGGGACTTCTGCCGTTCAGTCCTCAGAGAGTGACAG ATTTGGTCTTCTCTGTGTTCTCGCCGTTCGAGCCTGCTGTGAGGCTTCAAGTCTACTGTAAAT GTGGATCTCCAGCAGCCTGTCTGCAGCCTACAGGCCCCTCAAGTCTACTGTAAAT CAGGACCGGGTCGTGTCACCTGGCTCTGCGAGCCTGGAGAGAGGACAGATTTAGTGAGCGCTG GCATGACTCGGACTGCCTTTGAAGCTCCCTGCCTTGAAGCTCCCTGGCGGGTTGCCTGTCACC ACTGCGAAGTGA | 10810 |
| | 2 | MDSDWPLEAPCPDGVACHHCEVRLGRTCT* | 10811 | ATGGACTCGGACTGGCCTTTGAAGCTCCCTGCCTTGAAGCTCCTGTGACGGGTTGCCTGTCACCAAC TGCGAAGTGAGGCTTGGCAGGACCTGCACCTGA | 10812 |
| | 3 | MSRNSGRGGSQRRPSIQPGSALCPYLHQVGSLPCIAWGL AGLGPALLWNWMFSGSPAFFHVNTVHNIVFKVQFKTQ K* | 10813 | ATGAGTAGGAACTCTGGCCGTACTTACACCAGGTCCAGCAGGGATCCCAGCGCCCTGTGTCCCCTCGATACAGCTGG CTCTGCTGGCCTGGCCGTACTTACACCAGGTCCAGCAGGGATCCCAGCGCCCTGTGTCCCGATACAGCTGG ATTGGCTGGGCTTGGCCCGCCACCTGCTTGTGGAACTGGATGTTTTCAGGGAGCCAGC CTTTCCTCATGTCAACACACAGTTCACAATATAGTTTCAAAGTACAGTTTAAAACTCAA AAGTAA | 10814 |
| | 4 | MSTQFTI* | 10815 | ATGTCAACACAGTTCACAATATAG | 10816 |
| hsa-mir-210 | 1 | MGGIRGGGQD* | 10817 | ATGGGGGGGATTAGGGAGGGGCAGGATTAG | 10818 |
| | 2 | MNQPMKGAGESRREGAGKIRRRKGRGVCANRLWRPHK DWPRTEGEDREVGGNWGGGRGHPLLPCPRDRPPPGSR GAGGGCACCCACTGCTTCAGGGACAGCAGCAAGATGCCATCACTCAGGGTCTCTAAC SPSPGASARAGTRCPSGSLTAPHPLALYPSHSLHSSMGIA LPLLFPPHPLRLL* | 10819 | ATGAACCAGCCGATGAAGGGGCTGGAGAAGGAGCAGGAGGGAGGAGGAGGCTGGAAAGA GGAGGAGGAAGGCGACTGAAGGGTCGGCGCCCACATAAGGAC TGGCCACGGACTGAAGGAGGGACACCAGGAAAGTAGGGGGGAACTGGGTGGCGGGC GAGGGCACCCACTGCTTCAGGGACAGCAAGATGCCATCACTCAGGGTCTCTAAC CCAAGTGCGGGAGCCTCAGCTGGGCGGGGGACAAGATCCATCATTCCTACACTCCTAC TGCCCCCACCCACTGCCCTCGCGCTGACCCGTCCCGATCCCTCCTCATTCCTACACTCCTAC CTGCCCTCTTCTCTTTCCTCCCCATCCCCTTGTTTACTCTAG | 10820 |

Figure 1 (Continued)

| | | | | | |
|---|---|---|---|---|---|
| hsa-mir-219-1 | 3 | MPIRVSNCPPPPRPVSLSFPTLNGDRSAPSSSLSSPSPSFT LESSKRLLPTSHSRHSAPVYPTHTRTPPSQWELHLVYVP VSAWCLHSPFPPVRLPPFPAPGRGS* | 10821 | ATGCCCATCAGGGTCTCTTAACTGCCCCCCACCCTCGCCCTGTATCCTCATTCC CTACACTCTCAGAGTCCTGAAGAGGCTTCTGCCACTCCCACTCCAGACATTCTGCC GTTTACTCTAGAGTCCTGAAGAGGGCTTCTGCCACTCCCACTCCAGACATTCTGCC CTGTTACCCCACCACACTGCACCGCACCCGCACCCCCCCTTCCCAATGGAGCTCCATCTGTG TATGTCCCGTTTCCGCGTGTGTCTCCAATTCCTCCCGTGCCGCTCCTA CCTTCCCGCCGCCCGGGCCGCGGCTCCTGA | 10822 |
| | 4 | MGAFSCVCPCFRVVSPFFLSSRAPPSLPRPGPRLLIVQTQ FSSLWLRPRVESGRPEHPPPPNLRESGSEGLGRAKAEGG GSPQGGKGNPGHGT* | 10823 | ATGGGAGCTCCATCTTGTGTATGTCCTGTTTCGCGTGTGTCTCCATTCCCCTTT CCTCCCGTGCCTCCCTCCCGCGCCCCGGCCGCCGCTCCTGATTGTCCAAA CGCAATTCTCGAGTCTATGGCTCCGCGGCCGAGAGTTGAGTCTGGACGTCCGAGCCGC CGCCCCAAACCTCGAGGCGAGTCGGGTCGGAGGGCTCAGGGAGAGCCAAAGCA GAGGGTGAGGGGAGTCCCCAGGGTGGTAAGGGGAATCCCGGGCACATCGGGACCTA G | 10824 |
| | 1 | MEGESGVRAATPSPSGRRRGGGGRGASGRGAWTGRVS VSGATRKESGTGVVAEGLAEWRGACGEPRGRRAGGGS PGGPRSEDTGAGHLAWGUSGPPERAARRCFASAGVHW VRASSAPWQGBRGRWAGRPLLSFSPGDVM* | 10825 | ATGGAGGGTGAAAGTGGGGTCCGGGCGGCACACCAGCCTTCCGGGAGGAGAAG GGGCGGCGGGCGTCGCGGAGGACAGGGCGCTGGACCTGGCGGAGTTAGT GTGTCAGGAGGTACGAGAAAGAGTCTGGACGGAGAGGGCCTGGACTGGCGAAAGGCTGG CGGAGTGCGGCGGGCGCGGGAGAGCCGAGGGGCCGAGGGCGCGGAGGCGGCTC AACCCGGCGGCCCCGGTCTGAGGATACAGGGCGCGGCCATCTAGCCTGGGAGGGT CTGGACCCCGAGCGGTGGCGGCAGGGAGGGGAGTGCTTTGCCTCTGCCGGTTCACTGG GTCAGGGCAGTTCAGCGCCCTGGCAGGAAGGGGTCGCAGGGAAGGGTCGCGGCCCGGCCCCT CCCTCTCGTTCTCTCCAGGGGATGTTATGTAA | 10826 |
| | 2 | MLCKGGGERSRGRRCRGLMQPKG* | 10827 | ATGTTATGTAAGGGGAGGGGAGAGCGTAGGGGGCGGCGGTGCCGGGGCTTA TGCAACCCAAAGGTTAG | 10828 |
| | 3 | MASGEAVTPTSLRPWFQPPTTPLACHPGCQIGHGAVRVP EG* | 10829 | ATGGCCTCCTTTGGCCTGTCATCCTGGCCTGTTCAGTTCCAGCCTGTTCAGCCTCA ACTCCTTTGGCCTGTCATCCGGCTGTCAGATTGGGCTAGGAGCTGTCAGAGTGCCA GAGGGTTGA | 10830 |
| | 4 | MEQLVRGSVFWAHPALOPRAPAWHRLSAAAESSGLNR AISDRGRSDGVGLVTQGKEDTQSSCLPRGFRNLNRTFY PPIFLTL* | 10831 | ATGGAGCAGCTGGTCAGAGGGTCAGTGCCCTGGGCCCACCCCGCCTGCAGCCAAG GGCACCTGCTGCTTGGACACAGGAAGCGTCGAGCAGCTGGAGTTGGACCTCTGGGTTGAACAGAGC TATCTTCAGACAGAGGAAGGTCGGACGGAGTTGGACTGGTCACCAGGGAAGGAAG ATACACAAAGTTCATGCTCCAAGAGGGTTTCGGAATTTGAACCGCACCCGTATC CCCAATCTTCTTACCCTCTGA | 10832 |
| | 1 | MWKIS* | 10833 | ATGTGGAAAATTCATGA | 10834 |
| | 2 | MSLDICKHL* | 10835 | ATGAGTTTGGATATATGCAAACACCTGTGA | 10836 |
| | 3 | MQTPVIPSH* | 10837 | ATGCAAACACCTGTGATACCATCACCATAA | 10838 |
| | 4 | MDVFNISQSFIVSLWPCVCVCVYVKNHLT* | 10839 | ATGGATGTATTCAACATCTCAAAGTTCATTGTATCCCTTGGTTTTGTGTCTGTG TTTGTGTATATGTTAAGAATCACTTAACATGA | 10840 |
| hsa-mir-221 | 1 | MWKIS* | 10841 | ATGTGGAAAATTCATGA | 10842 |
| | 2 | MSLDICKHL* | 10843 | ATGAGTTTGGATATATGCAAACACCTGTGA | 10844 |
| | 3 | MQTPVIPSP* | 10845 | ATGCAAACACCTGTGATACCATCACCATAA | 10846 |
| hsa-mir-222 | 4 | MDVFNISQSFIVSLWFCVCVCVYVKNHLT* | 10847 | ATGGATGTATTCAACATCTCAAAGTTCATTGTATCCCTTTGGTTTTGTGTCTGTG TTTGTGTATATGTTAAGAATCACTTAACATGA | 10848 |
| | 1 | MANGWTGSRPGRRNPEL* | 10849 | ATGGCCAATGGCTGGACTGGCTCCCGCCCTGGTCGGAGGAATCCGGAGCTGA | 10850 |
| | 2 | MAGLAPALGGGIPSCEAAGIRAHYLLCLLRAEAMAGAG VGCGGGVRWRRSR* | 10851 | ATGGCTGGACTGGCTCCCGCCCTGGGCGGAGGAATCCCGAGCTGTGAAGGCTGG AATCCGGGCACAGGCCCATGTGCTTCTTGTTTACTAAGAGCGGAAGCGGATGCGGGGAGCGG GGGTGGGGTGCGGTGCGGGTGCGGTGGCGGAGGTTCCGGTGA | 10852 |
| hsa-mir-25 | 3 | MCFFVY* | 10853 | ATGTGCTTCTTGTTTACTAA | 10854 |

Figure 1 (Continued)

| | | | | | |
|---|---|---|---|---|---|
| | 4 | MLDGPVHCHGLFILRWLETDL* | 10855 | ATGTTGGATGGCCTGTGCACTGCCACGGGCTCTTTATTCTCGGTTAGAAACAGACTTGTGA | 10856 |
| hsa-mir-301a | 1 | MEAEVDKLELMVSAK* | 10857 | ATGGAGGCGGAGGTCGATAAGCTGGAACTGATGGTGAGTGCAAAGTGA | 10858 |
| | 2 | MASEVGRNLESPETPGGGGWTRVEFPPPAPKGAAATVWCLNRLG* | 10859 | ATGGCCTCGGAGGTGGGGCACAATTTGGAGTCGCCGGAAACTCCGGGCGGTCGGAGGCTGACCCAGAGTGGAGTTCCTCCTCGCACCAAAGGGAGCCGCCACCGTCTGGTGTCTAAACCGCCTCGGGTAA | 10860 |
| | 3 | MAGIDAEGAGPLEFLVPCPHLYTPYETAPGADRILCLYQKRCEWNGP* | 10861 | ATGGCGGGAGAGATGCTGAGGGTGCGGGGCTTTGGAATTCCTTGTTCCTTGCCCTCACCTTTACACCCCTACGAAACTGCGCCGGTGCCAGGGTGCAGACCGCATTCTGTGTTTGTACCAAAAAGATGTTGAATGGAACGTCCTAA | 10862 |
| | 4 | MLRVRGLWNSLFLALTPTPLTKLRRVQTAPCVCTKKDVNGTVPKRPKKGEVVHTPRKGNGGWGGE* | 10863 | ATGCTGAGGGTGCGGGGCTTTGGAATTCCTGTTCCTGCCCTCACCTTTACACCCCTTACGAAACTGCGCCGGTGCCAGACCGCATTCTGTGTTGTACCAAAAAGATGTGAATGGAACGGTCCCTAAGCGTCCAAGAAGGGAGGAGGTGGTTCACTGCTCCAAGAAAGGGGAACGTGAGGGTGGGGTGGGGAATAA | 10864 |
| hsa-mir-30a | 1 | MGFQSDVCSCLLPRTSRGYFRSNYLVY* | 10865 | ATGGGCTTTCAGTCGGATGTTTGCAGCTGCCTACTGCCTCGGACTTCAAGGGGCTACTTAAGGAGCAATTATCTGTTTACTAA | 10866 |
| | 2 | MFAAAYCLGLQGATLGAIILFTKTEYLAISLIHFYKAELKWYKLNHFPKTMSVHF* | 10867 | ATGTTTGCAGCTGCCTACTGCCTCGGACTTCAAGGGGCTACTTTAGGAGCAATTATCTTGTTTTACTAAACTGAATACCTCTGATCTCTATCTTTTGTATACATTTTACACTTTAAACAAAGCTGAATTAAAATGGTATAAATTAAATCACTTTAAACCATGTCTGTACATTTTAG | 10868 |
| | 3 | MHRICNRKKKVFVREMRKCVTVFLFFLKA* | 10869 | ATGCATAGAAATTGCAATATCAAAAGAAATATTCGTAAGAAATGAGGAATGA | 10870 |
| | 4 | MCYSIFIFFKSVYGQYFPEKSMK* | 10871 | ATGTGTTACAGTATTATTTTTTAAAGGTAGTAGGGCAATATTTCCCAGAAAAATCTATGAAGTGA | 10872 |
| hsa-mir-30c-2 | 1 | MQSRNFSPYT* | 10873 | ATGCAATCTAGAAATTTCAGTTTCTCGTCCTATACTTAA | 10874 |
| | 2 | MCVQHFSPSS* | 10875 | ATGTGTGTGCAACATTTTCTCCGTCTCTTAG | 10876 |
| | 3 | MGMHVFLY* | 10877 | ATGGGATGCATGGTCTTTTATATTAA | 10878 |
| | 4 | MSFYINIFPKYFQIVAFRFIASSLKYSCPESSCIVSIFCVSPQI* | 10879 | ATGTCTTTTATATTAAATATTTTCCTAAGTATTTGCGTTTCAGATTGTTGCTTTCAGATTATTGCTTCCTCCTTAAAAATATAGCTGCCCTGAAAGCAGCTGTATTGATCTATTTTTGTGTTTCCCACAGATCTGA | 10880 |
| | 1 | MKGSPQKKMWSLNFHPLNVLLKGN* | 10881 | ATGAAAGGTAGTCCTCAGAAGAAAAAATGTGGTCTCTTAACTCATACCAATCTTAATGTTTTGCTTAAGGGGAATTAG | 10882 |
| hsa-mir-30e-2 | 2 | MFCLRGISEEJTVSGRLKTVILLNKYCSFNLSSHARNVEVIFFHTCTVRPGILKSFKYK* | 10883 | ATGTTTTGCTTAAGGGGAATTAGTAGTGAGGAAATAACAGTCTCAGGAAGGTTGAAACTGTTGATTTTACTCCAACAAATATTGCTCTTTAATCTCTCCAGCCATGCCAGAAACTATGAAGTTATTTTCTTACACACTGCTACACTGTAAGACCTGGTATTTTAAAAAGCTTTAAATATAAGTAG | 10884 |
| | 3 | MPEIMKLFSFTHAL* | 10885 | ATGCCAGAAACTATGAAGTTATTTTCTTTCACACATGCACTGAA | 10886 |
| | 4 | MHCKTWYFKKL* | 10887 | ATGCACTGTAAGACCTGGTATTTTAAAAAGCTTTAA | 10888 |
| hsa-mir-30d | 1 | MQSRNFSPYT* | 10889 | ATGCAATCTAGAAATTTCAGTTCCTATACTTAA | 10890 |
| | 2 | MCVQHFSPSS* | 10891 | ATGTGTGTGCAACATTTTCTCCGTCTCTTAG | 10892 |
| | 3 | MGMHVFLY* | 10893 | ATGGGTATGCATGTCTTTTTATATTAA | 10894 |
| | 4 | MSFYINIFPKYFQIVAFRFIASSLKYSCPESSCIVSIFCVSPQI* | 10895 | ATGTCTTTTATATTAATATTTTCCTAAGTATTTTCAGATTGTTGCTTTCAGATTATTGCTTCCTCCTTAAAAATATAGCTGCCCTGAAAGCAGCTGTATTGATCTATTTTTGTGTTTCCCACAGATCTGA | 10896 |
| hsa-mir-320 | 1 | MLRRSGVLASGRWRGGAKIRVPGFVGRHAAM* | 10897 | ATGCTGCGCGCGGTCGCGGGGGTCTTGGCCTCTGGACGCTGGCGTGGCGTGGAGGCGCCAAGATCAGGGTCCCGGGTTTTGTCGGCGCCACCACGCGCAATGTGA | 10898 |
| | 2 | MGRGARRGAESESEWT* | 10899 | ATGGGACGCGAGCGGCGCGGCGCGGCGGAGAGTGAGAGCGAATGTGA | 10900 |

Figure 1 (Continued)

| | | | | | |
|---|---|---|---|---|---|
| hsa-mir-326 | 3 | MVTLEWSLPPGSDLAHFRGPLPCAPGGVLG* | 10901 | ATGGTGACCTTGGAGTGGTCATTACCTCCGGGCAGGCAGCGACCTCGCCACTTTCGGGGA CCCTTCCCTGTCGTCTCTGGTGGAGTCCTGGGGTGA | 10902 |
| | 4 | MLSPIPQTV* | 10903 | ATGTTATCCCCATCCCCAGACCGTATAA | 10904 |
| | 1 | MGDKGTR* | 10905 | ATGGGCGACAAAGGGACCCGGTGA | 10906 |
| | 2 | MWAAAPGPDTQLADTQHWPAAAETHGGRLTHNTRTG FLTRGTGMLAHTLATASTRSSHAVARRHTRLGQHILAD SLVGMHRSSQSNTHQF* | 10907 | ATGTGGGCCGCAGCCCCGGGACCCGACACAGTCTGCTGACACCCAGATTGGCC GGCAGCCGAGAGCCACGCAGGCAGTTGACACAGCAGGTTCACACATACGACGGGCACAC TAACCCGTGGCACGCAGCATGTGGGCACACAGTCTGGCAACGCTAGCACACGCTCAT CACACGCAGTTGGACGCCGTCATACAGGGCCCGGTCAACATTCTTGCTGACAGCC TTGTTGCCATCAGCAGTCACACAGCTCAACATCCAACACACACCAATTCTAG | 10908 |
| | 3 | MSHQHSGAQGHTNTDPHRHNQTDALKDWHPTGTSC* | 10909 | ATGTCTCACCAACACAGCGGAGCGCAAGCCACACTGACCCCACAGACA CAATCAGAGTGATGCCTCAAAGACTGGCACCCACAGGCAGGACGAGTCGTAG | 10910 |
| | 4 | MPSKTGTPQARAASPRPADTHASGPTWPEVETHTSHRV ERPPPPAWGKQIAFHPNRSHPSTLFPFPLTS* | 10911 | ATGCCCTCAAAGACTGGCACCCCACAGGCACGAGCTGCTAGCCCAAGGCCGTGA CACACACGCTTCAGGCCCCACATGGCCAGAAGTGGAAACACACACATCACACAGGG TAGAGCGCCCCCGCCACCCGCCAGCTGGCCTTCCCTTCCCTGTGACCTCCTGA GATCCCATCCATCTACTCGTTCCCTTTCCCTGTGACCTCCTGA | 10912 |
| hsa-mir-330 | 1 | MSSFGAG* | 10913 | ATGAGTAGCTTTGGAGCTGGGTGA | 10914 |
| | 2 | MVSPLF* | 10915 | ATGGTTTCTCCCTTTTCTGA | 10916 |
| | 3 | MGKGSYEACLLG* | 10917 | ATGGGGAAGGGCTCGTTGAAGCTTGCTTGTTGGGGTGA | 10918 |
| | 4 | MGLVSVFDLWGCPGRGWLRENVPEGGPPCAHDDPRRAG THLQPGHTLGAAFLPAQAGVGVSFCWNLLGAPIPPGGN RKAVKAAQACNLSTLGGSSPEAKSLRPAWATHKTSTARS RAMWPEWDWCI* | 10919 | ATGGGACTGGTGTCAGTGCCTGGACCTCTGGGGTGTTCTGGCAGGATGGCTCCG TGAAAATGTTCCTGAGGGCGCCCCATGAGATCCCAGACGAGTCGGCAC CCACCTACAGCCTGGACACACGTCGGACTGCTCTTCCTGCGGTCAAGCTGGAGT GGGTGTATCCTTTGCTGGAAATCTCTTGGTGCTCCCATCCCCAGGAGGAAATAG AAAGGCGGTCAAGGCAGCTCAAGGCGTAATCTCAGCACTTGGAGGATCGTTTG AGGCCAAGAGTTTGAGACCTGCTGCTGGACCAACACACAAAACAAGCACAGCAGTTCA AGGGCTATGTGGGCCAGAGTGGGATTGGTGCATTGA | 10920 |
| | 1 | MPGWHLQLRGFSGKQRPLLSRDPGS* | 10921 | ATGCCCGGATGGATCCTGCAGCTCCGCAGCTTTTCTGGAAGCAGCGGCCCCTGCTC TCAAGAGACCCTGGCTCCTGA | 10922 |
| | 2 | MDPAAPWLFWEAAAPALKRPWLLMVAPRLPAGARDSG QFPRKGQAGSPSRGRVRKLGGAEATLGP* | 10923 | ATGGATCCTGCAGCCTCCTGGCTTTCTGGAAGCAGCAGCGGCCCCTGCTCTCAAGAGA CCCTGGCTCCTGATGGTGGCCAAGCGGCCTGGTTGCCAGTGGTTGCTAGGACTCAGGACA GTTTCCCAGAAAAGCCAAGCAGCCAGCCCTCCAGGGCCCGGGTGCTAGGGACTCAGGACA GGGGTGCGGAGGCCACACTGGGTCCTGA | 10924 |
| hsa-mir-338 | 3 | MAFP* | 10925 | ATGGCCTTCCCCTGA | 10926 |
| | 4 | MSGRGTLGGEVSCPGGRRGAGGRRVRPGSRGRWRRSSR G* | 10927 | ATGAGTGGACGGGGCACAGGAGGAGAAGTGTCCTGCCCTGGGGGCCCGCGTGGGC GGGTGGGAGAAGAGTAAGGCCCGGAGCCGGTGGAGGCGGAGCAGCCGT GGGTGA | 10928 |
| | 1 | MGGALPGPRPAATGGRSRGRPWRPDAAAAGPAPPCRPR AGRAALLGAPLRAGPRAGGPGRSRALLPLTLLGAQGRAA GGRVYGVQALQALRALERPRNRPGSPALWGRTGPPAAM QQPPGETRALRTLGGLESSAAA* | 10929 | ATGGGAGGGCCCTGCCCAGCCCGTCCCGAGGGACCAGGTGGCGCTCCGTGG GAGCCGAGAGCCGGCTGCTGGGAAACCCTCCGGCCTGCCGCCGTCCCGAGCAGCCCT CCGGCGAGCCGTTCGGCGGCCTGGGGAGCTGGCCTGCGCCGTCCTCGGGGGCCG GGTGCACGGTTGGGGTTCGGCGGCCACCGGCGACGGCGCCCGAGCGCCG CAACCGCAGCCCAGGCTCCCCGCTCGTGTGGGGGCGGCCGAACCGGACCCTGAAGCGCCAAGGACGCAG AGCAGCCCCCGGGAGGGAGACACCGAGCTGTCTGAGGAGACCTGGAGTCGTCG GCCGCCGCGCGCTGA | 10930 |

Figure 1 (Continued)

| | | | | | |
|---|---|---|---|---|---|
| hsa-mir-339 | | MMKTIGHASLGSLPEDGGAGRQLLQEALPLLRRGSAGP GLESAEVLGVGLLSSEEAVARAGGGPVLVLRCVLGASS AAARTACGRGPGVRIDTRTGLPSLLLGLTAAETAGMV TVASESFAYE* | 10931 | ATGATGAAAACAATTGGGATAGCTTCACTCGGAGCCTTCCTGAGGACGGCGAGC AGGCCGGCAGCTCCTTGAAGAGGCTCTGCTGGCTGCCGCTTGGGGTCAGCCGGTT TGGGTTGGAGAGCGCAGAGGTGCTTGGAGTGGTTGGTGGGTCTTTATCTCTGAGGAGGCGG TGGCCCCGGGCAGGTTGCGGCGCGCCCCGTGCTGGTCCGTGTCCGCGCTCCTCGAGCGTCCT CAGCTGCTGCGGCACAGCCCTGTCTGGGGGGCCGTTGAACCAGGCGTCCGCAGGACACGCGA ACCGGGCTGCGCTGCTGCTGCGGGCCTGCTGCGGGCCTGCAAGAGACGGCGGGAATGGT GACCGTTGCTTCAGAGTCCTTTGCTTATGAGTAA | 10932 |
| | 3 | MSNSPN* | 10933 | ATGAGTAACTCACCGAATTGA | 10934 |
| | 4 | MNSLCSLRSCGKVRKPNPYLVPRCECFKLCVTTNKIDM MIHFTDI* | 10935 | ATGAATTCGTTGTGTCACTGAGGAGTTGTGGCAAAGTGAGAAAACTAACCGTAC TTAGTTCCAGATGTGAGTGTTTAAACTATGTGTAACACTATGTAACAATTGACATG ATGATACACTTCACGGACATTTAA | 10936 |
| hsa-mir-33b | 1 | MPPSPAGSPGVGGHAGYAT* | 10937 | ATGCCTCCGTCTCCTGCAGGTTCTCCTGGAGGTGGGCAGGCATGCGGGCTACGCAACTTGA | 10938 |
| | 2 | MRATQLEQERAPSRGRRCDSYQLAGEVEGYLQPN* | 10939 | ATGCGGGCTACGCAACTTGAGCAGGAAAGAGGCCCCTCCGAGGGAGAAGGTGTGA CAGTTACCAGTCGTCGGGGAGAAGTGGAGGGCTACCTCCAACCAAATTAG | 10940 |
| | 3 | MGNPAVESPL* | 10941 | ATGGGAAACCCTGCAGTTGAAAGTCCATTATGA | 10942 |
| | 4 | MTCDLGGPQTRRVST* | 10943 | ATGACTTGTGACCTGGCGGGTCCACAACCAGGAGAGTTTCTACTTGA | 10944 |
| | 1 | MGCGDE* | 10945 | ATGGGCTGCGGGGATGAATGA | 10946 |
| | 2 | MNESRV* | 10947 | ATGAATGAGAGCCGAGTCTGA | 10948 |
| hsa-mir-345 | 3 | MRAESDSAPQESLTFAVARDCPGPCGASHSVTSHQPPPS ASGGPDCQVGAWEQGRARRLFAVGVRSALGRAQLPS LGPAGRQGHTVCHVSRFRVTWFFYPNSSGYLPPGGAGR KVLCIWY* | 10949 | ATGAGAGCCGAGTCTGACTCGGCCCCCCAGGAGTCCCTGACATTCGCAGTGCAAG GACTGCCCTGGTCCTGTGGAGCGTCCATTCGGTAGCCTGGAGCCTGGAGCAGGGACGGGCCA CAGCGCCTGGAGGTCAGATGTCAGATGCAGATGAGTCCCGGCCCGGCCCAGCTTCCTT GGGCCTTTAGGGCTGCAGGCAGGCAAGGCCACGTGTGCCAGTTCCAGTTAGG CTTAGGGCTGCAGGCAGGCAAGGCCACGTGTGCCAGTTCCAGTTTAGG TCACATGGTTCTGTCTTTATCCAAATTCCAGTGGGTACCTACCTCTGGAGGTCAGGTC GAAAGGTTCTGTATTTGGTACTAG | 10950 |
| | 4 | MVLLSKFQWVPTSWRCRSKGSVYLVLGHTGRCCQ* | 10951 | ATGGTTCTTTTATCCAAATTCCAGTGGGTACCTACCTCTGGAGGTGCAGGTCGAAA GGTTCTGTGTATTTGGTACTAGGACACACAGGTAGGTGTGCACTGTGTCAGTAG | 10952 |
| hsa-mir-363 | 1 | MVEREGSGFHLHPPPPSLPPACLPGLSSSDPACSLVSDL* | 10953 | ATGGTGGAGCGGGGGTCGGGCTTCCATTTGCACCCGCCTCCCTCCTCTGCCTC CCCGGCTTCCTCCAGGGCTTCCTGCCGACCCAGTGGTGCTCACTGGTCTCTGATT TGTAA | 10954 |
| | 2 | MLNSILIVRLKLRHHFILQSAVGLWP* | 10955 | ATGCTTAATTCATTTGATTGTGCGTCTTAAACTAAGACATCATTTATTCTACAGA GCGCTGTCGGGCTTTGGCTTGA | 10956 |
| | 3 | MRGESKHAPYLPHCACIRWLLPLTIPAKKP* | 10957 | ATGAGAGGAGAAAGCAAAGATAATTGCACCGTATCTTCCGCACATTTGCGCGTATT CGGTGCTGCTACCGTTAACGATACCTGCCAAGAAACCCTGA | 10958 |
| | 4 | MCRE* | 10959 | ATGTGCAAGAGAGTAA | 10960 |
| | 1 | MEIISPNLGAQQI* | 10961 | ATGGAAATCATTCCCCAACTTGGGGCGCAGCAAATTGA | 10962 |
| | 2 | MRDD* | 10963 | ATGAGAGACGATTAA | 10964 |
| hsa-mir-365-1 | 3 | MGWGELYEAPRTPELSAAKGRLGHPSCCPGSF* | 10965 | ATGGGGTGGGGGAACTGTACGAGGCACCTGGACACCCGATTTATCCGCTAA GGGACGTTTGGGGCACCCCTCGGTGTCGGGAAGCTTTAG | 10966 |
| | 4 | MVWQMSPPTATPWHFGEMNRRPEGTPSNDSFSDPGSP NSCLKGGLPRCCQP* | 10967 | ATGGTGTGGCAAATGTCCCCTCCCACAGCGACCCCTGGCATTTGGTGAGATG AACCGCCGCCCTGAGGGAACACCAGTAACGATTCTTCAGTGATCCGGTTCTCCA AACTCTTGCCTCAAAGCGGCCTGCCCGTCGTGTCAGCCGTGA | 10968 |

Figure 1 (Continued)

| | | | | | |
|---|---|---|---|---|---|
| hsa-mir-365-2 | 1 | MGARGWVFAGEMRVSDQLAYKVPVLGPRDQRLLPGPRPRPASSRAGVRSGQAASQVHAGEGVVRCARPGCVR* | 10969 | ATGGGAGCTGAGGCTGGGTCTTTGCGGCGAGGGCGAGATAGGGTGTCGGATCAACTGGCCTACAAAGTCCCAGTTCTCGGCCCCGGGACCAGGGTCTTCTCCGGTCCTCGCCCCAGGCCGGCTTCCTCCCCGGGCTGGCGTCCGGCCAGGGTGCCTCTCAGGTCCACGCTGGAGAAGGAGGTGTGAGGTGCGCTCGCCCGGCTGCGTGCGGTGA | 10970 |
| | 2 | MGQALPLTEACPAVLSRAATLSLGVGRTGPDF* | 10971 | ACCTTGAGCTTGGGGGTGGGGAGCTTACCTGCACTTACCGAGGCCTGCCTGCCTGCTGCTGTGCTTTCCAGGGCGGTAACCTTGACTTCTAG | 10972 |
| | 3 | MDLCGCVPNGRSFVP* | 10973 | ATGGATCTTTGTGGATGTGTTCCAATGGCCGTCTTTGTTCCTGA | 10974 |
| | 4 | MCSQWPVFCSLTDAT* | 10975 | ATGTGTTCCCAATGCGGTCTTTGTTCCCTGACCGATGCAACATAA | 10976 |
| hsa-mir-371 | 1 | MMTCALVFFTEPLFKCSIKS* | 10977 | ATGATGACATGCGCTTTGGTCTTTTCACTGAACCTCTTTTATAAAGTGTTCAATAA | 10978 |
| | 2 | MRFGLFH* | 10979 | ATGCGCTTTGGTCTTTTCACTGA | 10980 |
| | 3 | MYSLHLA* | 10981 | ATGTATTCTTTGCATCTGGCATAG | 10982 |
| | 4 | MQEDHLSPGVPVQPGLTGRTPSLERKKCKKAFFVYYFFETGSPSIPQTGVPWYHHSLLQP* | 10983 | ATGCAGGAGGATCATTTGAGTCCAGGAGTTCCAGTCCAGCCTGGGTTAACAGGTAGAACCCCTTCTCTGGAAAGAAAAATGTAAAAAGGCATTCTTGTGTATTATTTTTTGAAACAGGGTCTCCCTCTATACCCAGACTGGAGTGCCTTGGTATCATCACAGCTTACTACAGCCTTGA | 10984 |
| hsa-mir-372 | 1 | MLTPYPSPSRELPCFVLSHREMISEVSPTTQFIHATPGTPAQKALAEDLLRGWSPCPHPCFLQ* | 10985 | GGGAAGATCTCAGAGGGTCTCTCACAACACAGTTCATTCACGGACACCGGACACCTGCACAGAAGGCACTTGCTGAGGACTTGCTTGCTGCGTGGGTGGAGTCCGTGCCTCCACCATGTCCCTTCAGTGA | 10986 |
| | 2 | MSPSVTLRRMGA* | 10987 | ATGTCCCTTCAGTGACCTTGAGAAGAATGGTGCTAG | 10988 |
| | 3 | MLPDP* | 10989 | ATGCTGCCTGACCCTGA | 10990 |
| | 4 | MEGLSSQETLELAVQLACAAFSKAGENGLG* | 10991 | ATGGAGGGCCTCTCTCTCAGGAGACGTTGGAACTTGCTGTCCAGCTGGCTTGTGCTGCCTTCAAAGCAGGAAATGTTGGGGTGA | 10992 |
| hsa-mir-372 | 1 | MMTCALVFFTEPLFKCSIKS* | 10993 | ATGATGACATGCGCTTTGGTCTTTGCACTGAACCTCTTTTATAAAGTGTTCAATAAAAAGCTGA | 10994 |
| | 2 | MRFGLFH* | 10995 | ATGCGCTTTGGTCTTTTCACTGA | 10996 |
| | 3 | MYSLHLA* | 10997 | ATGTATTCTTTGCATCTGGCATAG | 10998 |
| | 4 | MQEDHLSPGVPVQPGLTGRTPSLERKKCKKAFFVYYFFETGSPSIPQTGVPWYHHSLLQP* | 10999 | ATGCAGGAGGATCATTTGAGTCCAGGAGTTCCAGCTGGGTTAACAGGTAGAACCCCTTCTCTGGAAAGAAAAATGTAAAAAGGCATTCTTTGTATTATTTTTGAAACAGGGTCTCCCTCTATACCCAGACTGGAGTGCCTTGGTATCATCACAGCTTACTACAGCCTTGA | 11000 |
| hsa-mir-373 | 1 | MMTCALVFFTEPLFKCSIKS* | 11001 | ATGATGACATGCGCTTTGGTCTTTTCACTGAACCTCTTTTATAAAGTGTTCAATAAAAAGCTGA | 11002 |
| | 2 | MRFGLFH* | 11003 | ATGCGCTTTGGTCTTTTCACTGA | 11004 |
| | 3 | MYSLHLA* | 11005 | ATGTATTCTTTGCATCTGGCATAG | 11006 |
| | 4 | MQEDHLSPGVPVQPGLTGRTPSLERKKCKKAFFVYYFFETGSPSIPQTGVPWYHHSLLQP* | 11007 | ATGCAGGAGGATCATTTGAGTCCAGGAGTTCCAGTCCAGCCTGGGTTAACAGGTAGAACCCCTTCTCTGGAAAGAAAAATGTAAAAAGGCATTCTTTGTATTATTTTTGAAACAGGGTCTCCCTCTATACCCAGACTGGAGTGCCTTGGTATCATCACAGCTTACTACAGCCTTGA | 11008 |
| hsa-mir-374a | 1 | MVGENGKEEAARMRISDGVPGRGGAQHSGN* | 11009 | ATGGTTGGGGAGAACGGTAAGGAGGAAGCGGCGGCATGCGTATTTCAGACGGAGTGCCGGGAGGGGAGGGGAGGGCTCAGCATTGGGTAATTAA | 11010 |
| | 2 | MARGEVSCLCLAILG* | 11011 | ATGCGAGGGGAGGTCAGCTGTCTTTGCTTGGCATCTGGGCTAG | 11012 |
| | 3 | MLWPDFLERNPES* | 11013 | ATGCTGTGGCCAGATCCACTAGAAATTAACCCAGAATCTTAG | 11014 |
| | 4 | MRRR* | 11015 | ATGAGGAGGCGATGA | 11016 |

Figure 1 (Continued)

| | | | | | |
|---|---|---|---|---|---|
| hsa-mir-374b | 1 | MVGENGKEEAARMRISDGVPGRGGAQHSGN* | 11017 | ATGGTTGGGGAGAACGGTAAGGAGGAAGCGGCGCGCATGCGTATTTCAGACGGAGTGCCGGGGAGGGGAGGGGCTCAGCATTCGGGTAATTAA | 11018 |
| | 2 | MARGEVSCLCLAILG* | 11019 | ATGGCGAGGGGGAGTAAGCCTGTCTTTGCTGCATCTTGGCTAG | 11020 |
| | 3 | MLWPDPLEINPES* | 11021 | ATGCTGTGGCCAGATCCACTAGAGAATTAACCAGAATCTTAG | 11022 |
| | 4 | MRRR* | 11023 | ATGAGGAGGCGATGA | 11024 |
| hsa-mir-378 | 1 | MAGNDCGALLDEELSSFPLNYLADTQVRPAGAAGPGPGVLSCGGRSCSRGGREAAVGALG* | 11025 | ATGGCGGGGAACGACTGCGGCGCGCTGCTGGACGAAGAGCTCTCCTTCTTCTCTCAACTATCTGCTGACACGCAAGTTCGGCCCGCCCGCTGGGCCGGGGCCCCAGGGGTGCTGAGCTGCCGGGGCGCGGGCCCAGCTGCAGCGGCGGGAGGCAGCGGTGGGAGCCCTGGGGTAA | 11026 |
| | 2 | MRSVTGAGSRRSPGACRSAGGATAAGEGLALAAAWSLPPRGQNWGVPRFLWEVEARHGVGYPQAGAGCWRRAVSARHLLPYFHVDLWPRHGCMPGSPESPSPPGCSPQSAVAGPPRLSTRARSAEFPASCRLKA* | 11027 | ATGCGCGCTCCGTTACCGGGGCAGGGAGCCGGAGGTCTCCCGGCGCGTGCCGGAGCGCTGGGGCGCTACGGCCGCTGGGAGGGGTACCGCGCTTCTTTGCGGAGGTGGAGCGCGCACCCCGCGGGCAAAACTGGGCGGTACCCTCAGGCTCGCGCTGGTGTGCGCTGCGTCAGCGCCGGTGTGGGTACCCTCAGGCTCGCGCTGCGTGGTGGCCCCCCGCCCGGGGCGGGGCGCACTTGCTGCCGTACTTTCACGTGGACTTGGCGTGCGCACCTGCATGCCGGGTCTCCGAGTCCGTACTGCCTCAGGTGTCCCAGATTGCTGTGTGTGCGCGCCCCGGCGGGTTTCTACCGCCGAGTTTCCTGCCAGTTGCCGGCTAAAGGGCATAA | 11028 |
| | 3 | MRAETASSWFRYRAEPPGGKSQAGWGRKDCLGAPGSPCGARPRCALHDAGGREGEAESQALAEPGSPTGDTRVTGEGALVCRGAGERGSWWLGDWERGAAGTSSHQKCQHEACAAPTSPFPTQCLLQA* | 11029 | ATGCGGGCGGAGACAGCGTCTTCCTGGTTCGCTATCGGCGGAGCCCTGGGGGAAAGCCAGCGTGCATGGGGCGGATGGCGGCGCCCTGGGTCCCCTGGGGTGCCGGCCCCCGGTGCCAGGCACTGGCTGGAATGGGCCCTGAGCCCGGAGCCCCACTGGCTGGACACGCGCGTGACAGGGAGTCCCAGGCACTGGCTGGGTGCTCTGGTGTGTCCCGGGCGCGGGAAGCAAGCAACCACCAAAATGCTCACGACGAGGCGTGCGGGCGCCGTCGCTGGGACAAGCAGCGCCATTTCCCACCAATGCCTGTTGCAAGCATAA | 11030 |
| | 4 | MGAEGLSGGAWVPLRCAAPVRAPRCRGKGRRGGVPGTG* | 11031 | ATGGGGGCGGAAGGACTGTCTGGCGGCGCCTGGGTCCCCGAGGCGCGGGGTGCGCGCTCCACGATGCAGGGGGAAGGGAAGGCGAGTCGAGTCCCAGGCACTGGCTGA | 11032 |
| hsa-mir-423 | 1 | MAIPGRQ* | 11033 | ATGGCGATTCCGGGCAGGCAGTGA | 11034 |
| | 2 | MRNYGDCIFGRGVLNALEVKGLCRQG* | 11035 | ATGAGAAACTACGGCGACTGTATCTTTGGCCGAGGAGTTTAAATGCGCTGGAAGTGAAGGGACTGTGTCGTCAAGGGTAG | 11036 |
| | 3 | MRWK* | 11037 | ATGCGCTGGAAGTGA | 11038 |
| | 4 | MFARSLREKLVRK* | 11039 | ATGGAAGCCGAAATCTGACATTTGAGCGAGAAACTTGTGAGGAAATAA | 11040 |
| hsa-mir-424 | 1 | MGANLTFKVFNK* | 11041 | ATGGGCGCAAATCTGACATTTAAAGTGTTTAACAAATGA | 11042 |
| | 2 | MSAAGKFSGNGLGKKKQQLTWRGGERKLSKGQ* | 11043 | ATGAGTGCGGCCGGGAAATTCTCAGGAAACGGACTGGGAAAAAAAAAACAACACTAACATGAGGGGTGGGGAGAGAAAAACTGAGTAA | 11044 |
| | 3 | MEGRGEKTE* | 11045 | ATGGAGGGGCGGGGAGAGAAAACTGAGTAA | 11046 |
| | 4 | MNFSSYLQEVSYVLERNV* | 11047 | ATGAACTTTTCCTCTTATTTGCAAGAAGTTAGTTATGTCTTGGAAAGAAATGTGTGA | 11048 |
| hsa-mir-425 | 1 | MGGF* | 11049 | ATCGGCGGGTTCTGA | 11050 |
| | 2 | MWPQGE* | 11051 | ATGTGGCCCCAGGGCGAGTGA | 11052 |
| | 3 | MGLP* | 11053 | ATGGGGTGCCCCTGA | 11054 |
| | 4 | MGVDVGEPRLVAISGTLGRIGEGGWTQDLWVGLQW* | 11055 | ATGGGGTGTAGACGTGGGAGAGGCCAGGCTGGTGGCCATCTGGGGGAGGGTGGGGTTCAGGGAGGTGACCCTCTGGGAGGATTGGGTAGGGCTGCAATGGTAG | 11056 |

Figure 1 (Continued)

| | | | | | |
|---|---|---|---|---|---|
| hsa-mir-429 | 1 | MTMSYPAGGPGRNLWQPPVPGDSDTKCSHCAGPGYE WPHTDQLTPAGRATGPPPWRREASGATRCAPGPLTSL VGGGCRPGPPET* | 11057 | ATGACAAATGTCTACCCAGCAGGAGGACCAGGCCGGAACCTTTGGCAGCCACCAGT TCCTGGAGATTCCGACACCAAGTGCAGCCACTGTGCGGCGCCGGTGTGGAGTGGC CCCACACCGACCAGCTCACGCCAGCTGGCAGAGCCACTGGCGCCCCTCCGTGGAGG AGGAGAGAGGCCTCCGGCGCCACGGCTGTGCCCAGGGCCACTCCTTGGT AGGTGGGGATGCCGGCCTGGGCTCCGAGACTTGA | 11058 |
| | 2 | MPAWASRDLSPAPALAPRETCASERPRPPLPEPCTRAVR GPCCTPERASALSHSVSNPPPSSGPQNWPSTELRGTRGP WGLGRDWPARGPPAAIPRFHQDESRAVGTT* | 11059 | ATGCCGGCCTGGCCTCCGGGACTTGAGCCTGCCCTGCCCTTGCCCCCAGAGAG ACCTGTGCCAGCGAGACTTGCGCTTCCCGTGAGCCTGCACCGGCGGTG CGGGGCCCTGCTGCACCCCAGAGCGGGCATCAGCCCTGCAGCCACTCCGTTAGCAAT CCTCCCCCAGCTCAGGGCCTCAGAACTGACCATCCACGGAGCTCAGAGGGCACCCGA GGGCCCTGGGACCTGGGTAGGGACTGGCCAGCTGGGGGTCCTCCAGCAGCCATACC CAGGTTCATCCAGGATGAAAGCAGGGCAGTGGAACCACGTGA | 11060 |
| | 3 | MKAGQWEPRIDWFKSR* | 11061 | ATGAAAGCAGGACAGTGGGAACCACGTGATTGGTTTAAAGCAGGTGA | 11062 |
| | 4 | MVAHACNPGTFGGQGRRITRGQEFETSLANTAKPLSLL KIQKLAGHGSAHL* | 11063 | ATGGTGGCTCATGCTGTAATCTGGCACTTTTGGAGGCAAGGCAGGCGGATCACC GAGGTTCAGGAGTTTGAGACTAGCCTGGCCAACACTGGCAAAACCCCGTGTCTCTACTA AAATACAAAATTAGCTGGGCATGGTAGTGCACCTGTAG | 11064 |
| hsa-mir-449a | 1 | MVLGDGIPGY* | 11065 | ATGGTCCTGGGGGACGGGGACTCCAGGGGTTTGA | 11066 |
| | 2 | MEWKLERTAPRRVRTEEEMLWVSNTLFCILPNSLMRGR RPRS* | 11067 | ATGGAGTGGAAATTGGAGCGCAACTGCCGCCGGAGGGTCCGCACGGAAGAGGAGAT GCTGTGGGTGAGTAACACCCTTTTCTCCCTAACTCTCCTAATGTTATCTGTTTTCATGA AGGCCCCGTTCATAA | 11068 |
| | 3 | MIFLNSFSLNMLSVFSKESIMRVLSKDLKQKRSQDSANV SPGLVLVLCFNSDLEQTNSW* | 11069 | ATGATTTTCCTAAATAGTTCTCCTCAATATGTTATCTGTTTCAAAGGAAAGTA TCATGCGTGTCCTCCAAAGACTTGAAGCAGAAGAAGTTCCGCCAAC GTGAGTCCAGGCTTGTTCTTGTTCTCTGTTTTAATTCTGATCTGAACAAACGAATT CTTGGTAA | 11070 |
| | 4 | MRILVSYYILKKISL* | 11071 | ATGAGAATTTTAGTATCTTATTACATACTAAAAAAATTTCTTTATGA | 11072 |
| hsa-mir-449b | 1 | MVLGDGIPGY* | 11073 | ATGGTCCTGGGGACGGGACTCCAGGGGTTTGA | 11074 |
| | 2 | MEWKLERTAPRRVRTEEEMLWVSNTLFCILPNSLMRGR RPRS* | 11075 | ATGGAGTGGAAACTGGAGCGCACCGCCTCCGGAGGGTCCGCACGGAAGAGGAGAT GCTGTGGGTGAGTAACACCCTTTTCTGCATTCTCCTAACTCTCCTAATGCCGGGGCCG AAGGCCCCGTTCATAA | 11076 |
| | 3 | MIFLNSFSLNMLSVFSKESIMRVLSKDLKQKRSQDSANV SPGLVLVLCFNSDLEQTNSW* | 11077 | ATGATTTTCCTAAATAGTTCTCCTCAATATGTTATCTGTTTCAAAGGAAAGTA TCATGCGTGTCCTCCAAAGACTTGAAGCAGAAGAAGTTCCGCCAAC GTGAGTCCAGGCTTGTTCTTGTTCTCTGTTTTAATTCTGATCTGAACAAACGAATT CTTGGTAA | 11078 |
| | 4 | MRILVSYYILKKISL* | 11079 | ATGAGAATTTTAGTATCTTATTACATACTAAAAAAATTTCTTTATGA | 11080 |
| hsa-mir-450a-1 | 1 | MGANLTFKVFNK* | 11081 | ATGGGGCAAATCTGACATTTAAAGTTTTAACAAATGA | 11082 |
| | 2 | MSAAGKFSGNGLGKKKQQLTWRGGERKLSKGQ* | 11083 | ATGAGTGCGCCGGAAGTCTCAGGAAACGGACTGGGAACTGAGTAAGGGGCAGTGA | 11084 |
| | 3 | MEGRGEKTE* | 11085 | ATGGAGCGGGCGGGAGAAAACTGAGTAA | 11086 |
| | 4 | MNFSSYLQEVSYVLERNV* | 11087 | ATGAACTTTTCCTCTTATTGCAAGAAGTTAGTATGTCTTGAAAGAAATGTGA | 11088 |
| hsa-mir-450a-2 | 1 | MGANLTFKVFNK* | 11089 | ATGGGGCAAATCTGACATTTAAAGTTTTAACAAATGA | 11090 |
| | 2 | MSAAGKFSGNGLGKKKQQLTWRGGERKLSKGQ* | 11091 | AACATGGAGTGCGGCGGGGAGAAAACTGAGTAAGGGGCAGTGA | 11092 |
| | 3 | MEGRGEKTE* | 11093 | ATGGAGCGGGCGGGAGAAAACTGAGTAA | 11094 |
| | 4 | MNFSSYLQEVSYVLERNV* | 11095 | ATGAACTTTTCCTCTTATTGCAAGAAGTTAGTATGTCTTGAAAGAAATGTGA | 11096 |
| hsa-mir-450b | 1 | MLGTPGAGPRGPAASSGSVPSR* | 11097 | ATGCTGGGAACCCTGGGGCGGGGCCCTGCCAGCCTGGTCAGGGCTC AGTCCCTCCGATAA | 11098 |

Figure 1 (Continued)

| | | | | |
|---|---|---|---|---|
| hsa-mir-484 | 2 | MKNPVPSAFFFSSLGSRHVMVLLYP* | 11099 | ATGAAAAACCCTGTCCCTTCGGCTTTTTTTTCCTCTCTCGGGTCTCGTCACGTGATGGTCCTACTTTATTTTAA | 11100 |
| | 3 | MAHPQHPKSSAT* | 11101 | ATGGCGCATATTCCCAGATTCCTAAATCTAGTGCAACCTAG | 11102 |
| | 4 | MNTAPPVTGWASRKEJLRLVSNTLCPRWPDMLCGLL* | 11103 | ATGAATACTGCGTTTCCAGTTGACAGTTGGGCGAGATATGCGAAGGAGAAATCTTACGGTTAGTTTCAAACACTTTGTGTTTTAGTTGCGGCCAGATATGCTGTGTGGTTGCTTAA | 11104 |
| hsa-mir-497 | 1 | MRIRLGALPLASGWSH* | 11105 | ATGAGAATTAGACTAGGCGCTCTCCCTTGTGGGTCTCTTTATTATGGGTGTTATTTGA | 11106 |
| | 2 | MEYYLISCGVSVYGVLI* | 11107 | ATGGAGTATTATTTGATCAGTTGTGGGTCTCTTGTTTATTATGGGTGTTGATTTGA | 11108 |
| | 3 | MVSFRYGADLFVTLVLGVLTPTIWRLCSPVSSWTHSRTKVLMLIWGCSLFWGAI* | 11109 | ATGGTAAGTTTCAGGTATGGGGCTGACTTGGAAGTTACATTAGTTCTGGGGGTTCTGACACCCACAATTTGGAGATTGTGCTCACCTGTGTCATCTTGGACTATCAGCAGAACCAAAGTACTCATGCTGATTGGGGGTGCAGTCTATTTGGGGTGCCATCTAA | 11110 |
| | 4 | MGLTWKLH* | 11111 | ATGGGGCTGACTTGGAAGTTACATTGA | 11112 |
| hsa-mir-503 | 1 | MGANLTFKVFNK* | 11113 | ATGGGGGCAAATCTGACATTTAAAGTGTTTAACAATGA | 11114 |
| | 2 | MSAAGKPSGNGLGKKKQQLTWRGGERKLSKGQ* | 11115 | ATGAGTGCGGCCGGAAAATTCTCAGGAAACGGACTGGGAAAAAAAACAACAACTAACATGGAGGCGGGGGACGAGAAAACTGAGTAAGGGCAGTGA | 11116 |
| | 3 | MEGRGEKTE* | 11117 | ATGGAGGGGCGGGAGAAAACTGAGTAA | 11118 |
| | 4 | MNFSSYLQEVSYVLERNV* | 11119 | ATGAACTTTTCCTCTTATTGCAAGAAGTTAGTTATGTCTTGGAAAGAAATGTGTGA | 11120 |
| hsa-mir-505 | 1 | MFRRSLNRFVSTLAAAPRVPVCLLASPFAGSLTTTF* | 11121 | ATGTTCCGCCGGAGCTTGAATCGTTTGTAAGTACACTGCTGCCTCCGCGTGCCGGTTTGCTTGCTCGCCAGGCCCTTCGCCAGGGCCCCTTCACAACAATTTTCTGA | 11122 |
| | 2 | MAFYSQGCFLLFPLPRAHGGKPRPVTVAQKKSWGLREPETRARLSLA* | 11123 | ATGGCGTTTTATTCTCAGGAGGTTGCTTTCTTGTTTCCTCTGCCACGAGCACATGGAGGTAAACCTAGACCTGTCACGGTGGCCAAAAAGAGAGCTGGGGGCTGAGGGAGCCGGAGACTAGGGCAAGACTCAGCCTTGCCTAG | 11124 |
| | 3 | MEVNLDLSRWPKRRAGG* | 11125 | ATGGAGGTAAACCTAGACCTGTCACGGTGGCCAAAGAAGAGCTGGGGCTGA | 11126 |
| | 4 | MCSREEAAPPLPVLPISGLKPRGGLSTPDLEPMGEGGL* | 11127 | ATGTGCAGCCGCGAGGAGACTGAGGCGCTGCCTCCCGTGCTGCCGATCTCTGGTCTGAAGCCTCGCGGAGGACTGAGCACCCAGACCTTGAACCTGAACCATGGAGAAGGCGGACTGTGA | 11128 |
| hsa-mir-542 | 1 | MGANLTFKVFNK* | 11129 | ATGGGGGCAAATCTGACATTTAAAGTGTTTAACAATGA | 11130 |
| | 2 | MSAAGKPSGNGLGKKKQQLTWRGGERKLSKGQ* | 11131 | ATGAGTGCGGCCGGAAAACCCTCAGGAAACGGACTGGGAAAAAAAACAACAACTAACATGGAGGGCGGGGACGAGAAAACTGAGTAAGGGCAGTGA | 11132 |
| | 3 | MEGRGEKTE* | 11133 | ATGGAGGGGCGGGAGAAAACTGAGTAA | 11134 |
| | 4 | MNFSSYLQEVSYVLERNV* | 11135 | ATGAACTTTTCCTCTTATTGCAAGAAGTTAGTTATGTCTTGGAAAGAAATGTGTGA | 11136 |
| hsa-mir-545 | 1 | MVGENGKEEAARMRISDGVPGRGGAQHSGN* | 11137 | ATGGTTGGGGAGAACGGTAAGGAGGAAGCGCTCAGACATTCGGGTAATTAA | 11138 |
| | 2 | MARGEVSCLCLAILG* | 11139 | ATGGCGCGAGGGGAGGTAAGTGTCTTGCTTGGCCATCTGGGCTAG | 11140 |
| | 3 | MLWFDPLEJNPES* | 11141 | ATGCTGTGGCCCAGATCCACTAGAAATTAACCCAGAATCTTAG | 11142 |
| | 4 | MRRR* | 11143 | ATGAGGAGGCGATGA | 11144 |
| | 1 | MSLDWACLSSWGRATSWGPAHTRJHVERVCKSTPVLLTEGDYSTVFLGILFFFTSGLTLAARGSPPGLGCWIPATRGKHWRHDPGSTSRGARTGRGAAGLAAAAARGWAGLGCGEMTSPSPRAPW* | 11145 | ATGTCTCTGGATTGGGCTTGCCTCTCTTCTTGGGGAAGAGCCACTTCTTGGGCCCTGCACACGACGAGCGCATGTGGAAGGTCGTAAATGACCACCGTTCCTAACCGAAGGTGATTACAGACACCGTCTCTTGGGGGATACTTTTTTTTACGTCAGGCCTCACGCTCCGCTGCACGGGATCGCCGCAGGGCTGGACTTGCCCACACGGGGGAAGCACTGGCGGCACGATCCGAGATCCGGAGGCGCCCGCCACTGCCGCGGGGCTGCGGACTGCGCCGGCGGCGGCGGGGCTGGGGGGCTTGGCTGCGGGGAAATGACGCCCGCGCGGTGCCCCTGGTAA | 11146 |
| | 2 | MWKGSVNRHPFC* | 11147 | ATGTGGAAAGGGTCTGTAAATCGACACCGTTCGTCTAA | 11148 |

Figure 1 (Continued)

| | | | | |
|---|---|---|---|---|
| hsa-mir-548b | 3 | MSPPIPAAARPVSSSLRSLAESSVRAASGTRGAALSSTPP PGAGRGASKSWPGPRPPPNPGHLPRAVVPAASGRRDR PVPSRGIDPGVAGGTAPAAESGGRRVSGREAAAATLASR ASLLHGPASTRGDRCPGWGLLGRWRPRA* | 11149 | ATGTCCCCGCCTATCCCCGCGCAGCCGCCGCCCGTCTCTCCTCCGCAGCTTCG CCGAGTCCTCGGTTGCGGGGCTGCGAGCGGGAACCCGGAGCTGCGCTGTCCTGACG CCTCCGCAGGCGCGGCCAACGCCTCCAAGAGCTGGCCTCGGCGCCGGCC GCGGCCAACCCGGCATCCGCCCCTTCCCCCGCGTTGTCCCCGCGCTTCGGCCGAGG GGACCGGCCCCTCTCCTTCCAGGGGTGACCCGGGGTGAGCCCGGGGTAGGGGG CGGCCGAGTCTGGGGCGCGCCTCGGGGCGTCGTCCACGGCCTCGCCGGACTCTT GCCTCCGGGCGTCGTTGGGAAGATGGCGACCCGGACATGA | 11150 |
| hsa-mir-548c | 4 | MATPGMSWQQHYYGGSAAKEAPSPATAQLAGHSMDY SQEMHLKMSKKIAQLTKVRGAATGQVATPCGPRRTHL SPREAVRPAPAARGTLLRRSNSRRHLQNPANFGGTLA T* | 11151 | ATGGCGACCCCGGCATGAGCTGGCAGCAGCACTATTACGGCGGCTCGGCGGCAA ATTCGGCGCCTGCGCGCCACGCACAGCTGCTGGCACAGCTGAAATCGCCCAGCTCACCAAGTAAGGGG AGGAGATGCACCTGAAAATGAGCAAGAAAATGCCCAGCTCACCAAGTAAGGGGG GCAGGCAGGGGCAGGTGCGACCCGTGCGGGCCGTGCGGGCGACTCACCTGTCTC CGGGAGGCAGTGCGCGTCAGCGAGGGAACTCTACTCCTCCGCGAA GCAACAGCCGGAGACACCTGCAAACCTTGGTGGAACGCTGGCAACA TGA | 11152 |
| | 1 | MVKRQ* | 11153 | ATGGTGAAAGACAGTAG | 11154 |
| | 2 | MINACKGASLLYDKSWLI* | 11155 | ATGATAAATGCATGCAAAGGAGCTTCTCTATGACAAGTCTTGGCTAACTTAG | 11156 |
| | 3 | MHAKELFYMFSLG* | 11157 | ATGCATGCAAAGGAGCTTCTCTATATGACAAGTCTTGGCTAA | 11158 |
| | 4 | MQRSFSSI* | 11159 | ATGCAAAGGAGCTTCTCTCTATATGA | 11160 |
| hsa-mir-550-1 | 1 | MPGGTDPSPRTRARSSRGCTWAVAAGYFYPSPFLLLPG RRGLPPGPARVGLHPGRNPALNTGGAATA* | 11161 | ATGTTTGGAGGTACGGACCCCTCGCGACACCCGTCGCGCTCGGTCTCCCGGCTGC ACGTGGGCCGTGCCGCGGCGCCGGCTATTTTTACCCTTCTCCTTCTCCTCCGGGCG GCCGGGGGCTGCCTCCCCGGACCCAGCCCGCGGGTGCTGCCCATCCTGGAAGAAACCCG GCGCTTAACACCGGCGGTGCCGCTACCGCATAG | 11162 |
| hsa-mir-550-2 | 2 | MTGANVVLQQTDETALVLVVVFSTRKSGGDQLLNVVLS GDSSGEQFLKAKSQSVSNEH* | 11163 | ATGACTGGAGCAAATGTTGTTTTACAACAACCGACGAAACAGCCCTTGTGGTTGTG GTTTTTAGTACCAGGAAGTCAGGAAGTCAAGGAGAGACCAGTTGCTAAATGTAGTTCTATCTGGG GACTCGAGTGGGGAACAGTTTTAAAGGCCAAAAGTCAAAGTGTCTCAAATGAACA CTGA | 11164 |
| | 3 | MLFYNKPTKQPLWLWFLVPGSQEETSC* | 11165 | ATGTTGTTTTTACAACAACCGACGAAACAGCCCTTGTGGTTGTTGGTTTTTAGTACCA GGAAGTCAGGAGGAGACCAGTTGCTAA | 11166 |
| | 4 | MNTELPCLDRLLV* | 11167 | ATGAACACTGAGTTACCATGTTTGGACCGACTTTTAGTATAA | 11168 |
| | 1 | MAAVTAAAGEEAVGRPGAPSATAESGSPSWRTETSGS RTAT* | 11169 | ATGGCGGCCGTAACAGCGGCGGCCGCCGCCGGAGAGGAGGCCGTGGGAGGCCCGGAGCGC CAAGCGCGACGGCAGAAGCGGCCAGCAGCGGCCCGTCATGGCACCGAAACCAGCGGC AGTCGCACGGCCACCTGA | 11170 |
| | 2 | MAHRNQRQSHGHLSRPFLLEPARGACSRDTFLSASPRLP RPRQAASLAHRPEKSAPGADCPSGRRAAALDVRGPLWA GRGASALPSSSRVRSYPLGSRGTARGPVRSKADRSARQS GLAAANGARARTRLGSTFQ* | 11171 | ATGGCCCACCGAAACCAGCGGCACAGTGCACGGCCACTGAGTCTGCCCTTCCTGCTG GAGCCAGCCGAGGGGTGCCTGCAGCCGGACACCTTCCTGTCCGCCTCGCCGCTGCCGG CGCCGACTGCCCGTCAGCGCCCAGCTTGCCCACCGCCCGGGAGAAGAGCGCCGCGG CGGCCGACTGCCCATCTGGGCGGCGTGCCCTGGCCTGCCTTCTAGCTCCGCCTCTACCCTC TTGGCTCTCCGGGCACAGCGGCTTGTTCGCCCTAACGCGCAAGGCGGACAGGAGCGCC AGGCAGAGGCGGCCTGGCCGCCGCTAACCGGCACGCGCGCGCGCTACTCGGCTCGGATC TACCTTCCAGTAG | 11172 |

Figure 1 (Continued)

| | | | | |
|---|---|---|---|---|
| | 3 | MGPGPGLGAGGPPPRGGSRLLRCPALTSPAPRAAPKWPR QPRAAVSWGAWRRGPARRSPPSASRTAAVRRTRRTR CTAALRMAAAAASTGRWAGAPAGRAW* | 11173 | ATGGGACCGGGACTCAGGGCTGAGGGCCTGAGGGCCGGGGGCCGGGGGCCGCCGCCGGCGGCGGAGGTTCCC GGCTCAGGTGCCTGCCCCGCGGAGCTGCCTCACCAGCGCCTCGGGCGGCCGCGGCCCCGCGGCG CGGCAGGCCCGCGGCCAAGCTGTTTCCTGGGCGGTCGCTGCCGGGGCCCCGCCGGCG CAGTCCTCCTTCAGCATCCGAACAGCAGCAGCAGGGTCCGCAGGAGGTCGCAGGACTCG GTGCACAGCAGCCCTGAGGATGCCGGCGGCGGCGGCGCAGCACCGGCCGGTGGGCGG GAGCCCCGGCGGGGCCGGGCCGGCTGGTGA | 11174 |
| | 4 | MFGGTDPSPRARARFSRGCTWAVAAGYFYRSPFLLPPG RRGLLPGPARQGLLPGPARAGLHPGKKPGT* | 11175 | ATGTTTGGAGGTACGGACCCCTCTCCACGCGCCGCCTCGGTTCTCCCGGCTGC ACGTGGGGCGTGCGCCGCGCTATTTTACGTTCCTTTCTCCTTCCGCCGGGGC GCCGGGGCTGCTTCCGGCGCCACCCGCCAGGGCGTGCTTCCCGGCCCAGCCGC GCCGGTCTCCATCCTGGGAAGAAACCCGGCACGTAA | 11176 |
| | 1 | MNQGF* | 11177 | ATGAACCAAGGTTTCTGA | 11178 |
| hsa-mir-553 | 2 | MAGPRVEVDGSIMEGVSTERSGRGCSLTKEGSSHHRCA YFSSPCTPFAGRPDPESLYGLELSPRPPLAGAEDPSRPE HARPEVNLAGGGVGP* | 11179 | ATGGCCGGGCCCCGGGTGGAGGTCGATGGCAGCATCATGGAAGGGGTGAGTACAG GCGAAGCGGCCGGGCTGCAGCCTAACTAAGGAGGGGAGCTCTCACCACCGGTGT GCTTACTTCCTCCTTCCGTACCCAACCTTTGCAGGGCGCAGATCCTGAGAGT CTCTACAGCGCCTGAGCTGTCTCCTAGCCTCCCCTGGGGTGCAGAAGATCCGAGC CGGCCCGGAGCACGTCCAGGCCTGAGGTAAATCTGCTGGAGGGGAGTTGGGCCGTG A | 11180 |
| | 3 | MAASWKG* | 11181 | ATGGCAGCATCATGAAGGGGTGA | 11182 |
| | 4 | MGDPGRGTLPGRWPGH* | 11183 | ATGGGCGATCCAGGCCGTGGCACTTCTGCCTGGCGGTGCCTGGGTTGTAA | 11184 |
| hsa-mir-554 | 1 | MNGTRNWCTLVDVHPEDQAAVRKSALAVFSVLYSRFL SPPLPCPAPCWLTSPGARLARSALRGASLFLFFCLRRAV GVAG* | 11185 | ATGAACGGACACGGAACTGGTGTACCCTGTGGACGTGCACCTGAGGACCAAGC CGGTAAGAACAAAAGCGCTCTCAGCTGTCTTCTCCGTTTTGTATTCCGGTTCTAAG TCCGCCCCCCCGTGCCGCGCCGGTTGCGCTGACATCACCTGGTCGCCGGCTCGC GCGGTCAGCCTGCGCGGCACGGAATCTTTTATTCTTTGCCTGCGACGGGCAGTG GGAGTCGCGGGGTGA | 11186 |
| | 2 | MSSSIDWVPERLWTLCPAEEA* | 11187 | ATGAGCTCAAGCGACTTGGGTCCCTTGAGCCGTTGTCCTGAGGAG GCTTAG | 11188 |
| | 3 | MVLWMISNKKNGRVNYRAWTGRGCIASRGR* | 11189 | ATGGTGCTTTGGATGATCAGTAACAAGAAAAATGTAGAGTAAATTACAGGGCTTG GACTGGAGGGCGGGGGCAAGTAGGGCAAGTGGAACGGTAG | 11190 |
| | 4 | MQMPGREGEGSDPSEGFWTGRGLRRKGAPSSAGWSTP LSSFSGSQSQF5PP* | 11191 | ATGCAGAACCCGTGCCATGGCCGAGAAGGGGAGGAAGGGAAGTGACCAAGCAAGCGAAGCCTTCTGGA CGGGAGAGGGTTCCATGGATCCTCAGTGCAGGCTGGTCTACCCCCT CTCTCCTCTTTCTGCCTCCCAGTGCTCCCAGTTCCTCTCCCACCCTAG | 11192 |
| | 1 | MWAWGWGGAKLRGRAADTLKLRAGRAQRKGRRPHG YPSAARVK* | 11193 | ATGTGGGCATGGGGTGGGAGGGCTGGAAGGCGAAGCTCCGAGGCCGGGCGCGGATACTTT AAACTCAGAGCTGGAGGGGCCCAAAGGAAGGGGGGCGTCCACATGGTTACCCTT CTGCTGCGCGGGTCAAGTAG | 11194 |
| hsa-mir-561 | 2 | MGVGRREAPRPGRGYFKAQSWEGFKEGAASTWLPFCC AGQVASSGGRKARRG* | 11195 | ATGGGGGTGGGAGGCGGAAGCTCGAGGCCCGCGATACTTTAAAGCTCA GAGCTGGAGGGGCCCAAAGGAAGGGGCGGTCACATGGTTACCTTCTGCTGCG AGGGTCAAGTAGCTTCTTCTGGAGGGCGCAAGGCGGGGGGTGA | 11196 |
| | 3 | MVTLLLRGSSSFPWRAQGAAGVAASPWVLAPTAKPAWP GPPSRGLTRHTDQNPEQAVLSLRLLRLPR* | 11197 | ATGGTTACCCTTCTGCTGCGCGGGAGTAGTTCTTCTGGAGGGCGCAAGGCGG GCGGGGGTGATGAGCCTTGGCCTCACTGCGGCTGCTAATTCGCTTGGCCGGGT CCACCTTCTGTGGCCTCACTCGCCACACGAATCCGGAGCAGGCAGTTCTC TCTATTCTGAGGCTTCTGCGGCTGCGCGCTGA | 11198 |
| | 4 | MCLRC* | 11199 | ATGTGTTTACGATGTTGA | 11200 |
| hsa-mir-563 | 1 | MGEPDLHVEKA* | 11201 | ATGGGCGACCGGACTTGCACGTGGAGAAGCGTGA | 11202 |
| | 2 | MCPWVWGGWGAKEWDERWSRNGHRCCPPRGLQAET G* | 11203 | ATGTGCCCCTGGGTTTGGGGAGGTGGGGAGCCAAGGAGTGGGATGGGATGAGAGGTGGTC ACGGAATGGGGGGCTGCAGGGGCTGCAGGCCGAGACCGGGTGA | 11204 |

Figure 1 (Continued)

| | | | | | |
|---|---|---|---|---|---|
| hsa-mir-568 | 3 | MRGGHGMGGAAVLPGGCRPRPGEGRG* | 11205 | ATGAGAGGTGGTCACGGAATGGGCGGGGCGGCTGCTGTCCTCCCGGGGCTGCAGGCCGAGACCCGGGTGAGGGCGCGGGGTGA | 11206 |
| | 4 | MLALWTEGRRLRSRTGCGRPIYFLPVVPIRS* | 11207 | ATGCTGGCACTCTGGACGGAAGGGCGTCGTCTTCCCAGCGAACCGGTTGTGGACGCCCAATCGTTTTCTGCCCGTAGTCCAATCCGAAGCTAA | 11208 |
| | 1 | MPPTRRVGVRRRAP* | 11209 | ATGCCGCTGACCGCGGTGGTTGGAGTGCGACGAAGAGGCGTGA | 11210 |
| | 2 | MDRWYPEARSNCIRVISYHGEGFSKSGPVAQWITRLTIDQKILGSTPGWLAMSVLPHLTHVLGLVKMYIHNVKVLQDLGKVYG* | 11211 | ATGGATCGTTGGTACCCGGAAGCCCGTTCAAACTGTATAAGGGTGATCAGTATCACGGATCAGAAGATTCTAGTTCGACTCTAGTTCACGGCGCAATGGATAACGCGTCTGACTACCTGACCAGTAGTGTCTGGCTGGCTGTCTTTGCCACACTTGACCCATGTACTACTGGGTCTTACTGGGCTCTCACAAGACCTTGAAAGGGTATGTTAG | 11212 |
| hsa-mir-571 | 3 | MDNASDYGSEDSRFDSWLARDVCFATILDPCTTGSCKDVYSQCESITRPWKGVWLECES* | 11213 | ATGGATAACGCGTCTGACTACGGATCAGAAGATTCTAGTTCGACTCCTGGCTCGCGATGTCTGTTTTGCCACACTTGGCTGAAAGTGTTGTACCACCATTGAAAGGTCTTGGATGGGTAAAAGCGGTCTTGGATGGGTCTGTGATCACAATGTGAAAGCTGTAAATAGTTAA | 11214 |
| | 4 | MYYWVL* | 11215 | ATGTACTACTGGGTCTTGTAA | 11216 |
| | 1 | MVSVRGRASQG* | 11217 | ATGGTGAGTGTGCGGGGCAGGGCGTCCAAGGCTGA | 11218 |
| hsa-mir-572 | 2 | MAAGPSLRTESPLPPLSPGASVPSGEPGLLSVPAQRLWPSLQPSLCSSAPAAPHLPQAVG* | 11219 | ATGGCGGCGGGACCGAGTCTCCGAACGGAGTCCCGCCTCCCGGCTCAGCCCTGGGGCCTCAGTACCCTCCGGTGAGGGACCTGGGCTCGTGGCTCGTGCAGCTCGGCACGACAGCGCTTGGCCCAGCTGACCCCTCTGTGCGCCCCTCTGTGCGCCAGCCGCCCGCACCCTCCCAGGCTGTGGGGTGA | 11220 |
| | 3 | MPAWEELWEKLWSGDPVPALPCSE* | 11221 | ATGCCGGCTGGGAGGAGCTGTGGGAGAAGCTGTGGTCGGGGATCCCGTCCCTGCTTTACCCTGTTCGGAATGA | 11222 |
| | 4 | MRSRPHQNRVHVSKWGLNGTAPAVARGLGAASGS* | 11223 | ATGAGATCGAGGCCCCATCAAAACAGAGTTCATGTGAGCAAATGGGACTCATTAATGGGACAGCGCCGGCGTGCCGGGCTGTCTGCATGCGGGCTGCCAGCGGGTCTTGA | 11224 |
| | 1 | MRWKVG* | 11225 | ATGCGGTGGAAGGTCGGCTGA | 11226 |
| | 2 | MDRARWPSSV* | 11227 | ATGGACCGAGCACGGTGGCCGAGCTCAGTTGA | 11228 |
| hsa-mir-573 | 3 | MGYPRGADTGRLRLLEEKRGVGFLS* | 11229 | ATGGGTTACCCCAGAGGGGCGGATACGGGAAGATTAAGGTTGTGGAGGAGAAACGTGGAGTAGGCTTTGTCTTGA | 11230 |
| | 4 | MNCA* | 11231 | ATGAACTGTGCTGA | 11232 |
| hsa-mir-574 | 1 | MHTPTRPHSGSAPSACVNLRGACLDLPKYPVLAPSKSGKVPPMARGQVRGGLQGPFARARREQVPVRQRPRPRVRLPSALAQGAQALTSPLPSPYSSPNSRPTPCLLFQSSQHSKQAPPLAAPGMGPTPYRRSPGPLHPVG* | 11233 | ATGCACACACCACACGCCACACTCAGGTTCTGCCCCTGGCCTGCGTGAACCTCGCGGGAGCTGCCCCAATGGCTGCGGATCTCCAAAGTACCCAAGTCTGGCACCAAGCAAGTCTGGAAAAGTGCCCCAATGGCTGCCGGGCAGTGGGCTGCAGGGTCCCCAGCCCGGGGCACGAAGGGAGCCAGGTCCCTGTAAGACAGAGCCTCGTCCAGGCTGCCCTGCCCTCGGCTTGGCAGGGAGCCAGGCTCAGGTCACCTGGCCTTCGCCTCCGTCCAGCCGGCCCGGCCCCACCTGCCTCCAGTCAGTCAGCCCGGGATGGGTCCACTCCAGTCCTACCGCACTAAGCAGGCACCGCCCCCTCCACTGCCTCCAGTCCTACCGCAGATCCCCAGGCCCCCCTCCACCAGTCGGCTAG | 11234 |
| | 2 | MGCESITYALLIPSFPILNILKDTGRWLLKSVCSELPVTSANL* | 11235 | ATGGGCTGTGAGAGCATTACCTATGCCCTACTGATCCCATCATTTCCATCTAAACATCTTGAAGGACACAGGCAGGTGCTTCTTAAATCAGTGTGCTCTGAACTCCCTGTGACCTCAGCCAACCTGTGA | 11236 |
| | 3 | MRQALSSEPLFALSAA* | 11237 | ATGAGACAGGCTCTATCCTCCGAGCCTCTTTTTGCCCTCTCTGCAGCCTAG | 11238 |
| | 4 | MDLRHK* | 11239 | ATGGATTTGAGGCACAAGTGA | 11240 |

Figure 1 (Continued)

| | | | | |
|---|---|---|---|---|
| hsa-mir-578 | 1 | MAGRGGSALLALCGALAACGWLLGAEAQEPGAPAAG MRRRRRLQQEDGISFEYHRYPELREALVSVWLQCTAIS RIYTVGRSFEGRELLVIELSDNPGVHEPGKGAAP* | 11241 | ATGGCCGGGCAGGGGGCAGGCGCTGCTGGCTCTGTGCGGGGACACTGCTGCCTG CGGGTGGCTCCTGGCGCTGCAAGCGCTGCAAGGAGGCCCCGGGCGCTCAGCAGCCATGA GGCGGCGCCGGCGGCTGCAGCAAGAGGACGGCATCTTCTTGAGTACCACCGCTAC CCCGAGCTGCGCGAGGGCGCTCTGGTGTCCGTGTGGCTGCAGTGCACCGCCATCAGCAG GATTTACACGGTGGGGCGCAGGTTCGAGGGCCGGGAGCTCCTGGTCATCGAGCTGT CCGACAACCCTGGCGTCCATGAGCCTGGTAAGGGCGCTGCCCCTGA | 11242 |
| | 2 | MSLVRALPPDSPGGPEGGGRGWDWWRWGKEGGMGP GVPLGKRYLRWKVGSGGRDGNGEEPDLERQWPNFCFP VPSPQHQSHLPRP* | 11243 | ATGAGCCTGGTAAGGGCGCTGCCGCCTGACAGCCCTGGGGGCATCCGGAGGGGG CGGCAGAGGGTGGACTGGTGGCGTTGGGGAAGGAGGGAGGGATGGCCCAGGG GTGCCTCTTGGTAAAAGGTATCTAAGGTGAAGGTGGAAGTGGAGGAGGGATGG AAATGGGAAGAACCCGACTTAGAGCGCCAGTGGCCCCAATTTCTGCTTCCCGTCCC ATCCCCCAGCACCAATCCCATCCCCAGAACCTTAG | 11244 |
| | 3 | MEMGKNFT* | 11245 | ATGGAAATGGGGAAGAACCGACTTAG | 11246 |
| | 4 | MGGIAIQKKQILTHATPAVALTLLCEKPKGMIASPPQGG LVFLADKSRKIRCRRQ* | 11247 | ATGGGGATAGCAATACAGAAAAAACAAATCCTGACGCACGCAACCCCAGCGGT CGCTCTCACTTTGCTGTGTGAACAAAACCCAAGGAATGATTGCGAGCTCCCCGCAAGG GGGGTTGGGTCTTCCTTGCTGACAGAGTAGAAAGATAAGGTCAGAAGGCAGTGA | 11248 |
| hsa-mir-580 | 1 | MSAAGL* | 11249 | ATGTCAGCCGCTGGACTGTAG | 11250 |
| | 2 | MPLQP* | 11251 | ATGCCCTTGCAGCCTGA | 11252 |
| | 3 | MGINERTVFCNELYPCTQGASSKJAIWLLAVAQLATCVC VAA* | 11253 | ATGGGAATAAATGAAAGGACGTGTATTTGCAACGAGCTTTACCCGTGCACGCAGGG GGCCTCCAGCAAAGCCATTTGGTTGCTGGCTGTCGGTCAGCTGGCTACGTGTGTTTG CGTTGCGCGCCTAA | 11254 |
| | 4 | MKGLYFATSFTRARRGPPAKPFGCLLSLSWLRVFASPPK SELLSAYLC* | 11255 | ATGAAAGGACTGTATTTTGCAACGAGCTTTACCCGTGCACGCAGGGGCCTCCAGCA AAGCCATTTGGTTGCTGCTGTCGCTCAGCTGGCTACGTGTGTTTGCGTCGCCGCCT AAAAGCGAGCTGCTTTCAGCTACTCTGTCTGA | 11256 |
| | 5 | MVHTWVAASASPG3GV* | 11257 | ATGGTACACATGGGTGGCTGCTTCTGCATCCCAGGGAGCGGAGTCTGA | 11258 |
| hsa-mir-584 | 2 | MGGGFCIPRERSLTRGPCEFPRGPLACGLAKVDGPVEA QGPAGLEKLFSQRWGDDCAFWLPLLPPWYSVCHAGSV KREQSLEASIFS* | 11259 | ATGGGGTGGCTGCTTCTGCATCCCAGGGAGCGGAGTCTGACCGTGGGCCCAGGTGA GTTTCCCAGGGGGCCCTTGGCTGGTTGGCTTGGCCAAAGTGGATGGTCCAGTAGAGG CTCACGGACCTGCTGCCTCTCCTTGGTGGAAAACTTTTGTCATGCTGGCTCTGTAAA AAGGGAGCAAAGCCTGGAAGCCTGGAAGCATCTATTTTTCCTGA | 11260 |
| | 3 | MIVLSGCLSFLPG* | 11261 | ATGATTGTCTTCTGGCGTCTGCTTCCCTGGGTAA | 11262 |
| | 4 | MLAL* | 11263 | ATGCTGCTCTGTAA | 11264 |
| | 1 | MASSGEVLSATVSALLLPRPRPRSPWVLPSRPGFPCILSIP TPTPRPSHPDPGLAPAPVLPASCPQDSYPVSEGTSCLPL RSCIPDRQSCPRLSVP* | 11265 | ATGGCCAGCTCCGGAGAGGTACTGTCCGCAGACGTGTCCGCTCTGCTTCTGCCTCGG CGGCCTCGGCCTCGGTCCCGGGTTCCTCCATCCGACCGGGTTCCTTGCATCTTCTA TCCCGACCCGGCCTACCCGCGCATCTGTCCCAAGACTCCTACCCGTCTCGGAAGGCACAAGCTG CGTCCTTCCCGCCATCCTCCGCATCTGTCCGGTGCATTCCTGATCGCCAGAGTTGTCCCGTCTCCGGTCCCC TGA | 11266 |
| | 2 | MLSFSPSPLLPGACLLNDVGGG* | 11267 | ATGCTCAGTTTCAGCCCCAGCCCCACTTCTCCCTGGAGCCTGCTTGCTGAATGACGTG GGGGTGGGTGA | 11268 |
| hsa-mir-589 | 3 | MTWGVGJDGGKAISPFGLTTYPGILSQHSPNLGPMEKPA ASL* | 11269 | ATGACGTGGGGAGGTGGGTGATGAGGAAAAGCCATTTCACCTGAGGACTTACGAC GTACCCGGAATTCTTTCCAACACTCCCAAATCTGGTCGATGGAGAAGCCGGC CGCGTCCCCTGTAA | 11270 |

Figure 1 (Continued)

| | | | | |
|---|---|---|---|---|
| | 4 | MEEKPFHLRDLRRTLEFFPNTPQJWVRWRSPPRPCNVV QSIVSAERGAAGTLDSD* | 11271 | ATGGAGGAAAAGCCATTTCACCTGAGGGACTTACGACGTACCCTGGAATTCTTTCCC AACACTCCCAAATCTGGGTTCCGATGGAGAAGCCCGCGCCCGTCCCTGTAATGTGGTG CAAAGTATTGTCTGTCAGAAGCGGGTGCAGCGGGGACTCTAGACTCGACTAG | 11272 |
| hsa-mir-590 | 1 | MADHDTYDDRAYSSFGGGRG* | 11273 | ATGGCGGACTTCGACACCTACGACGATCGGGCCTACAGCAGCTTCGGCGGCGGCTAG AGGGTGA | 11274 |
| | 2 | MARSETGRRRLGSRGLACGADPPHCLPPTTCWFLPCL GRGGADARRRAPASSPIPPTVGPVRG* | 11275 | ATGGCGCGCTCGGACACGGGGCGGCGGCGCGCTGGCTCCGGCGTCTTGCTTGCGG GCGGATCCCTTCCACTGCCTCCGCCAACGACACCGTTGTTTTGCCCTGCCTT GGCGGCGGAGCGAGCGGCCATGCCGGAGCGAGCGCCGCTTCCAGCCGACCCATCCCC TACGGTAGGAGGACCAGTGCGGGGCTGA | 11276 |
| | 3 | MPGDERPLPAPSPLR* | 11277 | ATGCCCGGAGACGAGCCGCTTCCAGCCCATCCCCTACGGTAG | 11278 |
| | 4 | MVRLLAGGGRPRR* | 11279 | ATGGTACGACTCTTGCGGGAGGGAGACCAAGGAGATAA | 11280 |
| | 1 | MWTFVL* | 11281 | ATGTGGACTTTTGTTCTCTAA | 11282 |
| | 2 | MTYQRGK* | 11283 | ATGACGTACCAAAGAGGAAAATAG | 11284 |
| hsa-mir-594 | 3 | MLCERVVCRSPSGLMDKALAS* | 11285 | ATGTTGTGTGAAGCGCGTCGTTGCCAGAAGCCCAGTGGCTAATGGATAAGGCATTG GCCTCCTAA | 11286 |
| | 4 | MPTLLFFLNGKCVCVFTSWWAAIFENLHTPMSFV* | 11287 | ATGCCAACTTACTTTTTTTTTTAAATGGAAGTGTGTGTTTTACTAGCT GGTGGGCTGCAATTTTGAGAATCTGCACACCATGTCCTTGTCTGA | 11288 |
| | 1 | MNFSVETAPPQSLFKKQK* | 11289 | ATGAACTTCTCCGTCGAAACTGCTCCCCAGAGCCTGTTAAGAAGCAGAAATAA | 11290 |
| hsa-mir-607 | 2 | MPVDALTSKIFKGEVDTRY* | 11291 | ATGCCGGTGGATGCACTGACTCTAAGATTTCAAAGGTGAAGTGGATACACGTTAT TAA | 11292 |
| | 3 | MSKPLGHESP* | 11293 | ATGAGCAAGCCTCTTGAATAATTGAATCACCTTAA | 11294 |
| | 4 | MGNERRKGKEMGWKEKSRJDRPIPVGLVP* | 11295 | ATGGGAAACGCCGAAAGGAGAAATGGGTGGAAAGAAAAGCAGAA GAGATGCGCCTATACCAGTAGGCCTAGTACCTAG | 11296 |
| | 1 | MAQGREREGPHSAGGASLSVRCGVHGPATDLGLAEP PAPSPLLPPLPVP* | 11297 | ATGGCGCAAGGCGGGAGCGCGACGGAAGGCCCACTCCCGGCGGCGGCGTCTT GTCCGTGAGGTGCGGTGTTCACGGCCCGACCGATCTGGGTCTCGCGGAACCTCC TGCCCCAAGTGCCCTCTCCTCCTCCACCAGTGTCCTTCACTGCCTTTCCACCATCTTCA | 11298 |
| hsa-mir-609 | 2 | MSRGFSPNQCPSLAFSTIFKHTFNI* | 11299 | ATGTCTCGAGGTTCTCTCCAAACCAGTGTCCTTCACTGCCTTTCCACCATCTTCA AGCATAACTTTAATATTTAA | 11300 |
| | 3 | MFFLCASLSFTSTSRLLFSTPICIFKSKIWPHTLHLCK* | 11301 | ATGTTCTTTTTGTGTGCTAGCTTTCATTCAGTGACTTCATTCCTTTATTTCTAC GTTTATCTGTATTTTAAATCTAAAATATGGCACATACTCTTCATCTGTGTAAATAA | 11302 |
| | 4 | MATYSSSV* | 11303 | ATGGCCACATACTCTTCATCTGTGA | 11304 |
| | 1 | MVRALRGVPDGDARTPRGLTHTALRSSDAGDPREG* | 11305 | ATGGTGAGACGTCTCAGGGGAGTTCCAGACGGAGATGCGAGGACCCCTCGGGTCT GACCACACCGCGCTTATCTCTCAGACCGCGAGATCAGAGGCTAG | 11306 |
| hsa-mir-611 | 2 | MRGPLGV* | 11307 | ATGCGAGGACCCCTCGGGGTCTGA | 11308 |
| | 3 | MNSLGFSARDF* | 11309 | ATGAACTCCTTAGGTTCTCAGCTCGCGATTCTAA | 11310 |
| | 4 | MPWANVYW* | 11311 | ATGCCCTGGGCAAATGTTTATTGGTGA | 11312 |
| | 1 | MRVKKGRGHVRDTYWVVGVVGNAG* | 11313 | ATGAGGGTGAAGAAGGGGAGGGGTTGGTTAGAGATACAGTGGTGGTGGGGG TGGTAGGAAATGCAGGTGA | 11314 |
| hsa-mir-612 | 2 | MQVEGNSLGLWGI* | 11315 | ATGCAGGTTGAAGGGAATTCTCTGGGCTTTGGGAATTTAG | 11316 |
| | 3 | MPSHRQGKCLYQLPPGGQDSLFQRVVLFGYWVLSSEL VT* | 11317 | ATGCCATCTCACAGGCAGGGAAATGTCTTTACCAGTTCCTCCTGGTGGCCAAGAC AGCCTGTTTCAGAGAGGTTGTTTTGTTTGGGGTGTTATCAAGTGAATTAGTC ACTTGA | 11318 |

Figure 1 (Continued)

| | | | | |
|---|---|---|---|---|
| | 4 | MSLPASSWWPRQPVSEEGCFVWGVGVIK* | 11319 | ATGTCTTTACCAGCTTCCTCCTGGTGGCCAAGACAGCCTGTTTCAGAGGGTTGTTTT GTTTGGGGTGTGGGTGTTATCAAGTGA | 11320 |
| hsa-mir-616 | 1 | MLKMSGWQRQSQNQSWNLRREASTDSHLPFTLPSPQS WGIVRSLGSASLLHSEVRDRPREEWGESLILGWCLQTPH ASDDGVSPPLPGAGTRALLCAAGQRDLGCPWEIHSFP* | 11321 | ATGTTAAAGATGAGCGGATGGTGGAGACAGAGCAAGACAGGCAAAATCAGAGCTGGAACCTGAG GGGGCGTCCGCTCTTTAGGATGGGCCATCCAATTCCTCCGTCTCCCGTCTCCCTCAAAGTTG GAGAGGAGGAATGGGGAGAGTCCCTTATTCTGGGGTGGTGCTTACAAACCCTATTG CTTCGGACGACGGCGTCTCCACCCGTCCTCCACCCGTGCCCTGCCCTGGAGCCGGAACACGGCGCCTGCTCT GTGCTGCTGGCAAGGGACCTGGTTGCCTGGGAAATTCATTCTTTCCGGTAG | 11322 |
| | 2 | MGRVPYSGVVLTNPYCFGRRRLSTPARSRNTGPALCCW AKGPRLPLGNSFFPVANPRPHR* | 11323 | ATGGGGAGAGTCCCTTATTCTGGGGTGGTTGTTACAAACCCTATTGCTTCGGACGA CGGCGTCTCCACCCGTCCTCCACCCGTGCCCGGAGCCGGAACACGGCGCCTGCTGCTGG GCAAAGGGACCTCGTTGCCCTTGGGAATTCATTCTTTCCGGTAGCCAACTTCAGG CCTCATCGTTAG | 11324 |
| | 3 | MATLVAGATGRPCSG* | 11325 | ATGGCCACTTGGTAGCTGGGGCTACTGACCCTGCAGCGGATAG | 11326 |
| | 4 | MBREWCVFLLP* | 11327 | ATGACAGGACAGTGGAGTGGTGTGTTTCCTTTGCCGTAG | 11328 |
| hsa-mir-618 | 1 | MLKPSVTSAPTADMATLTVVQPLTLDRGKGAARSPGH RVPSPLLPSPPANSQRDMGRAQAGGEGERGRARKAFAP RTEHFPLSLPATFPLPLPTVLAPPRGRLLLALGSPLPLPA PRRVVSGFPLALLEFPLRGDYTRRQGLGVGEGQRASSPGQ SPEETGBEGAACQLAWRRGPGGRKFVQAPEGEGRSNCW SPGGHSGGGLGAPLGCRAHSGGAAAGREEPSAEFARQS ACGSRAPAAEHGSPRLRDRKRRGSRLLPPPAAPGR* | 11329 | ATGCTGAAGCCGAGCGTCACTTCGGCTCCCACGGCAGACATGGCAGATTGACAGT GGTCCAGCGCTCACCGTGACAGAGGTAAGGGAGGCTCTGCCTCGCCAGGCCACC GCGCTCCAGGCGAGCCTCCTCCTCCCCGCCAATTCCAACGGGACATGGGAC GCGCTCCAGGACAGAGGAGAGAAAGGGAGCAGGGAACGAGGACCAGGGCGTTGCCGCC GAGAACAGAACACTTCTCCCTCCGCCGCTACGTTCCGCTCCGCTGCCTCCC ACTGTACTCACCCCCTCGCCGGGCTCTCGCCTCTGGCTCTGGGTGTGTCGCCA CTCCCAGCGCTCCAGGCCTATAGGCGCCAGGGCTCGGGGTTGGAGGGCAGAGGAACAAGCT GGGGGACGGCTATAGGCGCCAGGGCTCGGGGTTGGAGGGCAGAGAGGCAAGCT CGGGGAACCGAGAGCCCGGGGAGCGCCCAGAGCAGCCGGGAACGAGGCGCACCCTGGGT CGCGGGCGCACAGTGGCGGGCGAGCCCAGCAGCCCCAGAGAATCCCTTGG CCAACTGCTGCAAGGTCCGGCCACTCGGGGAGTGGCCGAGTGGCGCACCCTGGGT TGCCGGGGCCACAGTGGCGGGCGAGCCCAGCAGCCCCAGCAGCCCCCTGCCGAAAGG TTCGAGATCGAAAGCGCGAGGCGGGAGGGTCCGCAGCCGAGATCGGCGTCGCGGC CGATAG | 11330 |
| | 2 | MESSAAKGASLVHPCGVIPYPECVGFLPGSSVQ* | 11331 | ATGGAGTCCTCCGCTGCGATCGGGCCTCACTGGTGCACCCTGTGGGGTTATACCT GTCCCTGAGTGTGGAGGCCTTCCTTGCCTGGCTCCAGCGTCCAGTGA | 11332 |
| | 3 | MKALESYGSAEEDHL* | 11333 | ATGAAGGCTCGAGTTCTACGGCTCCAGAGGAGGACACCCTAG | 11334 |
| | 4 | MVYSEENDLVRCTSKNFLSRGLN* | 11335 | ATGGTGTACTCAGAAGAAATGATTTAGTCGATGTACCTCTAAAATTTCTTTCT AGAGGATTAAACTGA | 11336 |
| hsa-mir-619 | 1 | MALYTLQRSPTPSAASSSASNSEVSPGLAAPGLGRRTPR RGRRSWGRACGGAGGGRLRGLLGAPP* | 11337 | ATGGCCCTGGTGACCCTGCAGCGGTCGCCCACGCCCAGCGCGCCCTCCTCTCGGCC AGCAACGAGCAGTGAGCCCGGGTCGCCGGTCGGGGCCGCGGCCCGGACGCC GCGCCGAGGGGCGCCGGGAGTCGCCGCTCGGGGCAGGGGGGGGCTGCGC GGGCTCCTCCGGGGCCCGCCGTAG | 11338 |
| | 2 | MQCDPSGSVCRILCVRCDPHQGVTPILG* | 11339 | ATGCAGTGCGACCCCTCTGGGAGTGTCTGCAGGATACTGTGTGTGCGCTGTGACCCA CATCAGGGGGTTACCCCCATCTTGGGGTGA | 11340 |
| | 3 | MCNWDP* | 11341 | ATGTGCAACTGGGACCCTTGA | 11342 |
| | 4 | MPGCAM* | 11343 | ATGCCTGGCTGTGCGATGTGA | 11344 |
| | 1 | MEEGL* | 11345 | ATGGAGGAGGGGATTGTAA | 11346 |
| | 2 | MAAAGSSLL* | 11347 | ATGGCGGCAGCCGGCAGCTCGCTGCTCTGA | 11348 |

Figure 1 (Continued)

| | | | | |
|---|---|---|---|---|
| hsa-mir-624 | 3 | MDELAGGGGKGPGMAAPPRQQGPGGNLLGLSPGGNG AGGGGPPASEGAGPAAGPELSRPQQYTPGILHYIQHE WARFEMERAHWEVERAELQVPRWGRCAGAAAAGFPA GGWGWGLHSAGAGALGGRAEPTCAAQVVMVLSTAFP GVPLPLSRISLLPNLHWLRGAGLLGAAILAFSMASAGAP PEAAFPGLRGLGPSTSLWESPVWGLSTLSLLLFVPLEMK SPKRGTRIGHLPPFSGPPPFPIWRIWPPPSDLVRACPLTAT LLSWAARVHSDLGLTCEVLFPIVNFKYFLT* | 11349 | ATGGACGAGCTTGCCGGAGGCGGTGGTGGCGGCCCGGGATGGCGGCCCCTCCCCG GCAGCAGCAGGGACCTGGGGGAACCTGGGGGAACCGGGAACGGAGCG GGGGGCGGCGGGGGTCCTCCGGTACTACTATCCCGGGAT... | 11350 |
| | 4 | MLPYSLGFSVVIPYLVTHQRFQH* | 11351 | ATGTGCCTTACTCACTTGGATTCTCTGTAGTTATTCCTTACTTAGTGACTCATCAAC GCTTTCAGCACTGA | 11352 |
| hsa-mir-627 | 1 | MAVLLKGL* | 11353 | ATGGCTGTGTTGTTGAAGGKCCTGTAG | 11354 |
| | 2 | MHDAFEPVPILEKLPLQIDCLAAWGEPRCRGAEAESAQ ERSCGSFLRPGKWTGVHPCGLRLDATREGLRMREGREM TTGYRHRCLWGYLGDPSDPVI* | 11355 | ATGCACGACGCTTTCGAGCCAGTGCCGATCCTAGAAAAGCTGCCTCTGCAAATCGAC TGTTGCTGCTGCCTGGGGTGAGCCGAGCCGAGGGCCGAGGCGAGTCAGCACA... | 11356 |
| | 3 | MLHERGLG* | 11357 | ATGTCTACACGAGAGGGCGTTAGGATGA | 11358 |
| | 4 | MSVGLLG* | 11359 | ATGTCTGTGGGCTACTTGGGTGA | 11360 |
| hsa-mir-629 | 1 | MGAPLPTGRDGAPPLRPVGELRNLLGRFWAEGGLFWL GAVGEGPGPL* | 11361 | ATGGGAGCCCCGCTGCCGACGGGCGAGAGATGGGGCCCCCCCTCCGCGCCCCGTCGG AGAGCTGAGAACTTGCTGGGAAGTTCTGGCTGAGGGTGGCCTCTTTTGGTTGG GCGCCGTTGGGGAGGGGCGTGGGGCCGGCTCTGA | 11362 |
| | 2 | MGRPPSAPSES* | 11363 | ATGGGCCGCCCCGCGCCCCTCCCGCCGTCGAGAGCTGA | 11364 |
| | 3 | MPPPPLSCLRGLQAPHQPGQPGFKFTVAESCDRIKDEF QFLQAQYHR* | 11365 | ATGCCCCCCCCGCCCTCCCTGTCTTCGCGGGCTCCAGGCTCCCATCAACCGG GGCAGCCGGGGATTTAAATTCACGGTGGCTGAGTCTTGTGACAGGATCAAAGACGAA TTTCAGTTCCTGCAAGCTCAGTATCACAGGTAA | 11366 |
| | 4 | MGAPPGGCQESGKVALEALGSGPQRRLSRRHA* | 11367 | ATGGGGGCGCCCCCGGGGGGTGTCAGGAAGCACTGACGGCACGCTGAGCGGGTGGAGAA TGGGTCGGGCCTCAGAGGAGGCTGTCCAGGCGCCACGCTGA | 11368 |
| | 1 | MAAAPALKHWRTLERVEKFVSPLYFTDCNLRGRCGP WSPAAGRPQPCASSFPSGEKPKLQPPGPPIDKVPAAGRA GAGEEGVGNGLCRGAARQPSWRRIQGKCGPTGQLAPR RKRGGLQHVPTGPSHAGFLGPAALWLCSPAS* | 11369 | ATGGCGGCTGCGCCGGCGCTCTAGTTTACGACTGTAACCTCGCACCACGCTGAGCGGGTGGAGAA GTCCCCGCCAGCGCCGCAGCGACGCCGCCAACCTGCCGCTGCAAGTGCCGGGGGCTCGCTGCAGGGAAGAA ACCTAAGCTGCAGGGAGGACGCGAGCACCCGGGCGGCCTGGGGAATGACTGCTCCGCGGACGGCAGCC CTCTTGGCGGAGGATCCAGGAAGTGCCGGGAAAGTGCCGGATGCCACCGCGCGCCGCTGGCCTGAGGCC GGAAACGGGCGGCCTGCCAGCATGTGCCACCGCCGCTGGGCTGTGCTCTGTGCTCCAGCTTTTG GGGCCAGCTGCCTGTGGCTGTCGTCTGTGCTCTCCAGCTTCCTGA | 11370 |

Figure 1 (Continued)

| | | | | | |
|---|---|---|---|---|---|
| hsa-mir-631 | 2 | MDCAAERPGSPLGGGSRESAAPPASWPPGGNGAAASSMCPPARPTQAFWGQLPCGCALQLPDAGETSLPGGSPAGLPPRAGRRQLRTHAVGNAQRVGGATGLGEVPTQLPATPSLSALCRRQLRGHEQHPLLGAAPSAGNSSLVPGSSGDGFHSHVAASGHPLGRAP* | 11371 | ATGGACTGTGCCGCGGAGGCGGTCAGGAGCGGCTCAGGAGGATCCAGGGAAAGTGCGGCCCCACCGGCCCGTGCCACCGGCCAGTTGGCCCAGGGTGGCGAAACGGRGGCGCCTCCAGCATGTGCCCACCGGCCCGTCGACGCGGAGAGACTTCCCTACCAGGAGGACTTCAGGGACTTCTCCAAGCTTCCTGACGCGGAGAGACTTCCCTACCAGGAGGACAGTTCAGGGACTTCCCCCGCCAGGTCGCGACAGCTTCGGACCACAGTTCGGACCCAGTTAACGCCCAGGGGTGGGCGGGCCACAGGCCTAGGGAGGTCCAACCAGCTCCAGCTCCAGCCACACCTCGTTGCTGCCCCTCGCCGTAGACAACTACGTGGGATCGGACAGCAGCACCCTCTGCTGGACGCACCACCCTGCTGCCGCCGCCCCCTCGCCGTGCGCCCCTCTTCTAGGAAGGGCACCCTAG | 11372 |
| | 3 | MVFIPTWPPLDIP* | 11373 | ATGGTTTTCATTCCACGTGGCCGCCTCTGGACATCCCTAG | 11374 |
| | 4 | MLGEFQAPADTLSKEEGYQDRKTSTSRPITTALLQMVDLLVPGGADHPRGMGGPGSSPLLGK* | 11375 | ATGCTTGGAGAGTTTCAAGCCTCCGACACTTTATCCAAGGAAGGATATCAGGATAGGACTTCTACCTCTAGGCTATCACAACAGCTCTCTTGCAGATGGTGGACCTGCTGGTTCCGGTGAGCTGAGTCGACCATCCAGAGGCATGGGTGGGCCAGGAAGTTCACCTTTGCTGGGAAAGTGA | 11376 |
| hsa-mir-632 | 1 | MAATSSRLLVPPTQGGGLRHVTLPPLAPPPTAVLDGRRSGERGRRPFCVCHLWDVVVAVGLGK* | 11377 | ATGGCTGCCACCTCTCGCGCCTCTAGTCCCACCCACTCAGGCGGAGGTCTGCGTCATGTGACCCTCCCCTTTGGCCTCGCGCCTCTACCGCAGTGCTTGACGGAGGCGGAGCGGGAACGAGGCCGTCGGCCATTTGTGTCTGCTTCTGTGGGACGTGGTGGTAGCCGTTGGGTTTGGGAAAGTGA | 11378 |
| | 2 | MGRKKKKQLKPWCWYPLSV* | 11379 | ATGGGTCGCAAGAAGAAGAAGCAGCTGAAGCCGTGGTGCTGGTATCCTTTGTCGT TTGA | 11380 |
| | 3 | MGFRGRQAFAVYGRVTL* | 11381 | ATGGGGTTCCGAGGTCGCAAGCTTCACAGTCTGTCACCCACTTTCTGTTTATTACTTGA | 11382 |
| | 4 | MEGWGQLHSLSPTFSVFIYFMCVLCLFFRIGGLVKMQVSQPWFRTFFFFFSGREEN* | 11383 | ATGGAGGGTTGGGGACAGCTTCACAGTCTGTCACCCACTTTCTGTTTATTACTTTATGTGTTTGTTTGTTTATTTTCGAATTGCGGTTAGTAAGAACCAAGTAGTCAACCCTGGTTTCGAACCTTTTTTTTTTCGGGCGGGAGGAAACTAG | 11384 |
| hsa-mir-634 | 1 | MLSSGREVPFGGCILKLCHTGLRPHLQGLR* | 11385 | ATGCTTCTTCTGCGAGAAGTCCCTTTGGGGGGTGCATTTGAAGCTCTGCCACACTGCGCCTCAGACTTCATTTGCAAATTGGCCTGAGGTGA | 11386 |
| | 2 | MHTFRSPSSLLKTVMAGPGGSHL* | 11387 | ATGCATATTTCAGGTCTCCATCATCTCTATTAAAACGGTGATGCGTGGGCCCGGTGGCTCACACCTGTAA | 11388 |
| | 3 | MQKKISR VVWWRAPVVPATREEAEAGEWREPGRRSLQ* | 11389 | ATGCAAAAAAAATTAGCCGAGTGTGGTGGCGGGCGCCTGTAGTCCCAGCTACTCGGGAGGCTGAGGCAGGAGAATGGCGTGAACCCGGGAGGCGGAGCTTGCAGTGA | 11390 |
| | 4 | MTKSRLQKMQK* | 11391 | ATGACAAAATCCCGTCTACAAAGATGCAAAATGA | 11392 |
| hsa-mir-637 | 1 | MSTPRQEDVEDHYEMGEELCR* | 11393 | ATGTCCACGTCAGGCAGGAGGATGTGGAGCGTGGAGGACCATTATGAGATGGGGAGGAGCTGGGCAGGTGA | 11394 |
| | 2 | MRWGRSWAGELSARTAGLQG* | 11395 | ATGAGATGGGGGAGGAGCTGGGCAGCTGTCTGCCCGCAGGCTGGGCTCCAGGGATAG | 11396 |
| | 3 | MLRRNESVSCGGGTNLGRGVRQPRL* | 11397 | ATGCTGAGAAGGAATGAGTCAGTATCATGCGGTGGGGGAACGAATTTGGGCCGTGGAGTCAGACAGCCCGGCTGTGA | 11398 |
| | 4 | MSQYHAVGERIWAVESIDSPGCEFLLGNPLCVSCGEKSN* | 11399 | ATGAGTCAGTATCATGCGGTGGGAGAACGAATTTGGCCGTGGAGTCAGATAGACAGCCCGGGCTGTGAATTCCCTGCTGTTCCTGTGTTTCCTGTGTGGGAGAAAAGTAATTGA | 11400 |
| | | MVKPLLFSPSYRRSAPFDWSRKLLGQSPGASPSLGSDRPQGAGANVGASCPDWPTGRARPGGAGRTQSRV* | 11401 | ATGGTCAAGCCCCTTCTCTTTAGCCTCCTACAGGCGTTCCGCCCCCCTTCGATTGGTCTCGCAAGTTGATTGGTCAATCCCTGGTGTCAGTCCTAGTCCCTGTGCCCGTCCTAGTCTTGGTTCGGACCGGCCCAAGGAGCAGGGGCGAACGTGGGGCGAACGTGGGGCCGGGGCGGAGGGCCTGAGGGCGCTGGAGGGCCGGGGCGCGGGAGCCGCAGAGCCGGCGTTTAG | 11402 |

Figure 1 (Continued)

| | | | | | |
|---|---|---|---|---|---|
| hsa-mir-639 | 2 | MKHYEVRSEKQGPCGHC* | 11403 | ATGAAGCATTACGAGGTAAGAAGCGAGAAACACGGGCCGTGGCCACTGCTGA | 11404 |
| | 3 | MRMCAGSIYKSATQAVLGVLPLGGLCRGWDACRFLAAPPAG* | 11405 | ATGCGCATGTGCGCAGGAAGTATTTATAAATCTGCAACCCAGGTGTTTGGGGTACTTTTCTTGGGGTCTCTGCAGGGTCTGCAGCCCTGGGACGCTTGCAGGTTCCTTGCAGCTCCCCCAGCGGGCTGA | 11406 |
| | 4 | MGATKVRDPCSQSEGVLHKSCATPPSPA* | 11407 | ATGGGAGCCACGAAGGTGCGAGACCCTTCTCCCAATCCGAGGGAGTCTTGCACAAATCTTGCGCCACGGCCGTCACCAGCGTAG | 11408 |
| | 1 | MGGIRAPPERLGGCR* | 11409 | ATGGGCGGTCGTAGAGCCCCGGAGCGCCTGGGCGGCTGCCGCTGA | 11410 |
| | 2 | MVASGPPAVPRWAVPPVPGGGTAALLEPLLQELSGGGRAGAVGPASGGRGGGGGPYH* | 11411 | ATGGTTCGCGTCCCGGGCCCCGCCGCCCCGTGGCCGATGGGTCCTGGCCGATGGGGTCTTCAGGAGCTCCTTGGGGGGTGGCGCAACGCGGGGACCGCGCGGTGGGCGGCGGGGGCCATACCACGGGGGAGCCCTCGAGCCCCTCCTCACCGGGGAGCCCTCGAGCCCCTCCTCGGGGGGCCGGCGGGGGGCCATACCACTGA | 11412 |
| hsa-mir-641 | 3 | MGCTTRARRGDRGPRAPPSGAEWGWPSGGGTSLGGPGRWRRAIPLRRWGERCKPAGRGAQAAACAGRGLDLSGAAGRSSLACAG* | 11413 | ATGGGCTGTACCACCCGTGCCCGGCGGGGGGACCGCGCCCCTGAGCCCTCCTCAGGGGGGGGCCGGGCCGGGGTGGCGGCGGCGGGGACCAGCTCGGGGCCGGGGGAGCTGAGGAGCGGTGCAAGTTTGCGGACGGGGAGCGCAGGCGCCATACCACTGAGGCGTGCGGGGGCTGAGCCTGGACCTTTCGGGCGCGGCGGGGCAGATCAGAGCCTGGCGTGCGCGGGCTAA | 11414 |
| | 4 | MLPQLWLGYITTALGEPCLERRGTQIRGL* | 11415 | ATGCTTCCCAACTGTGGCTGGGTTATATCACCGCGTTGGGGGAGCCCTGCTTAGAACGTAGGGAACCCAAATCAGAGGACTGTGA | 11416 |
| | 1 | MSLSACFHLWLAAR* | 11417 | ATGTCTCTGTCTGCGTGTTTCCATCTCTGGTTAGCTGCTAGATAA | 11418 |
| | 2 | MLGKGCSTYSGLYLPAGKVL* | 11419 | ATGCTGGGAAAGGGTTGTTCCACTTACTCTGGGCTTTATCTACCCCAGCGGGGAAAGTTTTGTAA | 11420 |
| hsa-mir-642 | 3 | MCARKPEGLGEWELGWAFQVLHQAVGTQMGVSSTPLGGTENLQVFQFPIEKGSRLTVSTPSSPRRSPSGSQESVGPDFGDTDTSAQRSSRATARSANTPPFHLCCPNNSQGRPGNHLRGPAHHRSSTHSACLSLPPDHHAWELRERVRCLGVPRVYGSPAVCPCV* | 11421 | ATGTGTGCTAGAAAACCCTTGGGCTTGGAGATGGGAGCTCGATGGCGTTTCAAGTACCCACTAGGGCGGAGTTCTCAAGGGATGGCGTTCCAGGAGTCTGATGGGACTTTCAGGTCCCATAGAAAGGGTCTAGGCTCGACGGTCTTCGGTGACACTGACACTTCGCTCGACACTTCGCTGTAGTCAGACTTCGGTGACACTGACACTTCGCTGCCCCAGCGTCTCGGTCAACACCAGTCAGGGAGGCCGGGAACTTAAGGGGCCGCCGGAGTTGCCACCACCGGAGTTGCACCACTCGGCGTCCTCCCTCCGCCAGATCATCACGCTGGGAGTTGCGGAGGTCGCTCGCTGGAGTCCCGGGTGTATACGGGGGTACTGA | 11422 |
| | 4 | MGVSSSPPGCGNSDGRFKYPTRGY* | 11423 | ATGGGGTTTCAAGTCTCCACCAGGCTGTGGGAACTCAGATGGGCGTTTCAAGTACCCCACTAGGGGGTACTGA | 11424 |
| | 1 | MAWRYGATAAREFSFV* | 11425 | ATGGCGTGAGATATGGCGAACTGCGGCGTGAGTTTCCTTGTTTAG | 11426 |
| hsa-mir-643 | 2 | MAQLRRVSPPLFRLSVRLAVPSRFCTRDVGGGTDLEIPAPLSPPRVNSCVPSEC* | 11427 | ATGGCGCAACTGCGGCGGGTCTCTACCCCGGAGTTTCGTTGTTTAGATTAAGTGTCGCTTAGCGTGGCCCTCACGCTCTGTACCCCGGAGTGTGGGGCGGTACAGACCTTGAAATCCCCGCACCGCTCTCTCCACCCGAGTAACTTGAAATCATGCGTCCGTCAGAGTGTAA | 11428 |
| | 3 | MWGAVQTLKSPHRSLHPE* | 11429 | ATGTGGGGAGCGGTACAGACCTTGAAATCCCGCACCGCTCTCTCCACCCGAGTAA | 11430 |
| | 4 | MRPVRYLKSP* | 11431 | ATGCGTCCGTCAGAGTGTTAAATCGCCTAG | 11432 |
| | 1 | MRMNWVLS* | 11433 | ATGAGGATGAACTGGGTTTAAGTGA | 11434 |
| hsa-mir-648 | 2 | MPPIPYLIARCTSQVRNPAPDCSSLIVSFSCAPGLEVLNLPYSVPMSLS* | 11435 | ATGCCGTTCATTCCATATTTGATTGCCAGATGTACTTCTCAGTTGCAGAAATCCAGCCCCAGATTGTTCAAGTCTTATAGTGAGTTTCTTGTGCTCCAGGTTTAGAAGTTTTAAATCTCTTTTATAGTGTATTCAACAGCTTGAGTTAA | 11436 |
| | 3 | MYFSGQKSSPRLFKSYSEFFLCSREFSFKSLL* | 11437 | ATGTACTTCTCAGGTACGAAAATCCAGCCCCAGATTGTTCAAGTCTTATAGTGAGTTT | 11438 |
| | 4 | MVCVFLL* | 11439 | ATGGTTTGTGTTCCTCGTAA | 11440 |

Figure 1 (Continued)

| | | | | | |
|---|---|---|---|---|---|
| hsa-mir-657 | 1 | MPGWILQLRGFSGKQRPLLSRDPGS* | 11441 | ATGCCCGGATGGATCCTGCAGCTCCGGTGGCTTTTCTGGGAAGCAGCGGCCCCTGCTCTCAAGAGACCCTGGCTCCTGA | 11442 |
| | 2 | MDPAAPWLFWEAAAPALKRPWLLMVAPRLPAGARDSGQFPRKGQAGSPSRGRVRKLGGAEATLGP* | 11443 | ATGGATCCTGCAGCTCCGGTGCTGATGGTGGCCCAAGGTTGCCAGCTGCCAGGGACTCAGGACAGTTTCCCAGAAAAGGCCAAGCGGCCACGCCTCCAGGGCCGGGTGAGGAAGCTGGGGGGTGCGGAGGCCACACTGGGTCCCTGA | 11444 |
| | 3 | MAFP* | 11445 | ATGGCCTTCCCCTGA | 11446 |
| | 4 | MSGRGTCGGEVSCPGGRRGAGGRRVRPGSRGRWRSSRG* | 11447 | ATGAGTGGACGGGGCACAGGAGGAGAAGTCCTGTCCTGGGGCCGGGTGGGGCGGTGTGGGAGAAGAGTAAGGCCTGGAAGCCGGTGAGGCGGAGCAGCCGTGGGTGA | 11448 |
| hsa-mir-658 | 1 | MSGPRLRPEAGSSAPLGPAGKPEAFPRPLAI* | 11449 | ATGAGCGGCCCGCGCCTGCGCCTCCTGAGGCCGGAAGTTCAGCCCCACTCGGGCCTGCCGGGAAACCGGAAGCCTTTCGAGGCCCTCTGGCCATCTGA | 11450 |
| | 2 | MEKPRLY* | 11451 | ATGGAGAAACCCGTCTACTAA | 11452 |
| | 3 | MPVIPATREAEAGESLEPGRRRLR* | 11453 | ATGCCTGTAATTCCAGCTACTCGGGAGGCTGAGGCAGGAGAGTCGCTTGAACCGGGAGGCGGAGGTTGCGGTGA | 11454 |
| | 4 | MLHKRWPASRVKEDSDTGA* | 11455 | ATGCTACACAAAAGATGGCCGGCTTCTCGCGTGAAGGAAGATTCGGATACGGGGCCTGA | 11456 |
| hsa-mir-659 | 1 | MSGPRLRPEAGSSAPLGPAGKPEAFPRPLAI* | 11457 | ATGAGCGGCCCGCGCCTGCGCCTCCTGAGGCCGGAAGTTCAGCCCCACTCGGGCCTGCCGGGAAACCGGAAGCCTTTCGAGGCCCTCTGGCCATCTGA | 11458 |
| | 2 | MEKPRLY* | 11459 | ATGGAGAAACCCGTCTTACTAA | 11460 |
| | 3 | MPVIPATREAEAGESLEPGRRRLR* | 11461 | ATGCCTGTAATTCCAGCTACTCGGGAGGCTGAGGCAGGAGAGTCGCTTGAACCGGGAGGCGGAGGTTGCGGTGA | 11462 |
| | 4 | MLHKRWPASRVKEDSDTGA* | 11463 | ATGCTACACAAAAGATGGCCGGCTTCTCGCGTGAAGGAAGATTCGGATACGGGGCCTGA | 11464 |
| hsa-mir-661 | 1 | MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASHLQRYRRPVAMVMPARRTPHVQAVQGPLGSPPKRGPLPTEEQRVYRRKELEEVSPETPVVPATTQRTLARPGPEPAPATGQLHPDPKS* | 11465 | ATGGTGGCCGGCATGCTCATGCCCAGGGACCAGCTGCGGGCCATCTATGAGGTGCTCTTCCGCGAGGGCGTGATGGTGGCCAAGAAGGACCGCCGCCCCAGGTCGCTGCACCCCCATGTGCCCGGGGTCACCAACCTGCAGGTCATGCGCGCCATGGCCTCGCTGCGGGCACGGGGCCTGGTCCGCGAGACCTTTGCCTGGTGCCACTTTTACTGGTACCTCACCAATGAAGGCATCGCCCACCTGCGCCAGTACCTGCACCTGCCGCCAGAGATCGTGCCCGCCTCTCAGCGCGTGCGGCGCCCCGTCGCCATGGTGATGCCCGCACGGCCCACCCCACGTGCAGGTCAGGGCCCGCTGGGCTCCCCACCAAAGCGGGGCCCGCTGCCAACGGAGGAGCAGCGGGTCTACCGCCGCAAGGAGCTTGAGGAGGTTCACTGAGACCCCTGTGGTGCCTGCTACCACCCAGCGGACCCTGGCCAGGCCAGGCCCGGAGCCTGCCCCAGCCACCCGCACCGCAGGGCAACTGCACCCCGACCCCAAGTCATGA | 11466 |
| | 2 | MRCSSARA* | 11467 | ATGAGGTGCTCTTCCGCGAGGCGTGA | 11468 |
| | 3 | MCPASPTCRSCVPWRPCGHGAWSARPLPGATFTGTSPMKASPTSASTCTCRQRSCPPLCSACAAPSPW* | 11469 | ATGTGCCCGGCGTCACCAACCTGCAGGTCATGCGCGCCATGGCCTCGCTGCGGGCACGGGGCCTGGTCCGCGAGACCTTTGCCTGGTGCCACTTTTACTGGTACCTCACCAATGAAGGCATCGCCCACCTGCGCCAGTACCTGCACCTGCCGCCAGAGATCGTGCCCGCCATGA | 11470 |
| | 4 | MMGGK* | 11471 | ATGATGGGTGGCAAGTAG | 11472 |
| | 1 | MSWSYVALGTRDLVEERRPVRGEGRAAALFV* | 11473 | ATGAGCTGGAGCTATGTGGCACTGGGAACTAGGGACCTGGTGGAGGAAAGGAGGCCGGTGCGGGGAGAAGGTCGCGCCGCTCTCTTTGTGTGA | 11474 |

Figure 1 (Continued)

| | | Protein | | Nucleotide | |
|---|---|---|---|---|---|
| hsa-mir-7-1 | 2 | MWHWELGTSWRKGGRCGEKVAPPLSLCEPRLTLGLPA RGRSWSGGDGTVRAASMALSRAVGGGCGG* | 11475 | ATGTGGCACTGGGAACTAGGGACCTCTGGAGGAAGAGGCCGTGCGGGAGA AGGTCGCGCCGCCCGCTCTGTGAGCCCCGCTCACCTTGGGTCTCCGGCC GGGGTCGGAGCTGGAGCGGCGGGGATGGAAGCGGTCAGGGTGCTCGATGGCTTTG TCTCGGGCAGTGGGGGGAGGAGTGCGGGGATGA | 11476 |
| | 3 | MERSGLPRWLCLGQWGHEDAGDETSGPRGGWGRGSAL GSA* | 11477 | ATGGAACGGTCAGGGCTGCTGCTCGATGGCTTGTCTCGGCAGTGGARGGAGGATGC GGGGGGATGAGACCTCGGGAACCGCGTGATGGGGCGGAGGGGTCGGCGCTCGGC TCCGCCTAG | 11478 |
| | 4 | MRGGMRPRDRVVGGGGRRSAPPSST* | 11479 | ATGCGGGGGATGAGACCCCGGGACCGCGTGGTGGGTGGGGCGGAGGGGTCGGCT CGGCTCTCGCCTAGTAGCACGTAG | 11480 |
| | 1 | MGTLPDLFPGGVSAVSFSP* | 11481 | ATGGGTACTCTCCCGGATCTCTCCCGGTGGGGTCTCTGCTGTTCCTTCCTGA | 11482 |
| | 2 | MRPRSSREGQWRPGEAGEASAWVAAVPPCGTKSPRVP STWDQRNSCSWPEWESGKWGTRMFLGGLDRGQLPDFDA TGHRVLSTPFSVSVSVSPCLRFLLLFCLGLHFSLRPPFQ LRSCPFPPTPADGRPGSCGJAGGGGGRCEAAWKRRRQQ PGGGVGCYLWLSSCMSGVESS* | 11483 | ATGCGCCCCTCGATCTTCCAGAGAAGGCAGTGGAGACCCCGGCGAGCTGGGAGGC CTCTGCCTGGGTCGCTGCATTCTTCCGGGTGCACGAAAAGCCGGCGTCCTTC CACCTGGACCAGCGGAACTCGCCCTCTGCCCGAATGGAGAGCGGGGAAATGG GCACCAGAGAACTTTTGGTCTGGATCGGGGTCAACTCCCGACTCGAGCGCACGG TCATCGCGCCTTCCACGCCTTTTGCGTCTCTGGTCTGTATCTCCGTGTCT GAGGTTTTGTTTTGTTTGCCTGGACTTCATTTCTCTCTTCACCCCACCAAC TCCACPTCCTGCCCTCCCTCTCCACTCCGCTGACGCGACGGGAAGCTGCGAG GTGCTGGCGGCGGCGGCGGCGGACGGAAGAGGCGGCGACAGCAGCC AGGAGCGGGGGTTGGTTGTTATCTTTGGTTATCTAGCTGTATAAGTGTGGAGTC TTCATATA | 11484 |
| hsa-mir-9-1 | 2 | MGEREMGHQKLFGSGSGSTPRLRRHGSSRPFHAFFGLC RVCISVSEVPVVVLSRTSPLSSPSPSTPLVSLPSYSR* | 11485 | ATGGGAGAGCGGGGAAATGGGGCACCAGAAACTTTTTGGGTCTGGATCTGGGGTCAAC TCCCCGACTTCGACGCCACGGGTCATCGGGTCATCCACGCCTTTTGCGGCCTCTCGT CGTTCTCGTATCCGTGTCTGAGGTTTTTGTTGTTTTGTCTCGGACTTCATTTC TCTCTTCACCCTCCCCCCCAACTCCACTCGTGTCCCTCCACTCCGGCTGA | 11486 |
| | 3 | MGPFLAVWVTAWEADLREKSVEI* | 11487 | ATGGGGCCTTTTCTGGCAGTCTGGGTCACGTGGGAAGCTGATCTAAGGAGAGAAA TCAGTTGAAATCTAG | 11488 |
| | 4 | MYLIAKDFSTLFSYVFFNCKLLGF* | 11489 | ATGTATCTGATAGCTAAGGATTTCAACTTATTCTCTTACGTATTTTTCAACTGTA AATTATTGGGCTTTAA | 11490 |
| | 1 | MDGINCC* | 11491 | ATGGATGGAATTAATTGCTGTTAG | 11492 |
| hsa-mir-92a-1 | 2 | MELIAVRRLENSKYRFGRW* | 11493 | ATGGAATTAATTGCTGTTAGGAGGTTGGAAAATAGCAAATAGATTTGGACGGTG GTAG | 11494 |
| | 3 | MFYLFPFYFSLPQSYTWT* | 11495 | ATGTTTTATCTTTTTCCTTATTTTCCTATTCCAGTCATACACGTGACCTAA | 11496 |
| | 4 | MYERFCSGFILHPFPPSLPPACLPGLSSSDPACSLVSDL* | 11497 | ATGGTGGAAAGGAGGGGTCCAGGGCTTCCATTTGCACCCTCCTTCCTGCCC CCGGCTTCCTCCAGGGCTTTCCTCCTGGACCCAGCGTGCTCACTGGTCTCTGATTT TGTAA | 11498 |
| hsa-mir-92a-2 | 1 | MLNSLIVRLKLRHHFILQSAVGLWP* | 11499 | ATGCTTAATTCCATTTGATTGTGCGTCTTAAACTAAGACATCATTTATTCTACAGA GCGCTGTCGGGCTTTGGCCTTGA | 11500 |
| | 2 | MRGESKHAPYLPHICACIRWLLPLTIPAKKP* | 11501 | ATGAGAGGAGAAAGCAAGATAATTGCACCGTATCTCCGCACATTGCGCGTGTATT CGGTTGCTGCTACCGTTAACGATACCTGCCAAGAAACCCTGA | 11502 |
| | 3 | MCRE* | 11503 | ATGTGCAGAGAGTAA | 11504 |
| | 4 | MELSGWGPEVCGRGTEVCGRGRWNVGGVGHVLCGP LCT* | 11505 | ATGGAGCTAAGCGGGTGGGGTCCTGAGGTATGTGAAGGGCACCGAGTATGTGG GAGAGGACGTTGAACGTGGGCGGGGAGTTGGACACGTTCTGTGTGGGCCGTTAT GTACTTAA | 11506 |

Figure 1 (Continued)

| | | | | |
|---|---|---|---|---|
| hsa-mir-92b | 2 | MWKGHRGMWERTLERGRGSWTRSVWAVMYLRGRSGVARWLTFVIPTLWKAEASGSQGQGFKTSLAKMVKPRLY* | 11507 | ATGTGGAAGGGCACCGAGGTATGTGGGAGAGGACGTTGGAAGAGGACGTTGGAACGTTGGGCGGGGAGTTGGACACGTTCTGTGTGGCGTTATGATGCGTTATGTACTTAAGAGGCAGATCGGGCGTGGCACGGTGGCTCACGCCGTAATCCAACACTTGAAGGCGAGCCGAGTGGATCACAAGGTCAGGGGTTCAAGACCAGCCTGGCCAAGATGGTGAAACCTCGTCTCTACTAA | 11508 |
| | 3 | MGFTDTELSFGEQSGKGDR* | 11509 | ATGGGATTTACGGACACAGAACTATCCTTTGGGAGCAGAGTGGTATTGGGGACAGGTAG | 11510 |
| | 4 | MRDSQEVCAAAVHEGRKLSQAAAARGTWVPQSQAAL* | 11511 | ATGCGCGACAGCCAAGAGGTGTGTGCGCAGCAGTGCACGAGGGGAGGAAGCTATCCCAGGCCGCGGCAGCACGTTGGGAACTTGGGTCCGCAGTCGCAGGCTGCGCTCTAG | 11512 |
| hsa-mir-93 | 1 | MANGWTGSRPGRRNPEL* | 11513 | ATGGCCAATGCTGGACTGCCTCCCGCCCTGGCGTGAGGAATCCGAGCTGTGA | 11514 |
| | 2 | MAGLAPALGGGHPSCEAAGIRAHVLLCLLRAEAMAGAGVGCGGGVRWRRSR* | 11515 | ATGGCTGGACTGGCCCTCGCGCCCCTGGGCGGGGAGGAATCCGAGCTGTGAAGGCGGCTGGAATCCGGGCCATGTGCTCTTGTTTACTAAGAGCGGAAGCGATGGCGGGAGCGGGGTGGGTGCGGTGCGGTGGGTGCGGTGGTCCCGGTGA | 11516 |
| | 3 | MCFFYY* | 11517 | ATGTGCTTCTTTGTTTACTAA | 11518 |
| | 4 | MLDGPVHCHGLFLRWLETDL* | 11519 | ATGTTGGATGGCCCTGTGCACTGCCACGGGCTCTTTATTCTTCGCTGGTTAGAAACAGACTTGTGA | 11520 |
| hsa-mir-99a | 1 | MLPQLMYHQLSLA* | 11521 | ATGTTGCCTCAGTAGTGTACACCAACTTTATTTAAATGTTATTTTAGCAGCATTAA | 11522 |
| | 2 | MFQDPFKNIILNVIFSSH* | 11523 | ATGTTTCAAGATCGTTAAAACATTATTTAAATCTCTACACTCTTATATCTTATTAAGCTCCATGCCAAATCCAAATCTCTGTCCTTTCAGCTTTCAGCTTTCATTGTCAAAACCTAGTCGCTTCTTTAACAGCAGCCATGCAAATCCAAATCCAAATCTCTTACTTCAGCTTTCAGCTTTCATTGTCAAACCTAG | 11524 |
| | 3 | MLFLAAINLYTLNYLIKLHAKSKSLFSPRYPIVQNLVASLTAIVLSLSKLLL* | 11525 | ATGTTATTTTAGCAGCATTAATCTCTACACTCTTATATCTTATTAAGCTCCATGCCAAATCCAAATCTCTGTCCTTTCAGCTTACTTCATTGTGCAAAACCTAGTCGCTTCTTTAACAGCAGCCATGCAAATCCAAATCTCTTCAGCTTTCAGCTTTCATTGTCAAAACCTAG | 11526 |
| | 4 | MPNPNLPSAFATSLCKJ* | 11527 | ATGCCAAATCCAAATCTCTTCAGCTTTCAGCTTTCATTGTCAAACCTAG | 11528 |
| | 1 | MAGTAGGRGEAAVRRRGEDGERSAAVGPGLRARGGGEDPPPATREPREP* | 11529 | ATGGCGGGACGGCGGGAGGAAGGGAAGAGGGGAGAGGGCCGTGCGGAAGGCGGGAGGCCGTGCGGGAGGGGGGGGGGGAGGATGGAGAGCCGCTCGGACGGCGGGGACGCGCGGAGCGGGGAGCCGTCGGTGA | 11530 |
| | 2 | MESARRRWGPACGPGAAEKTPSLRRGSRGSRESAEREGGGLGPALLGP* | 11531 | ATGGAGAGCGCTCGGACGCGGTGGGCCCGGCCTGCGGGGGCGGGAGAAGACCCCTTCCTCGGACGCGGGAGCCGTGAGTCTGCGACTCTGGGTCCTGAGGTGGGGCTGGGGCTGGACGCCGCACTCTGGGTCCTGA | 11532 |
| | 3 | MGAGAGRIVAGRD* | 11533 | ATGGGGGCTGGGGCTGGTTAGGATCGTGGCTGGAAGAGACTAG | 11534 |
| hsa-mir-99b | 4 | MGLRGFEGSRVSRASGRGPRRRGRLSGLPDRPGSAAGAGDVWRRRGPASMLPRGPGIPGPRPLLPQIWEYTTQSPTHSRIRAPSPLFSRIQESEPPVCSLRPGNPHASSP* | 11535 | ATGGGGCTGCGGGGCTTGAAGGGTCAAGGGTGAGCGTGCCAGTGGAGGTGAGGGCCGAGGAGGAGGGGGGGCCGAGGAGGGGAGTTGTCTGGGCTGCCAGACAGGCCAGGTTCAGCGCGGGGGCGGAGAGAGATGTCTGGAGGAGGAGGGCCATCCATGCTGCCTCCGGGACCCCGGCGCCAGGTCCCAGACCCCTCCGAGCCGCCAGCAGATCTGGAGTACACCAGTCCCGATCCAGGTCCCAGAATCCGAGCCGCCAGCCGTTTCCAGGATCCAGGAGTCTGACACCCATTCCAGTCTGTTCTCTCAGACCAGGAATCCACTCCACTCCAGCCCTAA | 11536 |
| | 1 | MAAPPARADADPSFTSPPTARDTPGRQAEKSETACEDR* | 11537 | ATGGCTGCGCCCGCCCGGCCCGCGCCGGACGCTGATCCTTCGCCCACGTCGCCACCTACGCCCGAGACACACCAGGCGCGGCAGGCCGCAGCCGCGTGCGAGGACGGGTAG | 11538 |
| | 2 | MLSARGVALPDPRGQGLGFGGAAAHGAFGLPRTRVAPSSLCGGFARA* | 11539 | ATGTTGTCGGCTCGGGGTGTGGCCCTGCCCGACCCGCGGGGTCAGGGTCTGGGGTTTGGCGGCGCCGCGCACGGCGCGTTCGGATTGCCGCGGACCCGGGTCGCTCCGAGCAGCCTCTGCGGGGGCTTTGCAAGAGCATGA | 11540 |

Figure 1 (Continued)

| | | | | |
|---|---|---|---|---|
| hsa-mir-647 | 3 | MKWGSCGGAAGGTRPHPGSSPRVAPLGAGPCAAPLGP WPSGGGGHAVPGAARGRSGRCPSLPGLKCPLGSPRGPQ EGVVPTQAPLAWVQAVTPVRNAVSQDSLRDGLRWMP QGEGCPGTGSLLSRSC* | 11541 | ATGAAGTGGGAAGTTGTGGGGTGCAGCGGAGGAACCCGCCACCCGGTTC GTCACCCCGAGTGGGCCCTCTGGAGCCGGACCCAGTGCCCGGCCGT GCCGTCAGGGGCGGTGGCCACGCAGTGCCGGGCCTGAAGAGGGCCTCTGGG CCCTGCCCCTCCCTTCCGGGTCTGAAGTGTCCTTGAAGTCCTTGGGAGCCGCGGGGTCCCAG GAAGGGGTTGTTCCCACTCAGGCGCCCTCTTGCTGGTTCTGGGTTCAGGCTGTGACTCGTC AGAAACGCTGTGAGCCAGGACTCCGCTGAGATGGCTGCCGCTGAATGCGCAGAGG GGAAGGGGTCCCGGCACAGGGTCGCTCCTCTCCCAGGAGCTGCTGA | 11542 |
| | 4 | MGCAGCRRGKGVPAQGRSSPGAAEQKELSPGPASLQV HTLPVGSD* | 11543 | ATGGGCTGCGCTGATCGCCAGGGGAAGGGTGTCCGGCACAGGTCGCTCCTC TCCAGGAGCTGCTGAAGCAGAAAGAGTTTCCCTGGCCCTGCGTCCCTTCAGGTCA CACCCTCCCAGTGGGCAGTGACTAG | 11544 |
| hsa-let-7e | 1 | MSGGGEAQHPCSLGDPGFQVPDPSSLRSGSTPPSPPPIPE SEPPAPFFPGSRSLSPQSYLSDQGIHTPAPNSFKTPEFRTS APLPKERGPQOPSVPLEPKRSGGIFLPLKPAVLGIPRPLLL RNPGVPTSSLAPAGVQPSRG* | 11545 | ATGTCTGGAGGAGGAGAGGCCCAGCATCCATGTCTCCCTGCGGGACCCGGATTCCA GGTCCCAGAACCCTCCTCCCTCAGCCCTCCCAGATCTGGGAGTACACCACCAGTCCCCACCCAT TCCAGAATCGAGCCCCAGCCCTCCCAGCCCCCTTTTCCAGGATCCAGGAGTCTGAACCCCA GTCTGTTTCTCAGACCAGGAATCCACACTCAGCCCTCCAACTCTTCAAAACCC AGAGTTCGAACCAAGCGTTCAGGCTTCGGCATCTTCTCCTTGAAGCCTGCAGTTCT TCTAGAACCCAAGCGTTCAGGCTTCGGCTCCTCCGAACCCAGGAGTCCCACCCTCCTCTTTAGC GGGATCCCAGGCCCTCCAGCCTTCCAGGGGTTAA | 11546 |
| | 2 | MLPRGPGIPGPRPLLPQIWEYTTQSPTHSRIRAPSLFSRI QESEFPVCSLRPGNPHSSP* | 11547 | ATGCTCCCTCGGGGACCCGGGATTCCAGGTCCAGACCCCTCCCTCAGATCTGG GAGTACACCACCCAGTCCCACCCACATTCCAGAATCCGAGCCCAGCCCCTTTT TCCAGGATCCAAGGAGTCTGAGCCCCAGTCTGTTTCTCAGACCAGGGAATCCACAC TCCAGCCCCTAA | 11548 |
| | 3 | MVPDCLGLLSDFWGLPRVRREGEGDLGLGEVQSLPLPQ SGAMGPGSSRFHQRLVQ* | 11549 | ATGGTCCCAGACTGTTTGGGTCTGCTCTCTGACCCTTGGGGCTCCCAGGGTCGCG AGAGAGGGGAGGGGACTAGGCCAAGCCTAGGCAGTTCGCGTTCACCAACGCTTGTCCAGTGA AAGCGGCTATGGGCCAGGGAGTTCGCGTTCACCAACGCTTGTCCAGTGA | 11550 |
| | 4 | MLRSGESLRFSASPLPSPSSSGPRQPRGMLGTQAAWAPGQ VGVGGWGRCQPPPFPLPTLA* | 11551 | ATGCTTAGGTCCGGGGAATCTCGAGATTCTCGCCTCCCCTCCCTCACCCCTCCT CCTCAGCCCGTCAGCAGCCCGGGCATGCTGGGAACCCAGCCTGCGCCTGCGGC CAGGTTGGTGTGGGGATGGGGTGGGAGCAGCCTCCTGCCCCC ACCTTGGCCTGA | 11552 |
| hsa-let-7i | 1 | MALAEVYVCAVGRVVTLPAVEITAQATALLVLVMLSA AEDNGWESPLFSGALPGDSPRSLGARPARPPRKPLVSHF PRRN* | 11553 | ATGGCTCTGGCTGAGGTAGGTAGTAGTTGTGCGTGTTGTAGTGCCGGTGTGCCGCT GTGGAGATAACTGCGCAAGCTACTGCCTTGCTAGTGCTGGCTAGTGCAGCGCGCGG GAGGACAATGGCTGGGAATCCCCTCTGTTTCCGGGGCGCTGCCTGGGGACAGCC GCGAAGCTCGGCGCCCGGCTGGCGGCCACCACGGAAACCGTTAGTTTCACATTT TCCTAGAAGGAATTGA | 11554 |
| | 2 | MAGNPLCFPGRCLGTAREASAPGRRGHHGNR* | 11555 | ATGGCTGGGAATCCCCTTGTTTCCGGGGCGTGCCTGGGGACAGCCCGGAAGCC TGCCGCCGGCGCGGCGCCACCACGGAAACCGTAG | 11556 |
| | 3 | MHFKGWERAKPLDSFS* | 11557 | ATGCATTTTAAAGGTTGGAAAGAGTAAGCCATTGGATTCCTTTCTTGA | 11558 |
| | 4 | MPNLVCTCFTSFFSCRLEWCERSAELALEGQEK* | 11559 | ATGCCAAATTTAGTTGTTACCTGTTTTACTTCATTCTTTAGCTGTAGGTTGGAGTGGT GTGAGCGATCTGCAGAACTGGCATTAGAGGGGCAGAAGAAGTAG | 11560 |
| | 1 | MLWFTKRETDFF* | 11561 | ATGCTCTGGTTCACCAAGAGAGACTGATTTTTTAA | 11562 |
| | 2 | MLRHHHHHTFLIMVISSCQVERPPAPARLLRLPQRRQQA VRAWPWRPLPGCFLHLQHPPYSSACVLSRSFSFQ* | 11563 | ATGCTCATCATCATCATCATCATCACTGTCCTTATCATGGTTA TCATTTCCTCTGCCAGGTGGAGCGCCCAGCCGCGCGCCCGGCCGCTCGCCTTC CCAGCGAAGGCAGCAAGCAGTTCGGGCTTGGCCGTGCCGCCGGGCCGGATGC TTCCTGCACCTCCAGCATCCCCCCCTTATTCATCTGCCTGTGATTATCTCGATCCT TTTCATTTCAGTAG | 11564 |

Figure 1 (Continued)

| | | | | |
|---|---|---|---|---|
| hsa-mir-124-1 | 3 | MLPAPPASPPLFICLCIISILFISVDPLPLVGPAESLGTAAS LLKKENKKPKTLCGRRDKAPWVRREGITRRSAEPRTRV AAEGRPPGVRMAEGIRTVFYLSLWLAFTVST* | 11565 | ATGCTTCCTGCACCTCCAGCATCCCCCCCTTATTCATTCTGCCTGTATTATCTCGA TCCTTTTCATTCAGTTAGATCCACTGCCTTTGGTTGGGCCGCTGAATCGCTGGGGA CTGCGGCCAGTTCCTTAAAAAAGGAGAACAAAAAGCCAAAAACCTTGTGTGGCGC CGGGACAAAGCCACCTTGGGTTCGGCGAGAAGGGACGGCGAGGAGCGCTGAACCCAG AACACGCGTGGCCGCTGGCCGCGTTGCCCGGGCTGCGGAACGCTGAGGGTA TTCGGATTGTCTTTTATTGTCCCGTGCCTTGCCTTTCACAGTGTCTACGTAG | 11566 |
| | 4 | MRIGLERGQGTQGLEKRRSPLLPCGGLRE* | 11567 | ATGCGGGGGTTGGAAAGGAGACAGGGGACTCAAGGCTTAGAAAAGAGAAGGAGCC CTCTGCTGCCTGGAGGGCTAAGGGAGTAG | 11568 |
| | 1 | MSGGGEAQHPCSLGDPGFQVPDPSSLRSGSTPPSPPPIPE SEPPAPFFPGSRSLSPQSVLSDQIHTPAPNSPKTIPEFRTS APLPKERGPQPSVPLEPKRSGSGIFLPLKPAVLGIPRPLLL RNPGVPTSSLAPAGVQPSRG* | 11569 | ATGTCTGGAGGAGGAGAGGCCCAGCATCCATGCTCCCTCGGGGACCGGGATTCCA GGTCCCAGAATCCGAGCCCTGGGACCCAGAGCCCCCTCCCAGCCCCCA TCCAGAATCCGAGCCCCCAGCCCCCAGCCCTTTTCCAGATGCAGTCCAGGAGTCTGAGCCCCA GTCTGTTCTCTCAGACCAGGAATCCACACTCCAGCCCTACTCCTTCAAAACCC AGAGTTCAGAACCTGCAGTCCAGCGCCCTCCCAAGGAGCGCGCCCAACCTCTGTTCC TCTAGAACCAAGCGTTCAGGCTCCAGCATTCTCCCTTTGAAGCTGCAGTTCT GGGGATCCCCAGCCTCCTCTCTCCTCGGAACCCAGGAGTCCCCACCTCTCTTTAGC CCCAGCTGGAGTCCAGCCCTCCAGGGGTTAA | 11570 |
| hsa-mir-125a | 2 | MLPRCPGIPCGPRPLLPQIWEYTTQSPTHSRIRAPSPLPSRI QESEPPVCSLRPGNPHSSP* | 11571 | ATGCTCCTCTGGGACCGGGATTCCAGTTCCAGACCCTCCTCCTCCTCCAGATCTGG GAGTACACACCAGTCCCACCACCAGGACCTCAGATCCAGCCCCCAGCCCCTTTTT TCCAGGATCCAGGAGTCTGAGCCCCAGTTCTGTTCTCTCAGACCAGGAATCCACAC TCCAGCCCCCTAA | 11572 |
| | 3 | MVPDCLGLLSDPWGLPVRREGEGDLGLGEVQSLPLPQ SGAMCPGSSSRFHQRLVQ* | 11573 | ATGGTGCCAGACTGTTTGGGTCTGCTCCTGAACCTTGGGGTCCCAGGGTGCCGC AGAGAGGGGAGGGGAGGGGACCTAGGCTGGGGAAGTCCAGAGTCAGACCAACCGCTTGTCCAGTGA AAGCGGGGCTATGGGCCCAGGGAGTTCGCGTTCCACCAACGCCTTGTCCAGTGA | 11574 |
| | 4 | MLRSGESLRFSASPLPSPSSSGPRQPRGMLGTQAWAPGQ VGVGWGRGQPPPPFLPTLA* | 11575 | ATGCTTAGGTCCGGGAGAATCTGAGATTCTGAGCTTCCCTCCCTCCCTCACCTCCT CCTCAGGCCCAGCAGCCCCGGGCAGCCCGGCATGCTGGGAACCCAGGCCTGGGCTCCGGGC CAGTTGGTGTGTGGGGCGGGGTGGGGGCGGGGCAGCCCTCCCTTCCCCCTTCCCCC AACCTTGGCCTGA | 11576 |
| | 1 | MRVGKSVCVAGRERLPGVGEGGSEAAGRRSRGFGGPA WTATWAS* | 11577 | ATGAGGGTGGGTAAATCGGTGTGTGTCGCGGGTCGGGAAAGGCTGCCGGGGGTAGG GGAAGGTGGCTCAGACGCGGCGGCGGCCGACGGTCGAGGGCTTCGGAGGGCCTGCTTT GGACTGCAACCTGGGCTCGTGA | 11578 |
| | 2 | MGARDLQLFRRDPGPEAA* | 11579 | ATGGGAGACCAGGAGATCTGCAGCTTTCCGCAGGGATCCTGGGCCTGAAGCTGCCTGA | 11580 |
| hsa-mir-141 | 3 | MMEAPVPVSATSIASGPQPLAGCSPLPTSHAPRKPLVLS* | 11581 | ATGATGGAGGCCCCGTCCGTCCGTCAGCAACATCCATGCCTCAGTCCCAGCCC TTAGCTGGCTGCAGCCCCCACTTCCCACGCACCCCGGAAGCCCCTCGTCTTG AGCTGA | 11582 |
| | 4 | MGPSPSSHPVRFVTWWRQNPQSTLSLGLARPLSRDLTW PVARVPCSNW* | 11583 | ATGGGCCCCAGCCCTCCTCCACCAGTGCGATTTGTCACTGGTGGATCCAGAAC CCACAGTGACCTTGAGCTTGGGGTTGGCTCGCCCCCTCAAGAGACCTCACCTGG CCTGTGGGCCAGGGTCCCGTAGCAACCTGGTGTGA | 11584 |
| | 1 | MGWDGFWGGVPNSDWEWRNPS* | 11585 | ATGGGCTGGGACGGGTTTGGGGGGGTGTCCCAATTCTGACTGGGAGTGGAGGAA CCCCTCCTGA | 11586 |
| | 2 | MRLGRLLSPAPQM* | 11587 | ATGCGACTGGGGCGGCTCCTTTCTCCTGCACCCCAAATGTGA | 11588 |

Figure 1 (Continued)

| | | | | |
|---|---|---|---|---|
| hsa-mir-195 | 3 | MHPKFCSFQNRGPGSQGRVAEVSGEGSVLCFQERRGG WGGGLEVRAGVGLALSVLELGG* | 11589 | ATGCACCCTAAATTTGTCTCTTTCAAATAGGGACCAGGATCTCAGGGGAGAGTA GCTGAGGTAAGTGGGGAGGGAAGTGTCCTCTGTTTCAGGAGAGACGTGGCGGTG GGGGGAGGTTGGAGGTGCGTGCGTGGGGTGGGGGTTGGCTTTGTCAGTCTTGGAAT TGGGGGATGA | 11590 |
| | 4 | MIGEAFSYTPKLQPPRRKPKAETREPPNIPSR* | 11591 | ATGATTGGAGAGGCTTTCTTCTTATACCCTAAACTGCAGCCCCCAGACGGAAACCA AAGGCTGAGACCAGAGAGCCCCAACATCCCAGCCGTTAG | 11592 |
| | 1 | MQKPLLY* | 11593 | ATGCAGAAACCCTTCTCTACTAA | 11594 |
| hsa-mir-200a | 2 | MNPGGRACSEPRLCHCTPAWATETDSISKKKKLASVS PSASCPSIKFFLLRQRESRPLLTYFGAETQHSASNRALK AHLSSTLHLGTRNPQPEW* | 11595 | ATGAACCCGGGAGGCAGAGCTTGCAGTGAGCCGAGATTGTGCCACTGCACTCCAGC CTGGGCGACAGAGACAGATCCATGTCCTCCATCCATCAAAAAAAAAACTGCCTCAGTCT CTCCTTCAGCCTCATGTCCTCCATCCATCAAATTCTTCTTCTGAGGCAGCGAGAATCGAG GCCGCTGCTGACATACTTTGGTGCTGAAACTCAGATACATTCTGCCAGTAATAGAGC TCTGAAGGCTCACCTGAGCTCCACCTCGGCACACGCAACCCTCAGCCAGA GTGGTGA | 11596 |
| | 3 | MSFHQILSSEAARIEAAADILWC* | 11597 | ATGTCCTTCCATCAAATTCTTCTTCTGAGGCAGCGAGAATCGAGGCCGCTGCTGAC ATACTTTGGTGCTGA | 11598 |
| | 4 | MSHF* | 11599 | ATGTCCCACTTCTGA | 11600 |
| | 1 | MQKPLLY* | 11601 | ATGCAGAAACCCTTCTCTACTAA | 11602 |
| hsa-mir-200b | 2 | MNPGGRACSEPRLCHCTPAWATETDSISKKKKLASVS PSASCPSIKFFLLRQRESRPLLTYFGAETQHSASNRALK AHLSSTLHLGTRNPQPEW* | 11603 | ATGAACCCGGGAGGCAGAGCTTGCAGTGAGCCGAGATTGTGCCACTGCACTCCAGC CTGGGCGACAGAGACAGATCCATGTCCTCCATCCATCAAAAAAAAAACTGCCTCAGTCT CTCCTTCAGCCTCATGTCCTCCATCCATCAAATTCTTCTTCTGAGGCAGCGAGAATCGAG GCCGCTGCTGACATACTTTGGTGCTGAAACTCAGATACATTCTGCCAGTAATAGAGC TCTGAAGGCTCACCTGAGCTCCACCTCGGCACACGCAACCCTCAGCCAGA GTGGTGA | 11604 |
| | 3 | MSFHQILSSEAARIEAAADILWC* | 11605 | ATGTCCTTCCATCAAATTCTTCTTCTGAGGCAGCGAGAATCGAGGCCGCTGCTGAC ATACTTTGGTGCTGA | 11606 |
| | 4 | MSHF* | 11607 | ATGTCCCACTTCTGA | 11608 |
| | 1 | MRVGKSVCVAGRERLPGVGEGGSEAAGRRSRGFGGPA WTATWAS* | 11609 | ATGAGGGTGGGTAAATCCGTGTGTGTCGCGGGTCGGGAAAGGCTGCCGGCGGGTAGG GGAAGGTCGCTCAGAGGCGGGACCGGTGGCGGGCCGACGGTCGAGGGGCTTCCGAGGGCTGCTT GGACTGCAACCTGGGCCTCGTGA | 11610 |
| hsa-mir-200c | 2 | MGARDLQLFRRDPGPEAA* | 11611 | ATGGGAGCAGGGATCTGCAGCTTTCCGCAGGATCCTGGGCCTGAAGTGCCTGA | 11612 |
| | 3 | MMEAPVPVSATSIASGPQPLAGCSPLPTSHAPRKPLVLS* | 11613 | ATGATGGAGGCCCCTGTCCCTGTGTCAGCAACATCCATCGCCTCAGGTCCCCAGCCC TTAGCTGGCTGCAGCCCCACTTGAGCTTGGGTTGGCTGCCCCCTCGTCAAGAGACCTCACCTGTCTTG AGCTGA | 11614 |
| | 4 | MGPSPSSHPVRFVTWWIQNPQSTLSLGLARPLSRDLTW PVARVPCSNW* | 11615 | ATGGGCCCCAGCCCCTCCTCCCACCAGTGCGATTTGTCACCTGGTGGATCCAGAAC CCACAGTCGACCTTGAGCTTGGGTTGGCTCGCCCCTCTCAAGAGACCTCACCTGG CCTGTGGCCAGGGTGCCCCGTAGCAACTGGTGA | 11616 |

Figure 1 (Continued)

| | | | | | |
|---|---|---|---|---|---|
| hsa-mir-210 | 1 | MDGVCLSGGQQGRRVGVSEHRGLCCPLGGAEAGPDTL LEGTFFSLCVQGTSVRSSCCQAEGGPGQAQVWSYLQFT GPSSGGPPLCTSYGERVTDLVLLCVSAASVGPLRETAG GSSSSLSAEPAFSSLLLKSGPGRVRAYRPCLRSPGLQEFLR AAPARWRGRGRFSGRLAWTRTGLWKLPALTGLPVTTA K* | 11617 | ATGGACGGGGTGTGCCTGTCTGGCCAGCAGGGACGGCGGTGGGGTAAGCGAAAT CATTCTGGGGGCTTTGCTGCCCCTCCGTTGGTGTGTCCAGGGTACCAGTGCGGAGTTCCTG TTGCCAAGCTGAAGTTCTTTCCTTGTGTGTCCAGGCACAGTGTGTCATATCTCAGCGAC AGGACCATCCTCCGAGRGCCACCTCTGGGACTTCCTACGGAAGAGAGTGACAG ATTTGGTGCTTCTGTGTTTCGAGCCTCAGTGGGCGCTGCTTCCAAGTGACAGGCGG GTGGATCTCCAGCAGGCTGTCTGCTGCAGCCGCTACACAGGCCCTGTCTCCGTCCCAGGCTACTGTTAAAT CAGGACCCGGTCGTGTGGACCCTACACGGCCCTGTCTCCGTCCCAGGCCTGCAGG AGTTGAGGGCTGACCATCGCGTGCGCTGGAGAGGGAGAGGCAGATTTAGTTGGACGCTG GCATGGACTGGACTGGCCTTTGGAAGCCTTTGGAAGCCTCCTGCCCTGACGGGGTTGCTGTCACC ACTGCGAAGTGA | 11618 |
| | 2 | MDSDWPLEAPCPDGVACHHCEVRLGRTCT* | 11619 | ATGGACTCGGACTGGCCTTGGAAGCCTTTGAAGCCTCCTGCCCTGACGGGGTTGCCTGTCACAC TGCGAAGTGAGGCTTGGCAGGACCTGCACCTGA | 11620 |
| | 3 | MSRNSGRGGSQRRPSIQPGSALCPYLHQVGSLPCIAWGI AGLGPALLWNWMFSGSPAFPHVNTVHNIVFKVQFKTQ K* | 11621 | ATGAGTAGGAACTCTGGGCGAGGAGGGTCCCAGCCGCCCTCTGCTGACCAGGGTC CTCTGCCCTGCCCCGTACTTACACAGGGATCCTCCTGCCCTGCATTGCCTGGGG ATTGGCTGGGCTTGGCCCCGCCCGTGGACCTGATGTTTCAGGGAGCCAGC CTTTCCTCATGTCAACACAGTTCACATATAGTTTCAAAGTACAGTTTAAAACTCAA AAGTAA | 11622 |
| | 4 | MSTQFT1* | 11623 | ATGTCAACACAGTTCACATATAG | 11624 |
| hsa-mir-223 | 1 | MGMRSEGEENKDEEKRKCE* | 11625 | ATGGGAATGAGGAGTGAGGAGTGAGGGAGAAGAGAATAAAGATGAAGAAAGAAATGTG AGTAG | 11626 |
| | 2 | MKRKENVSRKWYKDKEMDLIGEGEK* | 11627 | ATGAAGAGAAAAGAAAATGTAGTAGAAAAATGGTACAAGGACAAGGAAATGGACTT AATAGGAGAGTGGAGAGAAGTGA | 11628 |
| | 3 | MVQGQGNGLNRRGREVNEKKRRGDR* | 11629 | ATGGTACAAGGACAAGGAAATGGACTTAATAGGAGAGTGGAGAGAAGTGAATGAGA AAAAAGGAGGAGGAGACAGATGA | 11630 |
| | 4 | MRKKGEETDEERRKNFK* | 11631 | ATGAGAAAAAAAGGAGGAGGATACAGATGAAGAAGAAAAATTTAAGTAA | 11632 |
| | 1 | MAPFGLPRAQ* | 11633 | ATGGCCCCATTGGCTGCCCAGGCTCAATGA | 11634 |
| | 2 | MRGELGHASCCSLLVPHGPSRYLCLSSPGAGTEGTARL QLPVWWLLHMRKELPCTDQRKHLGTWRGGVPKSHYLL CSLSLSPLQVPASGPARCPPHPCATAGWGSWGWDLLPV TNHIARDFQPTLSSATEDAARGRGGREAPKPVPGLRSRA * | 11635 | ATGAGGGGAGCTTGGCCATGCAAGTTGCTTGTAGCCTCCTTGTCCGCATGGGCC TCTAGGTATCTCCCGTCCAGTCGTCGCCTCCGACTCGAACGGACTCCTGTGATCAAAGG AGCATCTGGGGAACCTGGAGGGAGGTGTCCAGCCTGCCAGCCTCCAAATCTCATTACCTCTTTGCTCT CTGTCTCTTTCTCCCCCAGCAAGCGCGCTTGGCCCGTGCTCCAGCTCGGCTGGGATTCCTGGGATCGATTGCTTCCTGTGTCACAAATC ACATTGCCAAGGATTCCAACGACCCTGAGCTCTGCACCAAGGATGCTGCCGGG GACGGGTGGCAGAGAGCCCGAGCCTGCCTGGCCTGGCAGCCTGAGGAGCAGGGCTTAG | 11636 |
| | 3 | MQVAVASLSRMGPLGISASPVLGLERRAQLGSSSPCGG SCI* | 11637 | ATGCAAGTTGCTTGTAGCCTCCTTGTCCGCATGGGCCCCTCTAGGTATCTCTGCCTCTC CAGTCGTGGGCTGGAACGGACAGGGCACAGCCTAGGCTCCAGCTCCCGTGTGGTGGC TCCTGCAATATGA | 11638 |
| | 4 | MGFASCHKSRCQGFPTDPELCHRGCCPGTGWQRGPEA CAWPEEQGLAACEQGFHQVVFTVAKFRPPGPHLLWPC RLSPAAACLPAIHLPGLPGLCPCLLS* | 11639 | ATGGGATTTGCTTCCTGTCACAAATCACATTGCCAAGGATTTCAACCGACCTGAG CTCTGCCACGGAGGATGTCGCCGGGGACGCGGGTGGCAGAGGCCCGAGGCCTG TGCCTGGCCTGAGGAGCAGGGCTTAGCTGCTTGTGAGCAGGGCTTCCACCAAGTCG TGTTCACAGTTGCTAAGTTCGACCCCACCAGGCCCCATCCCTGGCTTCGCGCCT GTCCCCTGCTGCCTCCATCCGCTCCCATCCTGCCTGGCCTCCTGGGCTCTGC | 11640 |
| | 1 | MAPFGLPRAQ* | 11641 | ATGGCCCCCATTGGCTGCCCAGGCTCAATGA | 11642 |

Figure 1 (Continued)

| | | | | |
|---|---|---|---|---|
| hsa-mir-24-2 | 2 | MRGELGHASCCSLLVPHGPSRYLCLSSPGAGTEGTARL QLPVWWLLHMRKELPCDQRKHLGTWRGGVPKSHYLL CSLSLSPLQVPASGPARCPPHPCATAGWGSWGWDLLPV TNHIARDFQPTLSSATEDAARGRGREAPKPVPGLRSRA * | 11643 | ATGAGGGGGGAGCTTGGCCATGCAAGTTGCTGTGCCCTCCTTGTCCGCATGGCCC TCTAGGTATCTCTGCCTCTCCAGTCCTGGGCTGGAACGGAGGCAGCTAGGCTC CAGCTCCCGTGTGGCTCCTGCATATGAGAAAGAGCTTCCCTGTGATCAAAGG AAGCATCTGGAGGACCTGAAGGGAGGTGTCCCAAATCTCATTACCTCCTTTGCCT CTCTCCTTCTCCCCTCAGGTGCCAGCTCCAGCCTGGGGATGCCCAGCTGGGGGGGGTGGGATCTGAACCGACCTGAGCTCTGCCAACCGACCTCTGGGATTGCTTCCGTCACAAATC ACATTCAGGGATTCCAACGACCTGAGCTCTGCCAACGACCCCGAAGCCCTGCCTGAGGAGCAGGGCTTAG | 11644 |
| | 3 | MQVAVASLSRMGPLGISASPVLGLERRAQLGSSSPCGG SCI* | 11645 | ATGCAAGTTGCTGTAGCCTCTCTGTCCGCATGGCCCTCTAGGTATCTCTGCCTCTC CAGTCCTGGGCTGGAACGGAGGCACAGCTAGGCTCCAGCTCCCGTGTGGTGCC TCCTGCATATGA | 11646 |
| | 4 | MGFASCIRKSHCQGFPTDPELCHRGCCPGTGWQRGPEA CAWPEEGQLAACEQGPHQVVFTVAKFRPPGPHLLWPC RLSPAAACLPAILLPGLCLPCLLS* | 11647 | ATGGGATTTGCTTCCTGTCACAAATCACATTGCCAGGGATTTCCAACGACCCTGAG CTCTGCCACCGAGATGCTGCCCGGGACGGAGCGGTGTGGCAGAGAGGCCCGAAGCCTG TGCCTGGCCTGAGGACCTGAGGGCTTAGCTGCTTGTGAGCAGGGTCACACCAAGTG TGTTCACAGTGGCTAAGTTCCACCCCCAGCCCTGCTGCCATCCTGGGCATTCCTCGCCT GTCCCCTGCTGCCGCCTGTCTGCCTGCACTGGAAGCCCTCGCTGCCTCCTCCTGGGCCTCTGC CTCCCGTCCTACTGAGCTGA | 11648 |
| | 1 | MAPFGLPRAQ* | 11649 | ATGGCCCCATTTGGCCTGCCAGGGCTCAATGA | 11650 |
| | 2 | MRGELGHASCCSLLVPHGPSRYLCLSSPGAGTEGTARL QLPVWWLLHMRKELPCDQRKHLGTWRGGVPKSHYLL CSLSLSPLQVPASGPARCPPHPCATAGWGSWGWDLLPV TNHIARDFQPTLSSATEDAARGRGREAPKPVPGLRSRA * | 11651 | ATGAGGGGGGAGCTTGGCCATGCAAGTTGCTGTAGCCTCCTTGTCCGCATGGCCC TCTAGGTATCTCTGCCTCTCCAGTCCTGGGCTGGAACGGAGGCACAGCTAGGCTC CAGTCCTGTGGTGCCTCCTGCATATGAGACGCTGAGAAAAGAGCTTCCCTGTGATCAAAGG AAGCATCTGGAGGACCTGAAGGGAGGTGTCCCAAATCTCATTACCTCCTTTGCCT CTCTCCTTCTCCCCTCAGGTGCCAGCTCCAGCCTGGGGATGCCCAGCTGGGGTTCCTGGGGATTGCTTCCGTCACAAATC ACATTGCCAGGGATTCCAACGACCTGAGCTCTGCCACCGAGGATGCTGCCGGGG GACGGGGTGGCAGAGAGGCCCGAAGCCTGTGCCTGGCCTGAGGAGCAGGGCTTAG | 11652 |
| | 3 | MQVAVASLSRMGPLGISASPVLGLERRAQLGSSSPCGG SCI* | 11653 | ATGCAAGTTGCTGTAGCCTCTCTGTCCGCATGGCCCTCTAGGTATCTCTGCCTCTC CAGTCCTGGGCTGGAACGGAGGCACAGCTAGGCTCCAGCTCCCGTGTGGTGCC TCCTGCATATGA | 11654 |
| | 4 | MGFASCIRKSHCQGFPTDPELCHRGCCPGTGWQRGPEA CAWPEEGQLAACEQGPHQVVFTVAKFRPPGPHLLWPC RLSPAAACLPAILLPGLCLPCLLS* | 11655 | ATGGGATTTGCTTCCTGTCACAAATCACATTGCCAGGGATTTCCAACGACCCTGAG CTCTGCCACCGAGATGCTGCCCGGGACGGAGCGGTGTGGCAGAGAGGCCCGAAGCCTG TGCCTGGCCTGAGGACCTGAGGGCTTAGCTGCTTGTGAGCAGGGTCACACCAAGTG TGTTCACAGTGGCTAAGTTCCACCCCCAGCCCTGCCATCCTGGGCATTCCTCGCCT GTCCCCTGCTGCCGCCTGTCTGCCTGCACTGGAAGCCCTCGCTGCCTCCTCCTGGGCCTCTGC CTCCCGTCCTACTGAGCTGA | 11656 |
| | 1 | MVSCI* | 11657 | ATGGTGTCTTGCATCTAG | 11658 |
| hsa-mir-27a | 2 | MVSICILRQNPVVFSLLQYVTNEVKTVGMGNLNEWH SSALSPTHTCQHAPQPSRK* | 11659 | ATGGTTTCCATTTGTATACTCCATCAAAATTTGTGGTTGTTCAGCCTATTACAAT ATGTCACTAATGAGGTCAAGACTGTAGGTATGGTAACCTGAATGAGTGGCACAGC TCTGCCCTGTCCCCACCCATACTTGTCAACATGCTCCACAGCTTCAAGAAAATAG | 11660 |
| | 3 | MSLMRSRL* | 11661 | ATGTCACTAATGAGGTCAAGACTGTAG | 11662 |
| | 4 | MSGTALPCPPPLVNMLHSLQENRTYQRFRRLGENTAM CAGNGTWHWQLHP* | 11663 | ATGAGTGGCACATTGCCTTGCCCTCCTCCACTATCAGAGATTTAGAAGATTGGAGTGAGAATACGGCTAT GTGTGCTGGGAATGGCACTTGGCAATTGCAACTTCATCCATGA | 11664 |
| hsa-mir-29b-2 | 1 | MVSCI* | 11665 | ATGGTGTCTTGCATCTAG | 11666 |

Figure 1 (Continued)

| | | | | | |
|---|---|---|---|---|---|
| hsa-mir-29c | 2 | MVSICILHQNPVVVFSLLQYVTNEVKTVGMGNLNEWH SSALSPTHTCQHAPQPSRK* | 11667 | ATGGTTCCAITTGTATACTCCATCATCAAAAATTTGTGGTTGTGTTCAGCTATTACAAT AGTGCACTAATGAGGTCAAGACTGTAGGTATGGGTAACCTGAATGAGTTGGCACAGC TCTGCCCTGTCCCCACCATACTTGTCAACATGCTCCACAGCCTTCAAGAAAATAG | 11668 |
| | 3 | MSLMRSRL* | 11669 | ATGTCACTAATGAGGTCAAGACTGTAG | 11670 |
| | 4 | MSGTALPCPPPHLVMMLHSLQENRTYQRFRRLGENTAM CAGNGTWHWQLHP* | 11671 | ATGAGTGGCACAGCTCTGCCCTGTCCCCACCATACTTGTCAACATGCTCCACAGC CTTCAAGAAAATAGGACCTATCAGAGATTTAGAAGATTGGGTAGAATACGGCTAT GTGTGCTGGAATGGCACTTGGCATTGGCAACTTCATCATCATGA | 11672 |
| hsa-mir-34b | 1 | MVGRPPVKWGPRRAPTPRRRCGPSGSCSRGCPVLGL* | 11673 | ATGGTAGGGCGTCCCCCGGTGAAATGGGTTCGAGGCGGGCGCCCGACCCGCGTCG GCGCCGCGACCGTCGGGACTCGGGAGCGTGCCCGGTGTCGGTTCGGTTGTAG | 11674 |
| | 2 | MGSEAGPDPASALRTVRELQPRVPGARFVGSVIS* | 11675 | ATGGGGTCCGAGGCGGGCCCCGACCCGGCGTCTGCGCTGCGGACCGTCCGGGAGCT GCAGCCGCGGGTGCCCGGTGTCGGTTCGGTCATTAGCTGA | 11676 |
| | 3 | MPEKRGVGVGPAQPAPRAPAASARKPAVSPDTVKLLAL SRSHRR* | 11677 | CCGCTCAAGTTCAAGGACTAGCAGTTCGGTCTCTGCGCAGCCTGCCGCGAGCGCC CGCTCAAGTTCGAGGCGGCGGTTCTCCAGATACAGTTAAACTGTTAGCTCT CTCTAGGAGTCACAGAAGATGA | 11678 |
| | 4 | MKQSHARKAKSLEVKPLHPCNG* | 11679 | ATGAAACAGTCTCATGCCAGGAAAGCAAAATCCTGGAGGTGAAGCCCCTCCATCC ATGTAACGGTTAA | 11680 |
| hsa-mir-34c | 1 | MVGRPPVKWGPRRAPTPRRRCGPSGSCSRGCPVLGL* | 11681 | ATGGTAGGGCCGTCCCCCGGTGAAATGGGTCGAGGCGGGCGCCCGACCCCGCGTCG GGGCTGGGACCGTCGGGACTCGGGAGCGTGCCCGGTGTCCGGTGCCCCGGGAGCT GCAGCCGCGGGTGCCCGGTGTCGGTTCGGTCATTAGCTGA | 11682 |
| | 2 | MGSEAGPDPASALRTVRELQPRVPGARFVGSVIS* | 11683 | ATGGGGTCCGAGGCGGGCCCCGACCCGGCGTCTGCGCTGCGGACCGTCCGGGAGCT GCAGCCGCGGGTGCCCGGTTCGGTTCGGTCAGTGTCATTAGCTGA | 11684 |
| | 3 | MPEKRGVGVGPAQPAPRAPAASARKPAVSPDTVKLLAL SRSHRR* | 11685 | ATGCCTGAGAAGCGAGGCGTCGGCGTGGGCCCCGCTCAGCCTGCCAGCCTGCCGGAGCGCC CGCTCAAGTTCGAGGAGAAAGCCGGTCCGGTTCTCCAGATACAGTTAAACTGTTAGCTCT CTCTAGGAGTCACAGAAGATGA | 11686 |
| | 4 | MKQSHARKAKSLEVKPLHPCNG* | 11687 | ATGAAACAGTCTCATGCCAGGAAAGCAAAATCCTGGAGGTGAAGCCCCTCCATCC ATGTAACGGTTAA | 11688 |
| | 1 | MRRTEEERGFEKGEGYRD* | 11689 | ATGAGGAGGACAGAGGAAAGAAAGGGCGGAAAAGGTGAGGGGTGAGAGACTAG | 11690 |
| | 2 | MFGVGTVGRTHGADSSAS* | 11691 | ATGTTTGGAGTAGGGACAGCTCCATGGCGCTGACAGCTCCGCATCTTGA | 11692 |
| | 3 | MALTAPHLDKVISCLSDIIRALEFSYQRFIQE* | 11693 | ATGGCGCTGACAGCTCCCACTTGATAAGTCATTCCTGTTATCAGACATCATT AGGGCATTAGAGTTCTCATACCAAAGATTTATCCAAGAGTAG | 11694 |
| | 4 | MSFLKTPEKFQPCVPHCSAVLCPNELLRGSCHPVSSGFS CPQFHLERSPQDRMVRSYQSTAPVMLLIFCMAFSSW LRQNSPLSNKDNMLLTELFLQFTY* | 11695 | ATGAGCTTCTTAAAGACACCAGAAAGTTCAACCTTGTGTGCCACATTGTTCTGCT GTGCTTTGTCCAAATGAACTTTGGAGGCAGCTGCATCCAGTTCAAGTGGATTC CTTGGGCCACAATTTCACTTGGAAAGACCAAGTCCTCAAGATCGCATGGTACGCAGC ATCAGAGTACAGCTCTGCGTTTTCATTTTCAATGGTATGGCTTTTCAAGTT GGCTTAGGCAGAATTCCTCTGTGCAATAAAGACAACATGTTCTCACTGAACTTT TCTCCAATTCACATACTAG | 11696 |
| hsa-mir-424 | 1 | MQKPLLY* | 11697 | ATGCAAGAAACCGCTTCTGTACTAA | 11698 |
| hsa-mir-429 | 2 | MNFGGCACSEPRLLCHCTPAWATFTDSISKKKKKLASVS PSASCPSIKFFLLRQRESRPLLTYPGAFTQHSASNRALK AHLSSTLHLGTRNPQPEW* | 11699 | ATGAACCGGAGGCAGAGCTTGCAGTTGACGCAGATTGTGCACTCAGCT CTGGGCGACAGAGACCAGCTCCATCTCAAAAAAAAAACTTCCTCAGTCT CCTGTTCAGCCTGCGACATACTTGGTGCTGAAACTCAGATACATTCTGCCAGTAATAGAGC GCCGCTGCTGACATACTTGGTGCTGAAACTCAGATACATTCTGCCAGTAATAGAGC TCTGAAGGCTCACCTGAGCTCCACTCCACCTCGGCACCGCACCCCTCAGCCAGA GTGGTGA | 11700 |

Figure 1 (Continued)

| | | | | | |
|---|---|---|---|---|---|
| | 3 | MSFHQJLSSEAARIEAAADLWC* | 11701 | ATGTCCTTCCATCAAATTCTTCTTCTGAGGCAGCGAGAATCGAGGCCGCTGCTGAC ATACTTGGTGCTGA | 11702 |
| | 4 | MSHF* | 11703 | ATGTCCCACTTCTGA | 11704 |
| hsa-mir-497 | 1 | MGWDGFWGGVPNSDWEWRNPS* | 11705 | ATGGGCTGGACGGGTTTTGGGGGGGTGTCCCAATTCTGACTGGGAGTGGAGGAA CCCCTCCTGA | 11706 |
| | 2 | MRLGRLLSPAPQM* | 11707 | ATGAGACTGGGCCGTCCTTCTCTGACCCCAAATGTGA | 11708 |
| | 3 | MHPKFCSFQNRGPGSQGRVAEVSGEGSVLCFQERRGG WGGGLEVRAGVGLALSVLELGG* | 11709 | ATGCACCCTAAATTTGCTCTTTCAAAATAGGGACCAGGATCTCAGGGGAGAGTA GCTGAGGTAAGTGGGGAGGGAAGGTGTCCTCTGTTTCAGGAGAGACGTGGCCGTTG GGGGGAGGTTTGGAGTGCGTGCTGGGGTGGGGTTGGCTTGTCAGTCTTGGAAT TGGGGGATGA | 11710 |
| | 4 | MIGEAFSYTPKLQPPRRKPKAETREPPNIPSR* | 11711 | ATGATTGGAGAGGCTTTCTTATACCCTAAACTGCAGCCCCCAGACGAAACCA AAGGCTGAGACCAGAGAGGAAGAACATCCCAGCCGTTAG | 11712 |
| | 1 | MRRTEEERGEKGEGVRD* | 11713 | ATGAGGAGGACAGAGGAAGAAAAGGGGGAAAAAGTGAGGGGTGAGAGACTAG | 11714 |
| | 2 | MPGVGTVGRTHGADSSAS* | 11715 | ATGTTTGGACTGAGGACAGTTGGAGACAGACCATGGGACGCTGACAGCTCGCATCTTGA | 11716 |
| | 3 | MALTAPHLDKVISCLSDURALEPSYQRFIQE* | 11717 | ATGGCGCTGACAGCTCCGCATCTTGATAAAGTCATTTCCTGTTTATCAGACATCATT AGGGCATTAGAGTTCTCATACCAAAGATTTATCCAAGATAG | 11718 |
| hsa-mir-503 | 4 | MSFLKTPEKFQPCVPHCSAVLCFNELLRGSCHPVSSGFS CPQFHLERPSPQDRMVRSYQSTAPVMLLLIFCMAFSSSW LRQNSPLSNKDNMLLTELFLQFTY* | 11719 | ATGAGCTTCTTAAAGACACCAGAGAAGTTCAACCTTGTGTTCGCCACATTGTTCTGCT GTCTTTGTCCCACATTGCGAGGCCATCCAGTTCAAGTGGATTC TCTTGCCCACATTCCTCACTGAATTCTTGCGAAAGACCAAGCTCCAGTTCAAGTGGATCC ATCAGAGTACAGCTCCTGTGATGCCTTATTTGTATGGCTTTTCAAGTT CAGAGCAGAATTCCTCTGAGCAATAAAGACAACATGCTTCTCACTGAACTTT | 11720 |
| | 1 | MQLLFMRSASLNPSHMHKGGSYQKAGVILGAAHHTPV YEESYNNYILVITCKLLKFGNALTKHHISKKEDYLRKRV LPLILTLAFRNLAV* | 11721 | ATGCAGCTCATTCATTCTATGAGAAGTGCGTCATGAAGGCAGGGTCATCTAGGGGCTGCCACCCACCACCTGT GTATGAAGAAAGTTACAACAATTACATTCTAGTCATTACGTGCAAATTACTAAAGTT TGGGAATGCACTTACTAATCTAATCATATCTCAAAAGGAAGATTATCTCAGAAAACG AGTTCTGCCTTAATCCTGACTCGACAATTACATTCTAG | 11722 |
| hsa-mir-527 | 2 | MKKVTTTF* | 11723 | ATGAAGAAAGTTACAACATTTACATTCTAG | 11724 |
| | 3 | MHLLNISSPKRKIISENEFCL* | 11725 | ATGCACTTACTAAACATATCATCTCCAAAAAGAAGATTATCTCAGAAAACGAGTTC TGCCTTTAA | 11726 |
| | 4 | MLLFPLLPVLACCVKTQTHRPTISGELNFPKQFLYSFTSE CLFMPIPVFI* | 11727 | ATGCTCCTGTTTCCTCTTCCGCTGCTTGGCATGTGTGTAAAGACACAAACACAGA GACCCACCATTTCAGGAGAGCTCAACTTTCCAAACAATTCCTATATTCCTTTACCTC TGAGTGTCTGTTCATGCCATCGACGCCAGTGTTTATTTAG | 11728 |
| hsa-mir-92b | 1 | MTIKVSARQQDTEENSSTTCQVDSVHDSAEQEVWAPSL* | 11729 | ATGACCAAAGTCTCAGCCAGGCAGCAGGATACCGAGTTAACTCATCTACCACCTGC CAGTGGACTCTGTGCATGCATGGATGACCAAGAGAAGTTGGCCCATCTCTTTGA | 11730 |
| | 2 | MTLQNKKFGPHLFEL* | 11731 | ATGACTCTGCAGAACAAGAAGTTTGGCCCATCTCTTTGAGCTCTAA | 11732 |
| | 3 | MRELEKLAQGSHGRPEWKELPAA* | 11733 | ATGAGGGAACTGGAAAGCTTGCCCAGGGTTCCATGGGAGACCAGAGTGGAAGGA GCTACCAGCTGCCTGA | 11734 |
| | 4 | MGDQSGRSYQLPDNPAFSSPPRRTVPG* | 11735 | ATGGGAGACCAGGAGTGGAAGGAGCTACCAGCTGCCTGATAACCCAGCTTCTCTCT CCACCCAGGAGAACTGTTCCTGGGTGA | 11736 |

Figure 1 (Continued)

| | | | | | |
|---|---|---|---|---|---|
| hsa-mir-99b | 1 | MSGGGEAQHPCSLGDPGFQVPDPSSLRSGSTPPSPPIPE SEPPAPFPGSRSLSPQSVLSDQGIHTPAPNSFKTPEFRTS APLPKERGPQPSVPLEPKRSGSGIFLPLKPAVLGIPRPLL RNPGVPTSSLAPAGVQPSRG* | 11737 | ATGTCTGGAGGAGGAGAGGCCCAGCATCCATGCTCCCTCGGGGACCCGGATTCCA GGTCCCAGACCCCCTCCCTCAGATCTGGAGTAGCACCACCAGTCCCCACCCAT TCCAGAGATCGAGCCCCCGAGCCCCAGCCCCTTTTCCAGGATCTCAGGAGTCTGAGCCCCA GTCTGTTCTCTCAGACCCTCAGAACCTCCAGGGAATCCACACTCCAGCCCCTAACTCCTTCAAACCCC AGAGTTCAGAACCTCAGCCCTTCAGGAGCCCCCAACCCTCTGTTCC TCTAGAACCCAAGCGTTCAGGGTCTCCGGCATCTTCCCTTGAAGCCTGCAGTTCT GGGGATCCCCAAGGCCCCTCCCTCCCTCCGGAACCCAGGAGTCCCCACCTCCTCTTTAGC CCCAGCTGGAGTCCAGCCCTCCAGGGGTTAA | 11738 |
| | 2 | MLPRGPGIPGPRPLLPQIWEYTTQSPTHSRIRAPSPLFSRI QESEPPVCSLRPGNPHSSP* | 11739 | ATGCTCCCTCGGGGACCCGGGATTCCAGGTCCCAGACCCCTCCTCCCTCAGATCTGG GAGTACACCACCAGTCCCCACCCATTCCAGAATCGAGCCCGAGCCCCAGCCCCTTTTT TCCAGGATCCAGGAGTCTGAGCCCCCAGTCTGTTCTCTCAGACCCAGGGAATCCACAC TCCAGCCCCTAA | 11740 |
| | 3 | MVPDCLGLLSDPWGLPRVRREGEGDLGLGEVQSLPLPQ SGAMGPGSSRFHQRLVQ* | 11741 | ATGGTGCCAGACTGTTTGGGTCTGCTCTCTGACCCTTGGGGCTCCCAGGGTCCGC AGAGAGGGGAGGGGGACCTAGGCTGGGGAAGTCAGAGCCTACCCTTCCCCA AAGCGGGGCTATGGGGCCCAGGGAGTTCGCGTTTCCACCAACGCCTTGTCCAGTGA | 11742 |
| | 4 | MLRSGESLRFSASPLPSPSSSGPRQPRGMLGTQAWAPGQ VGVGGWGRGQPPPPFLPTLA* | 11743 | ATGCTTAGGTCGGGAATCTGAGATTCTCGGCTTCCCCTCCCCACCCTCCT CCTCAGCCCAGGCAGCCCCGGACAGCATGCTGGAACCCAGGATCTGGGGCTCGGGC CAGGTTGGTGTGGGGCGGGGGTGGGGGCCAGCCTCCTCCCCTTCCCCTTCCTCCCCC ACCCTTGGCCTGA | 11744 |
| hsa-miR 145-2 | | MVGLNPPLWQETGEYT | 11745 | ATGGTTGGTTTAAATCCACCCTCTGGCAGGAGACTGGGAATACACATGA | 11746 |
| hsa-miR 125a-1 | | MSLCLSPSLTPPGSTGPPHTMLPVSRSLRPFNL | 11747 | ATGTCTCTGTGCCTATCTCCATCTCTGACCCCCACCCCAGGGTCTACCGGGCCACCG CACACCATGTTGCCAGTTCTCAGGTCCCGAGACCCTTTAACCTGTGA | 11748 |
| hsa-miR 15a-16-1 | | MFKHRFFYMHSFPERKYPLYSLGANVCLKKIKPWSKV AAHNGLWILKRCRPYCAASKIQGSDLLKKIYFFLFIALMI AMSAVP | 11749 | ATGTTTAAACATAGATTTTTCCTTAGGCGCGAATGTGTTTACATGCATTCTTTTTCCTGAAAGAAAATATTTTT TATATTCTTTAGGCGCGAATGTGTTTGTGGATTTGTTTAAAAAATAAAACCTTGGAGTGAAGTAG CAGCACATAATGGTTTGTGGATTTGTTTGAAAAGGTGCAGGCATATTGTGCTGCCTCAA AAATACAAGGATCTGATCTTCTGAAGAAAATATATTCTTTTATTCATAGCTCTTAT GATAGCGAATGTCAGCAGTGCCTTAG | 11750 |

*iBSP*: DIF + BMP4 medium

*PTHR1*: DIF + BMP4 medium

*STMN2*: DIF + BMP4 medium

*OSTERIX*: DIF + BMP4 medium

STMN2: DIF + BMP4 medium

STMN2: DIF Δ BMP4 medium

*OSTERIX*: DIF Δ BMP4 medium

*STMN2*: DIF Δ BMP4 medium

*OSTERIX*: DIF Δ BMP4 medium

*STMN2*: PROLIF medium

THERAPEUTIC PEPTIDES

FIELD

The present invention relates to therapeutic peptides.

BACKGROUND

The microRNAs (miRs) are small non-coding RNAs, about 21 nucleotides in length after maturation, which control expression of target genes at the post-transcriptional level, by degrading the target mRNA or by inhibiting its translation, in eukaryotic organisms.

The miRs can in particular regulate the expression of specific genes involved in certain pathologies in humans and animals. It is now recognized that miRs play an important role in many pathologies, and these are therefore attractive targets for the development of new drugs. The regulation of expression of the miRs is very poorly understood, but it is known in particular that the latter involves, like most coding genes, an RNA polymerase II: this enzyme produces a primary transcript, called "pri-miR", which is then matured by a protein complex in particular containing the Dicer type enzymes. This maturation leads firstly to the formation of a precursor of miR called "pre-miR", having a stem-loop secondary structure containing the miR and its complementary sequence miR*. Then the precursor is matured, which leads to formation of a shorter double-stranded RNA containing the miRNA and the miR*. The miR is then manipulated by the RISC complex, which cleaves the mRNA of the target gene or inhibits its translation.

At present, there are mainly two types of therapeutic approaches for regulating the expression of miRs in vivo.

The first approach is to mimic the effect of miR using synthetic RNA duplexes designed to mimic the miR of interest. One strand is identical to the miR of interest, while the other strand can be modified to facilitate cellular uptake of the molecule. However, since one of the strands must function as a miR and be recognized as such by the cell, the allowed modifications are chemically limited. In addition, although this approach allows for the replacement of the amounts of miRs lost during a pathology, it is difficult to target the RNA molecules to specific tissues, and the tissues that do not normally express the miR of interest. can also capture the synthetic RNA duplex and lead to undesirable side effects.

The second approach is to use antisense oligonucleotides. Such antisense oligonucleotides have a sequence complementary to all or part of that of the target miR and will reduce the endogenous amount of miRs. However, because of the low in vivo stability of this type of molecule, their manipulation is made difficult and expensive.

It is therefore necessary to provide a means of regulating more simply, and specifically, the miRs involved in certain pathologies.

Recently, small open reading frames (ORFs) have also been found in long intergenic non-coding RNAs (lincRNAs) whose putative function, if any, is not known (Ingolia et al., *Cell*, 147(4):789-802, 2011; Guttman & Rinn, *Nature*, 482 (7385):339-46, 2012). However, no examples have yet been reported concerning the existence of ORFs encoding peptides within miRs. So far, the miRs, and by extension their primary transcript, have always been considered, by their particular mode of action, as noncoding regulatory RNAs producing no peptide.

However, the inventors have recently demonstrated the existence of micropeptides (or "miPEPs", microRNA encoded PEPtides) capable of modulating the accumulation of miRs in cells (Lauressergues et al., *Nature*, 520(7545): 90-3, 2015; International Application WO 2015/063431).

SUMMARY

One of the aspects of the invention is therefore to propose compositions containing micropeptides capable of modulating the accumulation of miRs involved in certain pathologies.

Another aspect of the invention relates to these micropeptides for their use as medicaments, and for the treatment of specific pathologies.

Another aspect of the invention relates to a method of identifying micropeptides for modulating the accumulation of miRs involved in pathologies.

Other aspects of the invention also relate to micropeptides as such and the nucleic acids encoding them.

BRIEF DESCRIPTION OF THE DRAWINGS

FIG. 1: List indicating the corresponding miPEPs and miORPs, as well as the associated miRs.

The mesenchymal stem cells were treated for 4 days with 100 μM of miPEP//125a-1, with 100 μM of control peptide (ScmiPEP//125a) or untreated (NT). The y-axis indicates the relative expression of the iBSP gene. Analyzes and statistics were performed with the Mann-Withney test (p-value: * $p<0.05$;  $p<0.01$ and * $p<0.001$).

Figure 2:
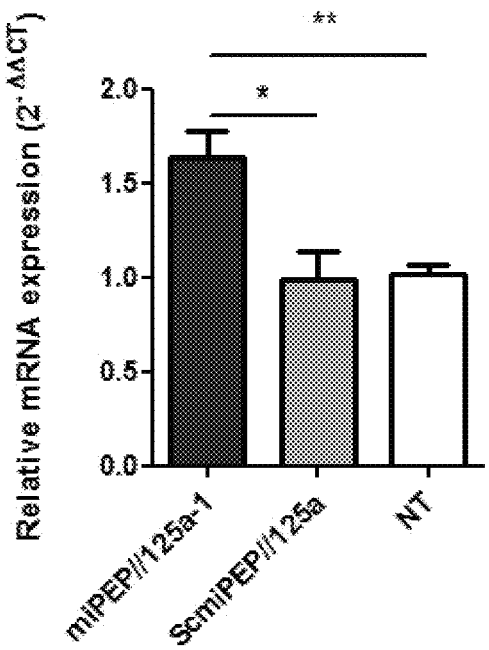
FIG. 2: Expression of the iBSP gene in mesenchymal stem cells cultured in DIF+BMP4 medium in presence of miPEP//125a-1.
Figure 3:
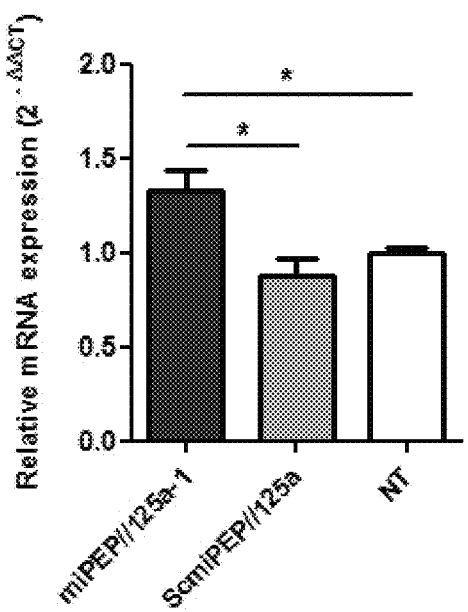

FIG. 3: Expression of the PTHR1 gene in mesenchymal stem cells cultured in DIF+BMP4 medium in presence of miPEP//125a-1.

The mesenchymal stem cells were treated for 4 days with 100 μM of miPEP//125a-1, with 100 μM of control peptide (ScmiPEP//125a) or untreated (NT). The y-axis indicates the relative expression of the PTHR1. Analyzes and statistics were performed with the Mann-Withney test (p-value: * $p<0.05$;  $p<0.01$ and * $p<0.001$).

Figure 4:
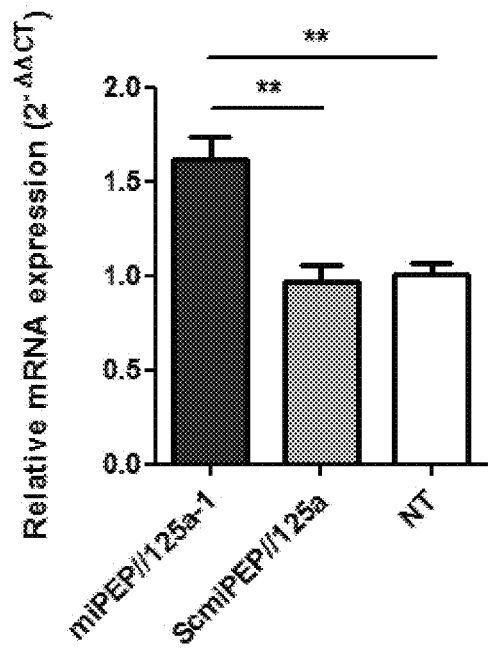

FIG. 4: Expression of the STMN2 gene in mesenchymal stem cells cultured in DIF+BMP4 medium in presence of miPEP//125a-1.

The mesenchymal stem cells were treated for 4 days with 100 μM of miPEP//125a-1, with 100 μM of control peptide (ScmiPEP//125a) or untreated (NT). The y-axis indicates the relative expression of the STMN2 gene. Analyzes and statistics were performed with the Mann-Withney test (p-value: * $p<0.05$;  $p<0.01$ and * $p<0.001$).

Figure 5:
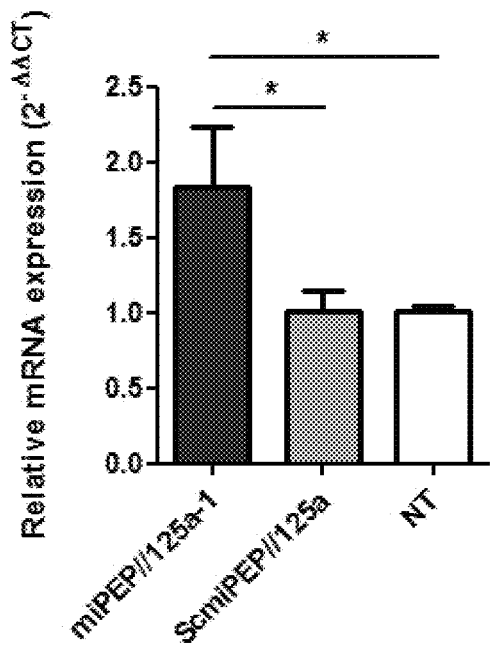

FIG. 5: Expression of the OSTERIX gene in mesenchymal stem cells cultured in DIF+BMP4 medium in presence of miPEP//125a-1.

The mesenchymal stem cells were treated for 4 days with 100 μM of miPEP//125a-1, with 100 μM of control peptide (ScmiPEP//125a) or untreated (NT). The y-axis indicates the relative expression of the OSTERIX gene. Analyzes and statistics were performed with the Mann-Withney test (p-value: * $p<0.05$;  $p<0.01$ and * $p<0.001$).

Figure 6:
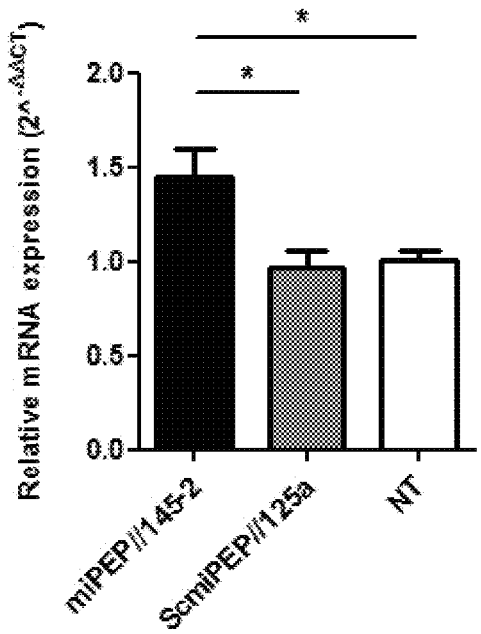

FIG. 6: Expression of the STMN2 gene in mesenchymal stem cells cultured in DIF+BMP4 medium in presence of miPEP//145-2.

The mesenchymal stem cells were treated for 4 days with 100 μM of miPEP//145-2, with 100 μM of control peptide (ScmiPEP//125a) or untreated (NT). The y-axis indicates the relative expression of the STMN2 gene. Analyzes and statistics were performed with the Mann-Withney test (p-value: * p<0.05;  p<0.01 and * p<0.001).

Figure 7:
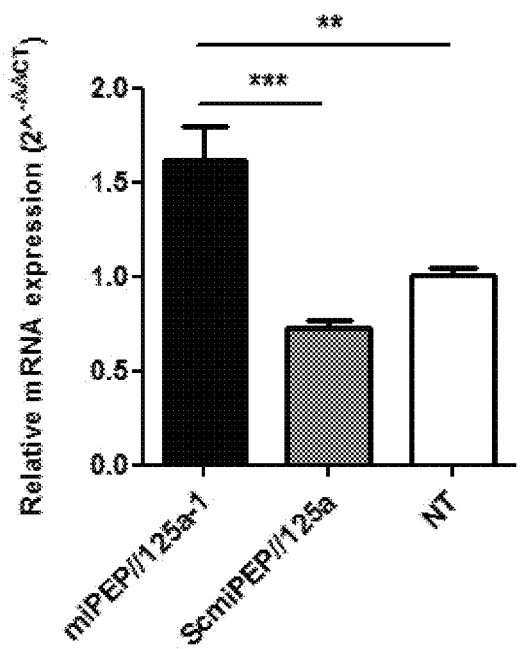

FIG. 7: Expression of the STMN2 gene in mesenchymal stem cells cultured in DIF 4 BMP4 medium in presence of miPEP//125a-1.

The mesenchymal stem cells were treated for 4 days with 100 μM of miPEP//125a-1, with 100 μM of control peptide (ScmiPEP//125a) or untreated (NT). The y-axis indicates the relative expression of the STMN2 gene. Analyzes and statistics were performed with the Mann-Withney test (p-value: * p<0.05;  p<0.01 and * p<0.001).

Figure 8:
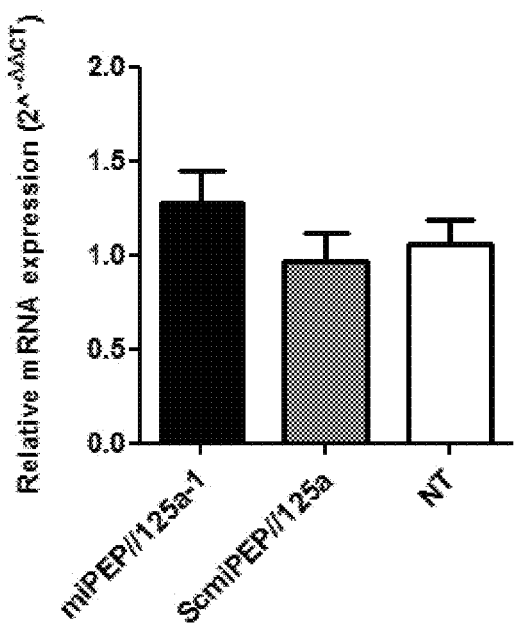

FIG. 8: Expression of the OSTERIX gene in mesenchymal stem cells cultured in DIF BMP4 medium in presence of miPEP//125a-1.

The mesenchymal stem cells were treated for 4 days with 100 μM of miPEP//125a-1, with 100 μM of control peptide (ScmiPEP//125a) or untreated (NT). The y-axis indicates the relative expression of the OSTERIX gene. Analyzes and statistics were performed with the Mann-Withney test (p-value: * p<0.05;  p<0.01 and * p<0.001).

Figure 9:
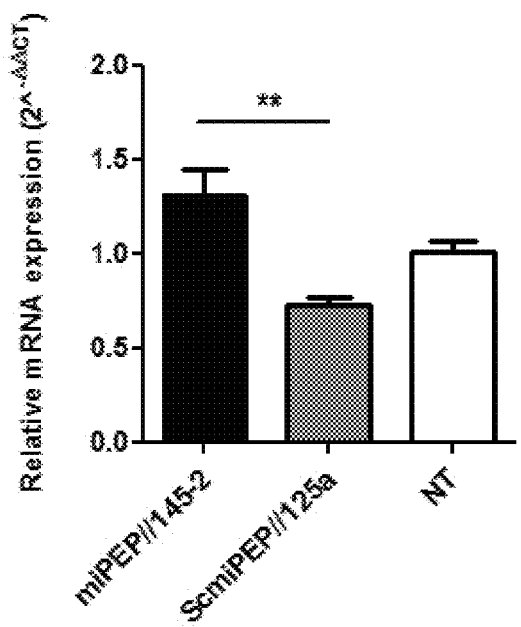

FIG. 9: Expression of the STMN2 gene in mesenchymal stem cells cultured in DIF 4 BMP4 medium in presence of miPEP//145-2.

The mesenchymal stem cells were treated for 4 days with 100 μM of miPEP//145-2, with 100 μM of control peptide (ScmiPEP//125a) or untreated (NT). The y-axis indicates the relative expression of the STMN2 gene. Analyzes and statistics were performed with the Mann-Withney test (p-value: * p<0.05;  p<0.01 and * p<0.001).

Figure 10:
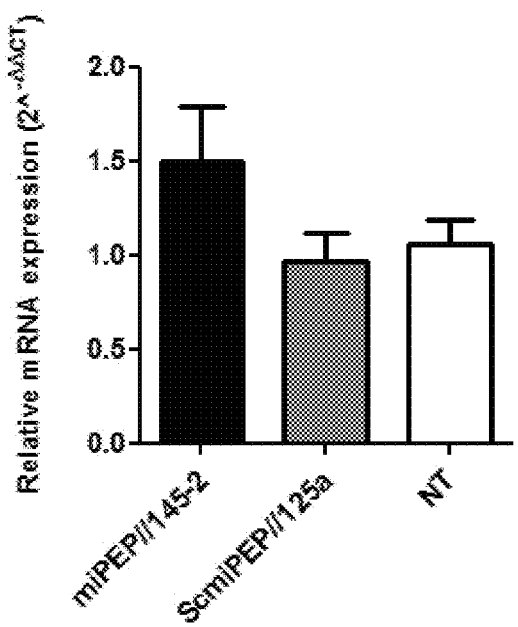

FIG. 10: Expression of the OSTERIX gene in mesenchymal stem cells cultured in DIF BMP4 medium in presence of miPEP//145-2.

The mesenchymal stem cells were treated for 4 days with 100 μM of miPEP//145-2, with 100 μM of control peptide (ScmiPEP//125a) or untreated (NT). The y-axis indicates the relative expression of the OSTERIX gene. Analyzes and statistics were performed with the Mann-Withney test (p-value: * p<0.05;  p<0.01 and * p<0.001).

Figure 11:
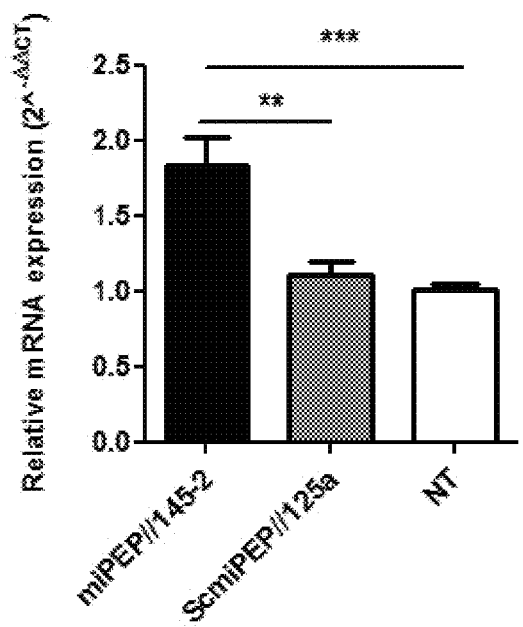

FIG. 11: Expression of the STMN2 gene in mesenchymal stem cells cultured in DIF BMP4 medium in presence of miPEP//145-2.

The mesenchymal stem cells were treated for 4 days with 100 μM of miPEP//145-2, with 100 μM of control peptide (ScmiPEP//125a) or untreated (NT). The y-axis indicates the relative expression of the STMN2 gene. Analyzes and statistics were performed with the Mann-Withney test (p-value: * p<0.05;  p<0.01 and * p<0.001).

Figure 12:
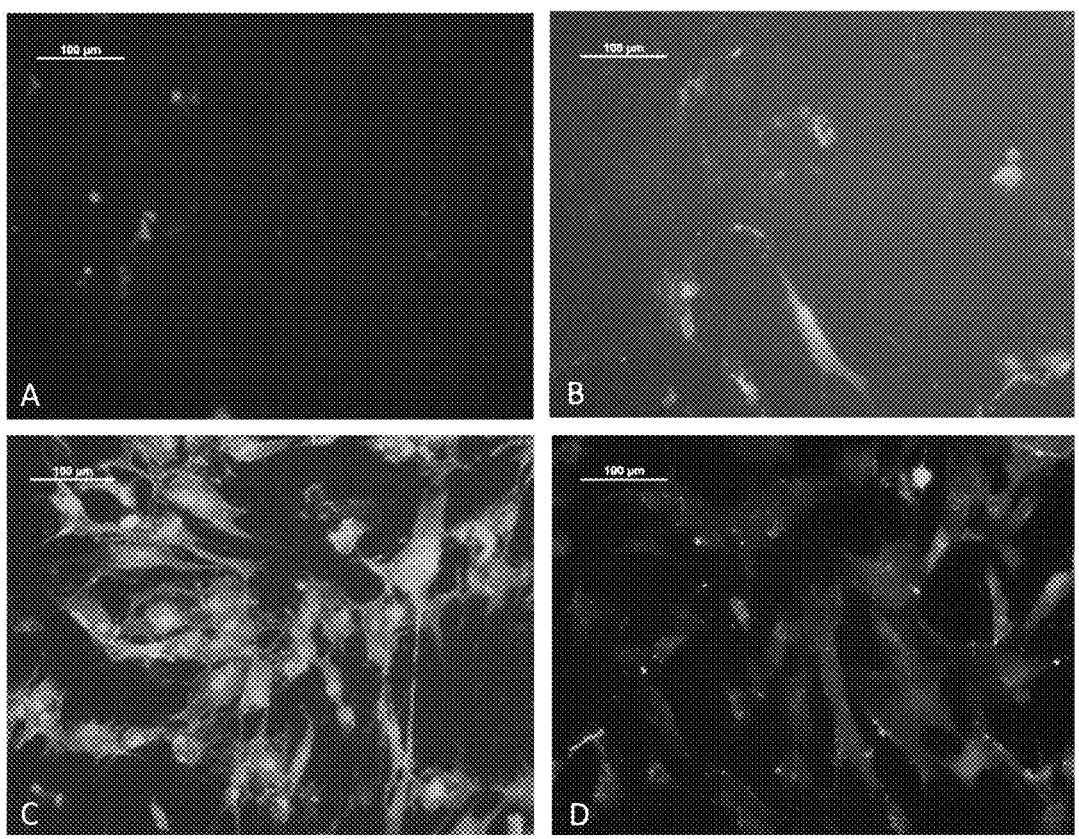

FIG. 12: Entry of miPEP//15a-16-FAM in mesenchymal stem cells.

The undifferentiated mesenchymal stem cells were treated for 6 hours with miPEP//15a-16-1-1-FAM at 5 μM (A), 10 μM (B), 50 μM (C) or 100 μM (D).

Figure 13:
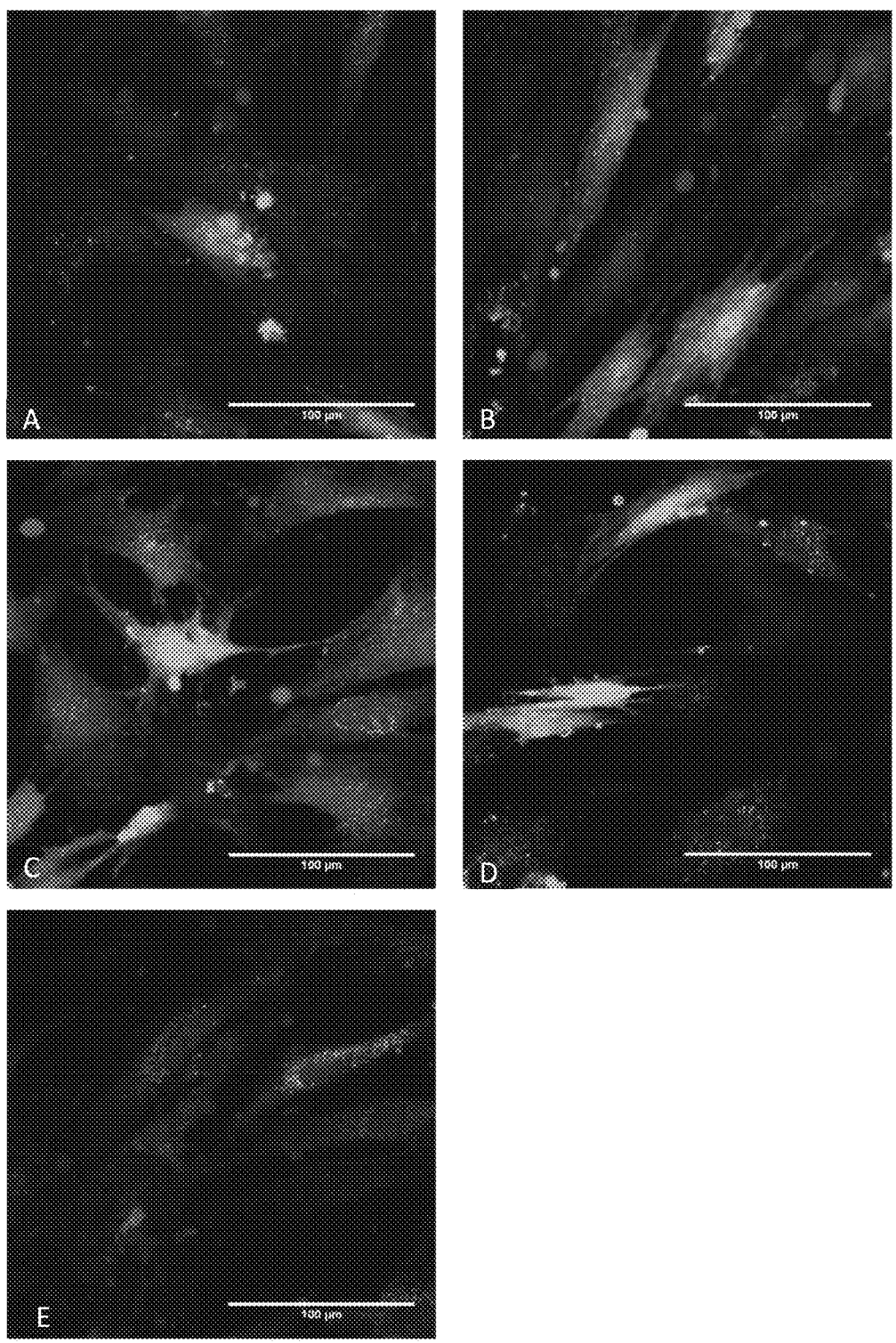

FIG. 13: Entry of miPEP//15a-16-FAM in mesenchymal stem cells.

The undifferentiated mesenchymal stem cells were treated with 100 μM of miPEP//15a-16-1-1-FAM for 2 hours (A), 4 hours (B), 6 hours (C), 8 hours (D) and 24 hours (E).

Figure 14:
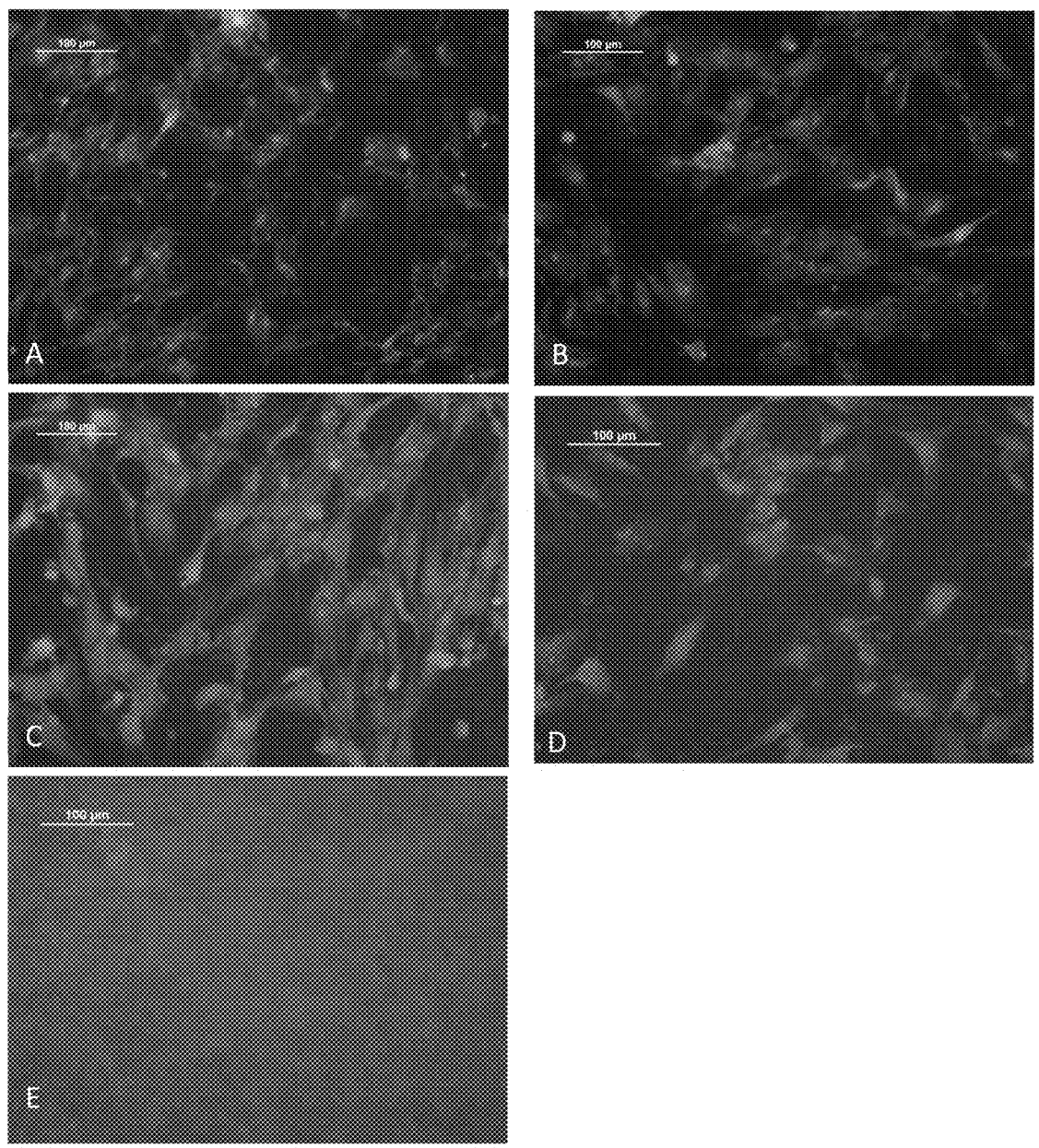

FIG. 14: Entry of miPEP//15a-16-FAM-TAT in mesenchymal stem cells.

The undifferentiated mesenchymal stem cells were treated for 6 hours with miPEP//15a-16-1-1-FAM-TAT at 5 μM (A), 10 μM (B), 20 μM (C), 50 μM (D) or 100 μM (E).

Figure 15:
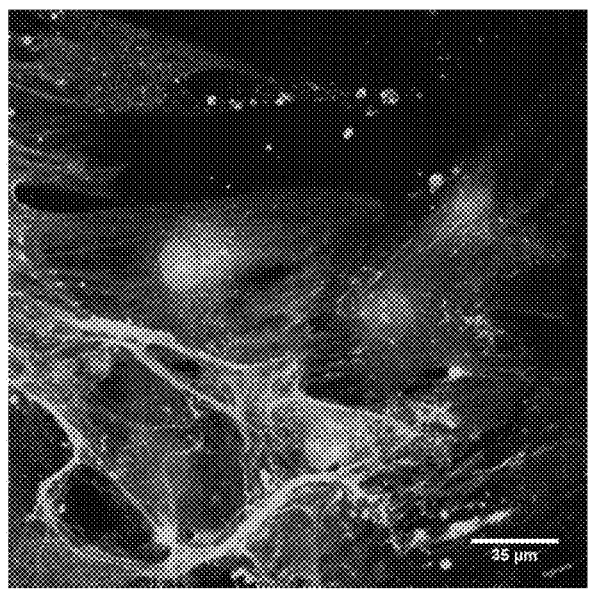

FIG. 15: Entry of miPEP//15a-16-FAM-TAT in mesenchymal stem cells.

The undifferentiated mesenchymal stem cells were treated for 2 hours with miPEP//15 a-16-1-1-FAM-TAT at 10 μM.

Figure 16:
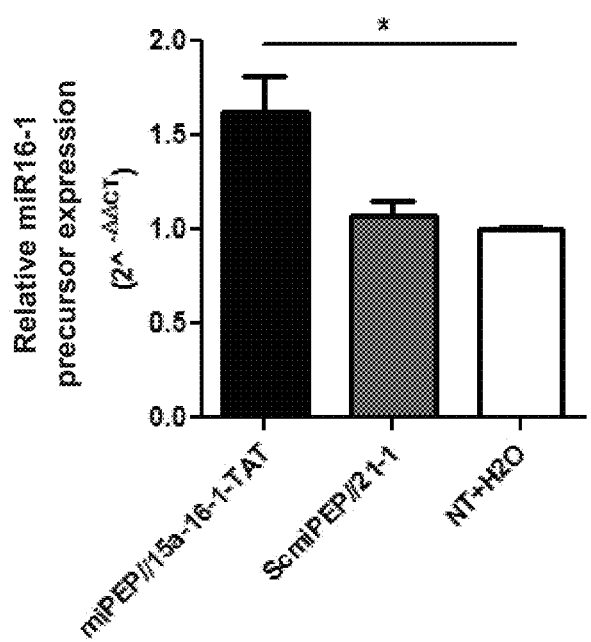

FIG. 16: Accumulation of the miR16-1 precursor in the presence of miPEP//15a-16-1-TAT.

The mesenchymal stem cells were treated with 10 μM of miPEP//15a-16-1-TAT, treated with 10 μM of control peptide (ScmiPEP//21-1) or untreated (NT) for 3 hours. The amount of miR16-1 precursor in cells has been measured by quantitative RT-PCR. The measurement of the amount of miR16-1 precursor was normalized with respect to the PPIA household gene. Analyzes and statistics were performed with the Mann-Withney test (p-value: * p<0.05;  p<0.01 and * p<0.001).

Figure 17:
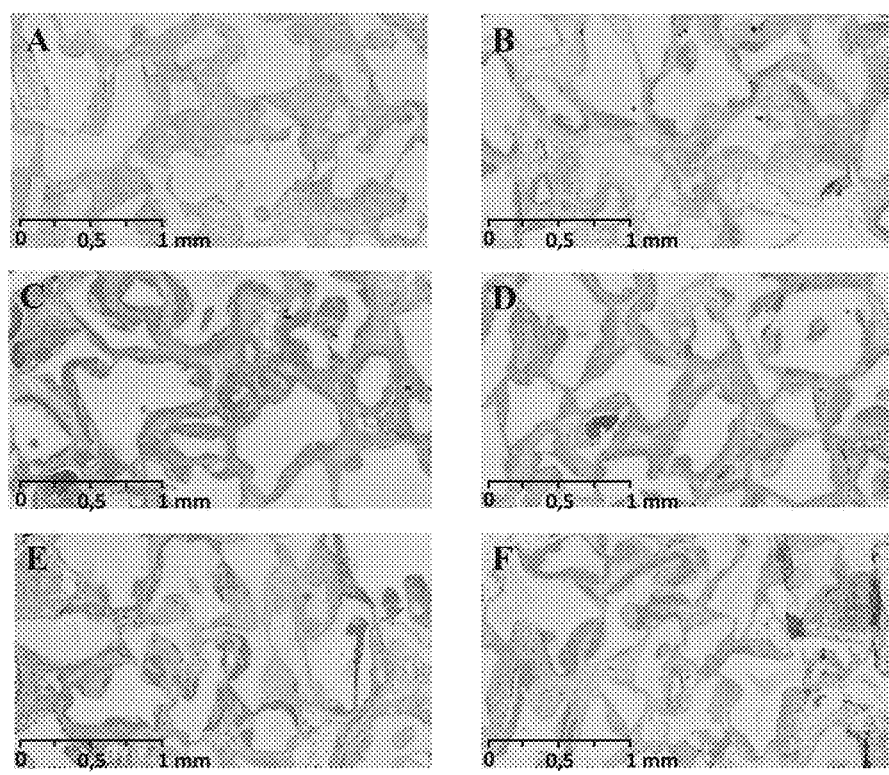
Figure 17:
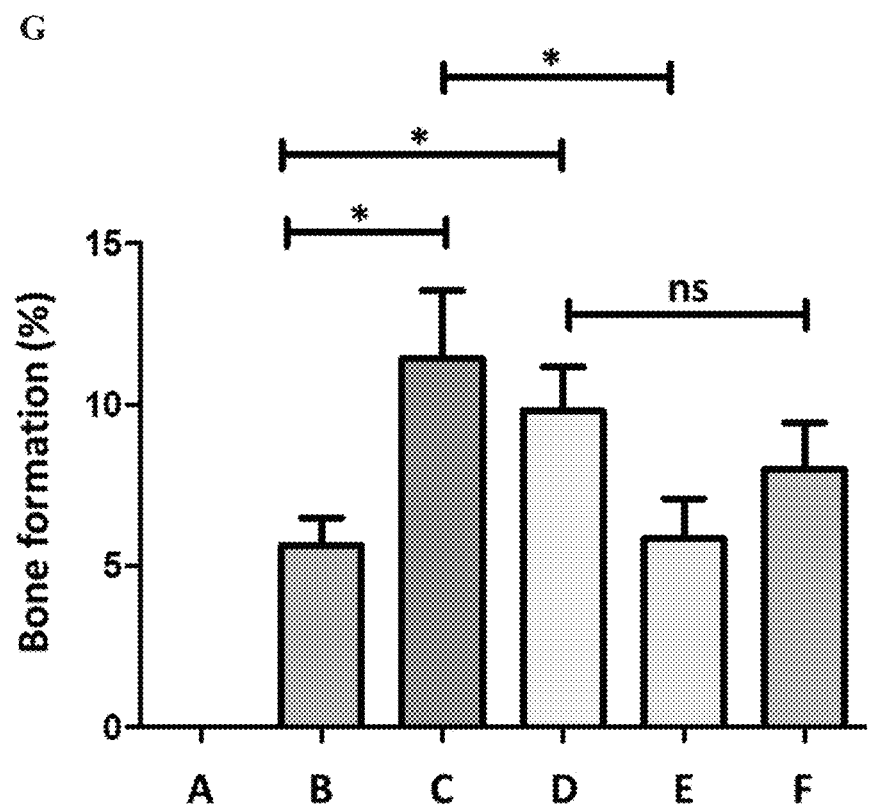

FIG. 17: Evaluation of the effects of miPEP125a-1 on bone formation in vivo.

Nude mice were grafted with
- A. the biomaterial alone,
- B. mesenchymal stem cells mixed with biomaterial (granules of βTCP [20/80]),
- C. & D. mesenchymal stem cells pretreated for 4 days with miPEP//125a-1 mixed with biomaterial (granules of βTCP [20/80]),
- E. & F. mesenchymal stem cells pre-treated 4 days with the control miPEP (scramble) mixed with biomaterial (granules of βTCP [20/80]).

For D. and F. conditions, mice also received regular injections (once a week) of either miPEP//125a-1 (D) or scramble miPEP (F) during the study. After 4 weeks, the mice are euthanized and the grafts were then isolated, fixed, included in methacrylate, cut and treated for histology. The cuts were scanned (NDPview) and bone formation (dark grey) is evaluated (A to F) and is also quantified (G) using the Fiji image analysis software and the total area of new bone is reported to the total area of the cut With regard to microscopic photographs A to F, the scale is indicated in the figure. For G, the y-axis indicates the percentage of bone formation and the statistical analyzes were performed with the paired t-test (p-value: * p<0.05;  p<0.01 and * p<0.001).

DETAILED DESCRIPTION

In one aspect, the invention relates to a pharmaceutical composition comprising:
- a miPEP from 3 to 500 amino acids encoded by a nucleotide sequence contained in the primary transcript of a miR, or a fragment of said miPEP, said miPEP being capable of modulating the accumulation of said miR in a eukaryotic cell, and
- a pharmaceutically acceptable excipient.

In the invention, the terms "microARN", "non coding microARN" and "miR" are equivalent and may be used interchangeably. They define small molecules of RNA of about 21 nucleotides, which are not translated and do not lead to a peptide or a protein.

However, in this mature form, the microRNAs perform a function of regulation of certain genes via post-transcriptional mechanisms, for example by means of the RISC complex.

The primary transcript of the microRNA or "pri-miR" corresponds to the RNA molecule obtained directly from transcription of the DNA molecule. Generally, this primary transcript undergoes one or more post-transcriptional modifications, involving for example a particular structure of the RNA or cleavage of certain portions of the RNA, and which lead to the precursor form of the microRNA or "pre-miR", then to the mature form of the microRNA or "miR".

The terms "micropeptides" and "miPEPs" (microRNA encoded PEPtides) are equivalent and may be used interchangeably. They define a peptide that is encoded by an open reading frame present on the primary transcript of a microRNA, and which is capable of modulating the accumulation of said microRNA. The micropeptides within the meaning of the present invention are not to be understood as necessarily being small peptides, as "micro" does not correspond to the size of the peptide.

According to the invention, a miPEP can also be considered as a transcription modulator, and in particular a transcription activator. Such a transcription modulator can operate at the transcription level to modulate the accumulation of pri-miR, pre-miR and miR.

Taking into account the degeneracy of the genetic code, one and the same micropeptide may be encoded by several nucleotide sequences. Nucleotide sequences of this kind, differing from one another by at least one nucleotide but encoding one and the same peptide, are called "degenerate sequences".

The terms "open reading frame" or "ORF" are equivalent and may be used interchangeably. They correspond to a nucleotide sequence in a DNA or RNA molecule that may potentially encode a peptide or a protein: said open reading frame begins with a start codon (the start codon generally encoding a methionine), followed by a series of codons (each codon encoding an amino acid), and ends with a stop codon (the stop codon not being translated).

In the invention, the ORFs may be called specifically "miORFs" when they are present on the primary transcripts of microRNA.

The miORFs may be contained in the 5' or 3' portion of said primary microAR transcript, preferably in the 5' portion.

The 5 or 3 portions of the primary microRNA transcript correspond to the terminal portions of the RNA molecule that are cleaved during microRNA processing.

The miORFs as defined in the particular invention may have a size from 12 to 1503 nucleotides and may encode peptides from 3 to 500 amino acids.

In particular, the miORFs encode miPEPs having a size of: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 amino acids.

The miPEPs may especially have a size from 100 to 500 amino acids, from 101 to 500 amino acids, from 200 to 500 amino acids, from 300 to 500 amino acids, or from 400 to 500 amino acids.

According to the invention, a "miPEP fragment" corresponds to an N-terminal part, a C-terminal part or an internal part of the sequence of a miPEP.

In others words, a "miPEP fragment" corresponds to a part of a miPEP containing the first N-terminal amino acid, to a part of the miPEP containing the last C-terminal amino acid or to a part containing neither the first N-terminal amino acid or the last C-terminal amino acid.

In particular, a miPEP fragment has a size from 2 to 20 amino acids, preferably from 5 to 10 amino acids.

In particular, a miPEP fragment has a size of 2, 3, 4, 5, 6, 7, 8, 9, 10, 11, 12, 13, 14, 15, 16, 17, 18, 19 or 20 amino acids.

Preferably, a miPEP fragment has a size of 10 amino acids and corresponds to the N-terminal portion of a miPEP.

In the present invention, a miPEP fragment may be referred to as "miPEP//".

In the invention, "accumulation" means the production of a molecule, such as a microRNA or a micropeptide, in the cell.

The accumulation of a microRNA or a micropeptide can be determined using assay methods known to those skilled in the art, such as for example by RT-qPCR or by the quantification of the fluorescence due to the fusion of a peptide or protein to a fluorescent marker.

Thus, "modulation" of the accumulation of a molecule in a cell corresponds to a modification of the quantity of this molecule present in the cell.

Moreover, the effect of a miPEP can be observed through the modulation of the accumulation of the miR, but also through the modulation of the accumulation of the corresponding pri-miR or pre-miR.

In one embodiment, the invention relates to a composition as defined above, wherein the modulation of the accumulation of said microRNA is a decrease or an increase in the accumulation of said microRNA, in particular an increase.

A "decrease in the accumulation" corresponds to a decrease in the quantity of said molecule in a cell relative to a control cell.

Conversely, an "increase in the accumulation" corresponds to an increase in the quantity of said molecule in a cell relative to a control cell.

According to the invention, a miPEP is capable of modulating the accumulation of pri-miR, pre-miR and miR. Therefore, if a primary transcript contains more than one miR, a same miPEP encoded by said primary transcript is capable of modulating the accumulation of at least one of the miRs present on the primary transcript.

In a particular embodiment, the invention relates to a pharmaceutical composition comprising:
- a miPEP from 3 to 500 amino acids encoded by a nucleotide sequence contained in the primary transcript of a miR, or a fragment of said miPEP, said miPEP being capable of modulating the accumulation of said miR in a eukaryotic cell, which miR regulates expression of at least one gene involved in a pathology,
- a pharmaceutically acceptable excipient.

According to the invention, said pharmaceutical composition comprises at least one miPEP but may also comprise a mixture of several miPEPs.

In a nonlimiting manner, said pharmaceutical composition may for example comprise 2, 3, 4, 5, 6, 7, 8, 9 or 10 miPEPs.

In a particular embodiment, the invention relates to a pharmaceutical composition as defined above, wherein said miPEP is selected from the group of miPEPs consisting of SEQ ID NO: 2q-1, q varying from 1 to 5 875.

In a particular embodiment, the invention relates to a pharmaceutical composition as defined above, wherein said miPEP is selected from the group of miPEPs consisting of:

miPEP 145-2
(MVGLNPPLWQETGEYT, SEQ ID NO: 11 745), miPEP 125a-1
(MSLCLSPSLTPTPGSTGPPHTMLPVSRSLRPFNL, SEQ ID NO:
11 747), ant miPEP 15a-16-1
(MFKHRFFYMHSFFPERKYFLYSLGANVCLKKIKPWSKV

AAHNGLWILKRCRPYCAASKIQGSDLLKKIYFFLFIALMIAMSAVP,

SEQ ID NO: 11 749).

In a particular embodiment, the invention relates to a pharmaceutical composition as defined above, wherein said miPEP fragment is a fragment of miPEP 145-2, preferably consisting of SEQ ID NO: 11 751 (MVGLNPPLWQ).

In a particular embodiment, the invention relates to a pharmaceutical composition as defined above, wherein said miPEP fragment is the miPEP//145-2 consisting of SEQ ID NO: 11 751 (MVGLNPPLWQ).

In a particular embodiment, the invention relates to a pharmaceutical composition as defined above, wherein said miPEP fragment is a fragment of miPEP 125a-1, preferably consisting of SEQ ID NO: 11 752 (MSLCLSPSLT).

In a particular embodiment, the invention relates to a pharmaceutical composition as defined above, wherein said miPEP fragment is the miPEP//125a-1 consisting of SEQ ID NO: 11 752 (MSLCLSPSLT).

In a particular embodiment, the invention relates to a pharmaceutical composition as defined above, wherein said miPEP fragment is a fragment of miPEP 15a-16-1, preferably consisting of SEQ ID NO: 11 753 (MFKHRFFYMH).

In a particular embodiment, the invention relates to a pharmaceutical composition as defined above, wherein said miPEP fragment is the miPEP//15a-16-1 consisting of SEQ ID NO: 11 753 (MFKHRFFYMH).

Figure 1:
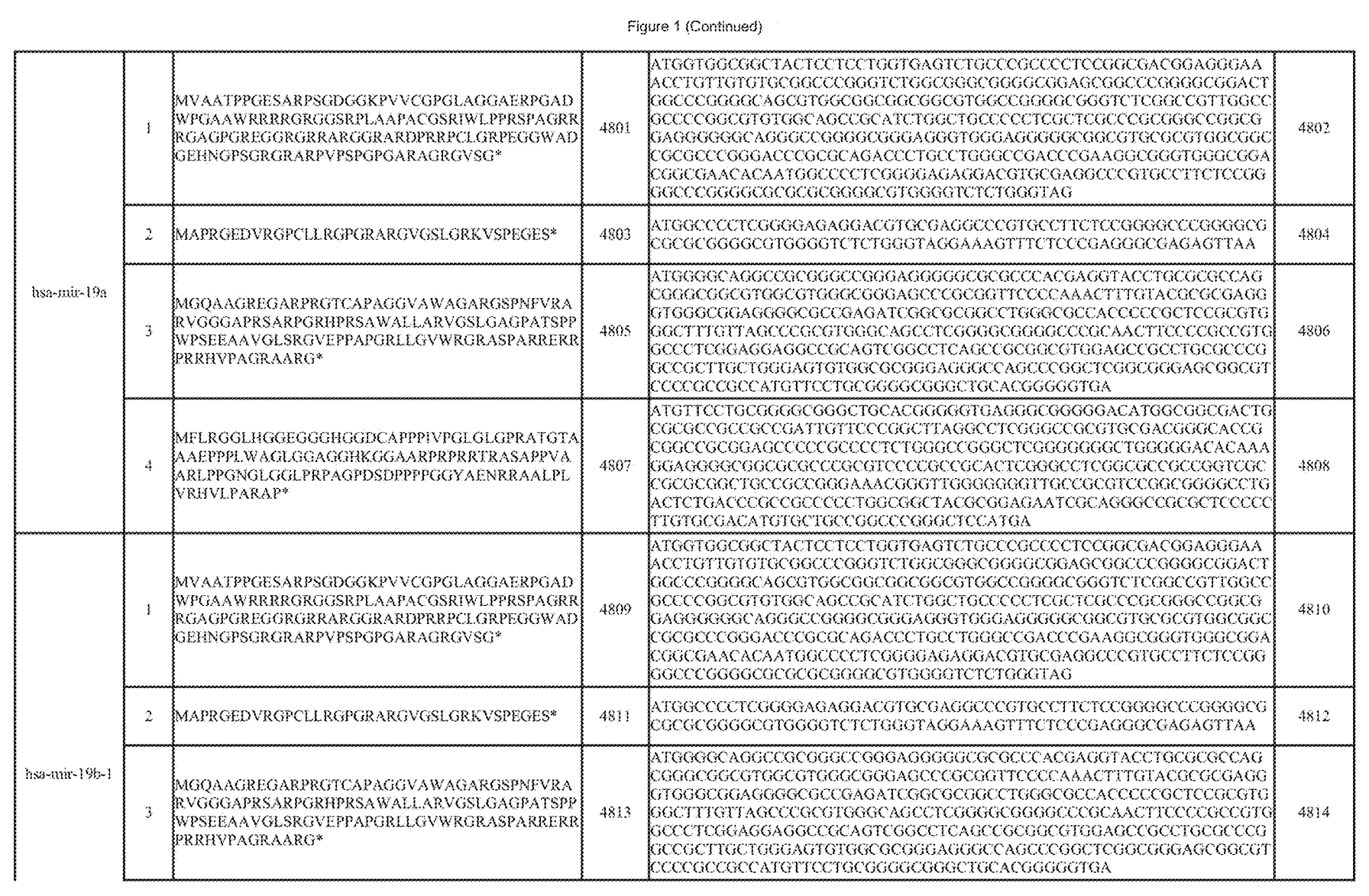
Figure 1:
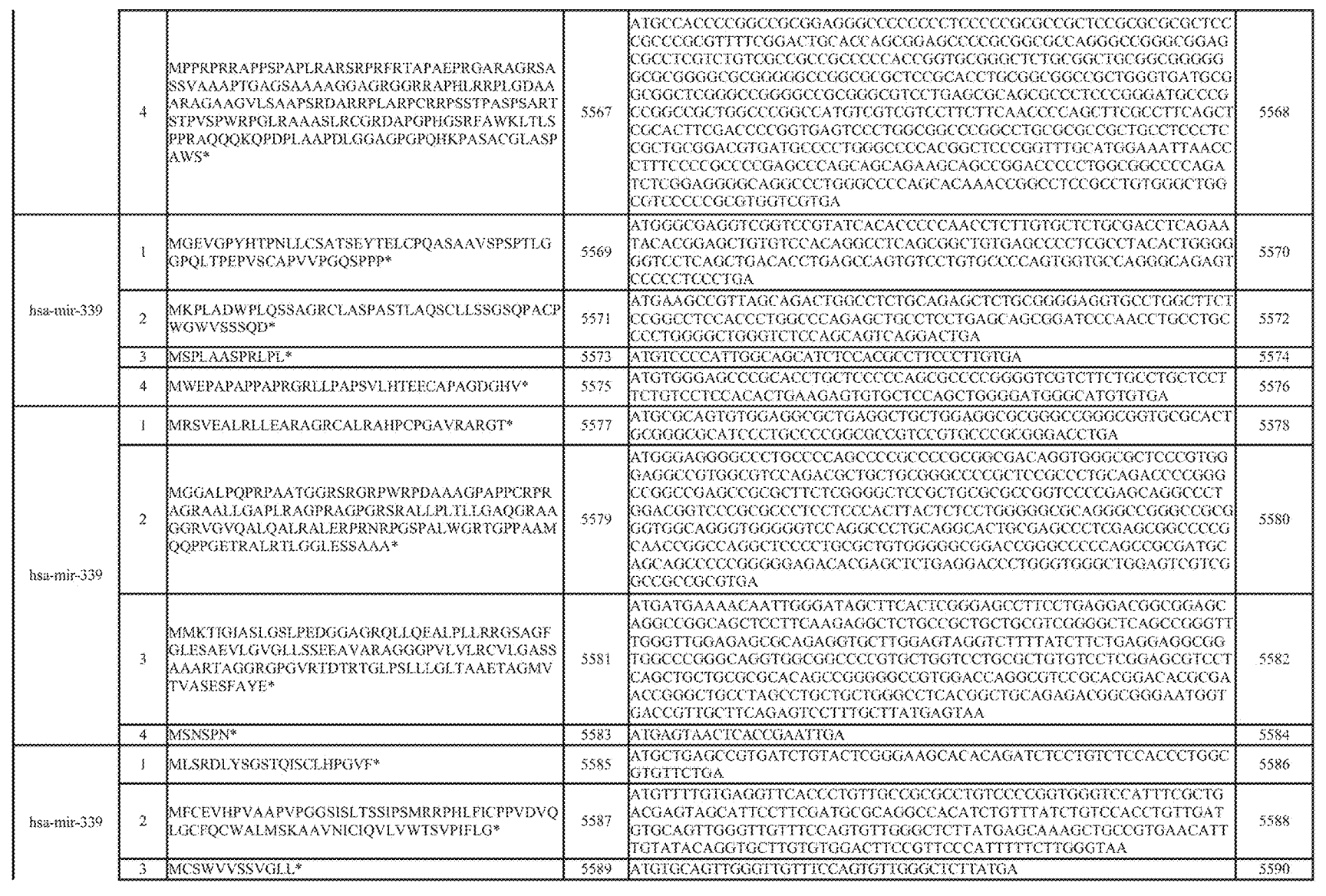
Figure 1:
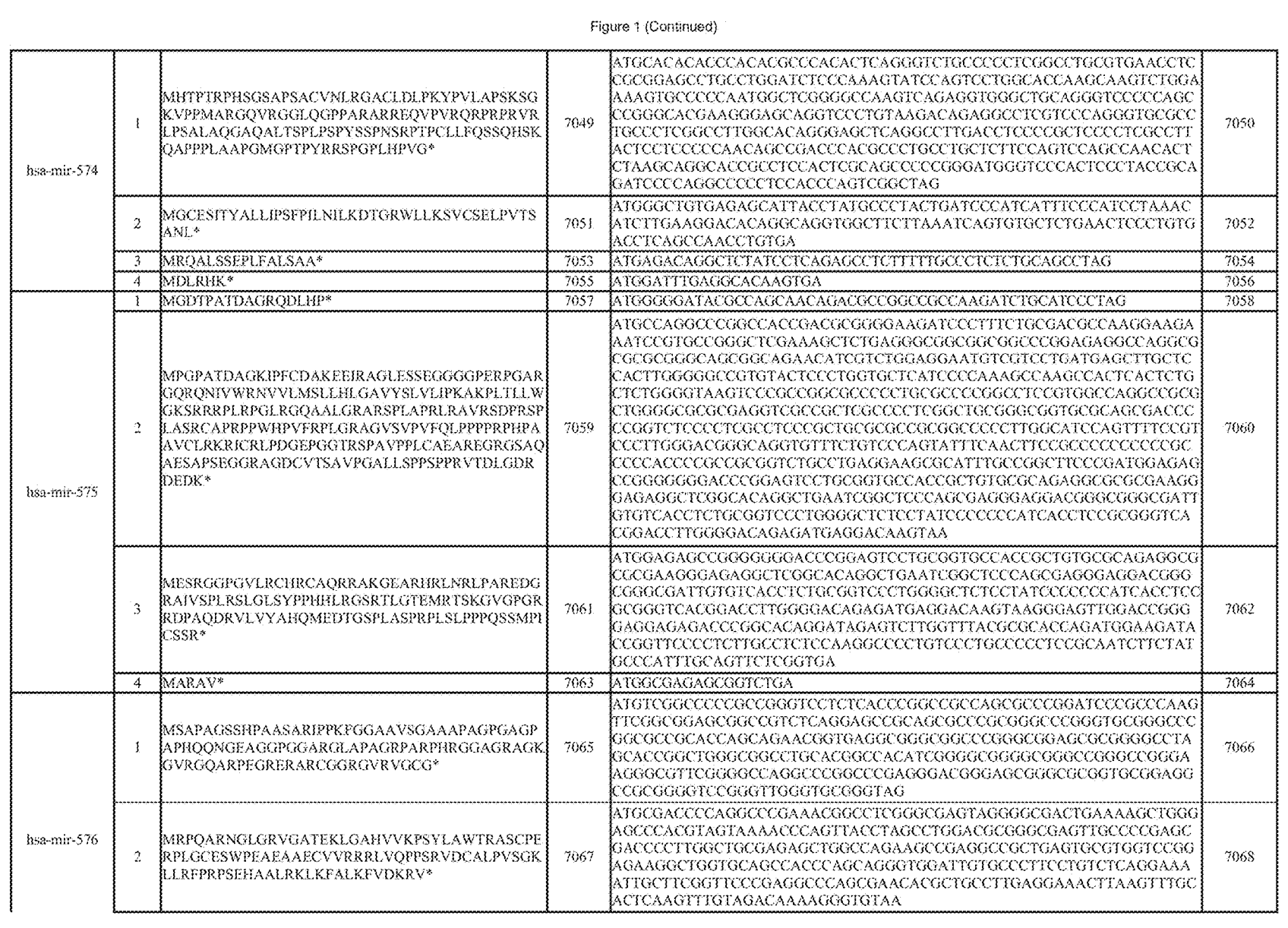
Figure 1:
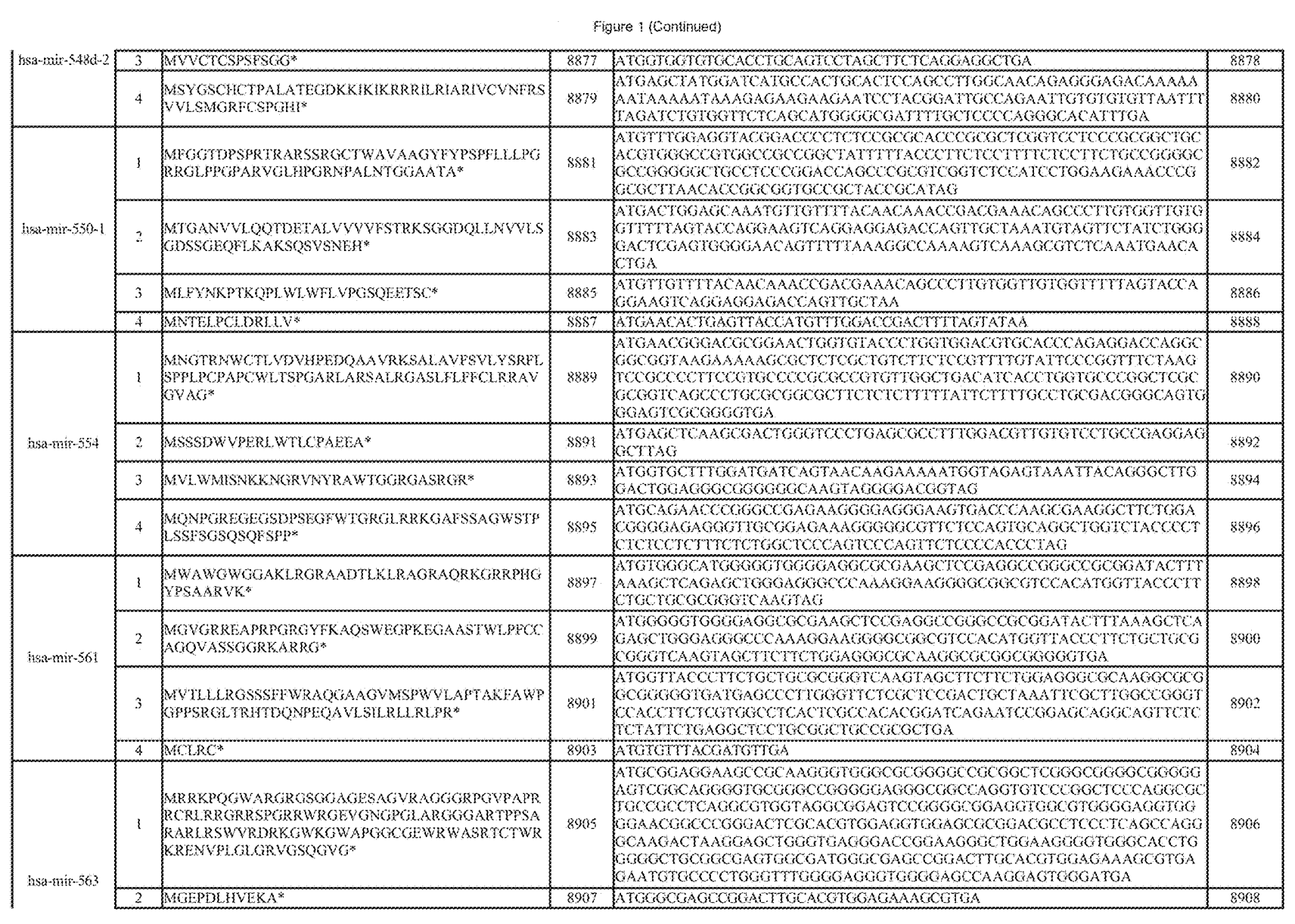

The list of all miPEPs, and corresponding miORPs, is presented in FIG. 1 and is incorporated in this application.

In a particular embodiment, the pharmaceutical compositions comprising the miPEPs are in the form of a unit dose comprising from $10^{-4}$ M to $10^{-10}$ M of miPEP.

In a particular embodiment, the compositions according to the invention can be administered in one or more times.

In a particular embodiment, the pharmaceutical compositions are suitable for oral, ocular, nasal, parenteral (intravenous, intraarterial, subcutaneous, intradermal, intramuscular), rectal, vaginal, topical or auricular administration.

In a particular embodiment, the miPEP can be vectorized or encapsulated.

In the invention, the miPEP, or the fragment of said miPEP, may be fused or linked to one or more molecules facilitating the entry of the miPEP, or miPEP fragment, into the cell.

In a particular embodiment, the invention relates to a pharmaceutical composition as defined above, wherein said miPEP, or said fragment of said miPEP, is fused to a peptide facilitating the entry into the cell of the miPEP, or miPEP fragment.

In a particular embodiment, the invention relates to a pharmaceutical composition as defined above, wherein said miPEP, or said fragment of said miPEP, is fused to the TAT peptide (YGRKKRRQRRR, SEQ ID NO: 11 754).

In a particular embodiment, the invention relates to a pharmaceutical composition as defined above, wherein said miPEP, or said fragment of said miPEP, is fused in N-ter or in C-ter to the TAT peptide (YGRKKRRQRRR, SEQ ID NO: 11 754).

In a particular embodiment, the invention relates to a pharmaceutical composition as defined above, wherein said miPEP fragment is selected from:

miPEP//145-2-TAT consisting of SEQ ID NO: 11 755
(MVGLNPPLWQ-YGRKKRRQRRR), miPEP//125a-1-TAT consisting of SEQ ID NO: 11 756
(MSLCLSPSLT-YGRKKRRQRRR),
and miPEP//15a-16-1-TAT consisting of SEQ ID NO: 11 757
(MFKHRFFYMH-YGRKKRRQRRR).

In a particular embodiment, the invention relates to a pharmaceutical composition as defined above, wherein said miPEP, or said fragment of said miPEP, is fused to penetratin, to a polyhistidine peptide (in particular a peptide of at least 6 histidine residues) or to a polyarginine peptide (in particular a peptide of 9 arginine residues).

In a particular embodiment, the invention relates to a pharmaceutical composition as defined above, wherein said miPEP, or said fragment of said miPEP, is linked to one or more palmitic acid molecules.

The amount of miPEP present in the composition or used for the treatment of a pathology may vary depending on whether or not the miPEP is modified with a molecule facilitating cell penetration.

In another aspect, the invention relates to a miPEP from 3 to 500 amino acids encoded by a nucleotide sequence contained in the primary transcript of a miR, or a fragment of said miPEP, said miPEP being capable of modulating the accumulation of said miR in a eukaryotic cell, for its use as a drug.

In a particular embodiment, the invention relates to a miPEP from 3 to 500 amino acids encoded by a nucleotide sequence contained in the primary transcript of a miR, or a fragment of said miPEP, said miPEP being capable of modulating the accumulation of said miR in a eukaryotic cell, which miR regulates expression of at least one gene involved in a pathology, for its use as a drug.

In the invention, a gene is involved in a pathology if the expression of said gene varies significantly between a patient suffering from said pathology and a healthy individual.

In a particular embodiment, the invention relates to a miPEP, or a fragment of said miPEP, for its use as defined above, said miPEP being identified, or as identified, by implementing of a process for identifying a miPEP modulating the accumulation of a miR involved in a pathology, comprising:
  a) a step of detecting an open reading frame from 12 to 1 503 nucleotides contained in the sequence of the primary transcript of said miR, then
  b) a step of comparison between:
    i. the accumulation of said miR in a specified eukaryotic cell expressing the primary transcript of said miR, in the presence of a peptide encoded by a nucleotide sequence that is identical or degenerate relative to that of said open reading frame, said peptide being present in the cell independently of transcription of the primary transcript of said miR, and
    ii. the accumulation of said miR in a eukaryotic cell of the same type as the aforesaid specified eukaryotic cell expressing the primary transcript of said miR, in the absence of said peptide,
in which a modulation of the accumulation of said miR in the presence of said peptide relative to the accumulation of said miR in the absence of said peptide indicates the existence of a miPEP, the latter being encoded by said open reading frame and being capable of modulating the accumulation of said miR involved in a pathology.

In the invention, a miR is involved in a pathology if said miR is capable of regulating the expression of a gene involved in said pathology and/or of reducing the symptoms of said pathology.

In a particular embodiment, the invention relates to a miPEP, or a fragment of said miPEP, for its use as defined above, said miPEP being encoded by a nucleotide sequence contained in the primary transcript of a miR selected from those presented in Tables 2, 3, 4, 5 and 6.

In a particular embodiment, the invention relates to a miPEP, or a fragment of said miPEP, for its use as defined above, said miPEP being encoded by a nucleotide sequence contained in the primary transcript of a miR selected from the group consisting of:
hsa-mir-103-1, hsa-mir-103-2, hsa-mir-107, hsa-mir-122, hsa-mir-155, hsa-mir-21, hsa-mir-33, hsa-mir-15a, hsa-miR-15b, hsa-mir-451, hsa-mir-92a-1, hsa-mir-92a-2, hsa-mir-92b, hsa-mir-208, hsa-mir-208b, hsa-mir-29a, hsa-mir-29b-1, hsa-mir-29b-2, hsa-mir-29c, hsa-mir-143, hsa-mir-145, hsa-mir-206, hsa-mir-378, hsa-mir-34a, hsa-mir-34b, hsa-mir-34c, hsa-let-7, hsa-mir-16-1, hsa-mir-16-2 and hsa-mir-125a.

In a particular embodiment, the invention relates to a miPEP, or a fragment of said miPEP, for its use as defined above, said miPEP being encoded by a nucleotide sequence contained in the primary transcript of a miR selected from the group consisting of: hsa-mir-125a, hsa-mir-15a-16-1 and hsa-mir145.

In a particular embodiment, the invention relates to a miPEP, or a fragment of said miPEP, for its use as defined above, said miPEP being selected from the group consisting of SEQ ID NO: 2q-1, q varying from 1 to 5 875.

In a particular embodiment, the invention relates to a miPEP, or a fragment of said miPEP, for its use as defined above, said miPEP being selected from the group consisting of: miPEP 145-2 (SEQ ID NO: 11745), miPEP 125a-1 (SEQ ID NO: 11747) and miPEP 15a-16-1 (SEQ ID NO: 11 749).

In a particular embodiment, the invention relates to a miPEP, or a fragment of said miPEP, for its use as defined above, said miPEP fragment being a fragment of miPEP 145-2, preferably consisting of SEQ ID NO: 11 751.

In a particular embodiment, the invention relates to a miPEP, or a fragment of said miPEP, for its use as defined above, said miPEP fragment being miPEP//145-2 consisting of SEQ ID NO: 11 751.

In a particular embodiment, the invention relates to a miPEP, or a fragment of said miPEP, for its use as defined above, said miPEP fragment being a fragment of miPEP 125a-1, preferably consisting of SEQ ID NO: 11 752.

In a particular embodiment, the invention relates to a miPEP, or a fragment of said miPEP, for its use as defined above, said miPEP fragment being miPEP//125a-1 consisting of SEQ ID NO: 11 752.

In a particular embodiment, the invention relates to a miPEP, or a fragment of said miPEP, for its use as defined above, said miPEP fragment being a fragment of miPEP 15a-16-1, preferably consisting of SEQ ID NO: 11 753.

In a particular embodiment, the invention relates to a miPEP, or a fragment of said miPEP, for its use as defined above, said miPEP fragment being miPEP//15a-16-1 consisting of SEQ ID NO: 11 753.

In a particular embodiment, the invention relates to a miPEP, or a fragment of said miPEP, for its use as defined above, wherein said miPEP, or said fragment of said miPEP, is fused to the TAT peptide.

In a particular embodiment, the invention relates to a miPEP fragment for its use as defined above, said miPEP fragment being selected from:

```
miPEP//145-2-TAT consisting of SEQ ID NO: 11 755
(MVGLNPPLWQ-YGRKKRRQRRR), miPEP//125a-1-TAT consisting of SEQ ID NO: 11 756
(MSLCLSPSLT-YGRKKRRQRRR),
and miPEP//15a-16-1-TAT consisting of SEQ ID NO: 11 757
(MFKHRFFYMH-YGRKKRRQRRR).
```

In a particular embodiment, the invention relates to a miPEP, or a fragment of said miPEP, for its use as defined above, wherein said miPEP, or said fragment of said miPEP, being fused to penetratin, to a polyhistidine peptide (in particular a peptide of at least 6 histidine residues) or to a polyarginine peptide (in particular a peptide of 9 arginine residues).

In a particular embodiment, the invention relates to a miPEP, or a fragment of said miPEP, for its use as defined above, wherein said miPEP, or said fragment of said miPEP, being linked to one or more palmitic acid molecules.

Another aspect of the invention relates to a miPEP from 3 to 500 amino acids encoded by a nucleotide sequence contained in the primary transcript of a miR, or a fragment of said miPEP, said miPEP being capable of modulating the accumulation of said miR in a eukaryotic cell, for its use in the treatment of a pathology selected from: cancer, bacterial infections, mycoses, cardiovascular diseases, hereditary congenital diseases, skin diseases, eye diseases, diseases of the digestive system, diseases of the endocrine system, diseases of the nervous system, diseases related to viruses, diseases related to nutrition and metabolism, lymphatic diseases and hemopathies, neonatal and hereditary diseases, respiratory diseases, urogenital diseases in humans, urogenital diseases in women, disorders of the immune system, musculoskeletal disorders, diseases or trauma of bone tissue or cartilage tissue.

Another aspect of the invention relates to a miPEP from 3 to 500 amino acids encoded by a nucleotide sequence contained in the primary transcript of a miR, or a fragment of said miPEP, said miPEP being capable of modulating the accumulation of said miR in a eukaryotic cell, for its use in the treatment of a disease or trauma of bone tissue or cartilage tissue.

In the invention, the term "bone tissue disease" refers to any disease reducing bone capital, such as osteoporosis.

In the invention, the term "bone tissue trauma" refers to a break in continuity or fracture of a bone.

In a particular embodiment, the invention relates to a miPEP from 3 to 500 amino acids encoded by a nucleotide sequence contained in the primary transcript of a miR, or a fragment of said miPEP, said miPEP being capable of modulating the accumulation of said miR in a eukaryotic cell, for its use as defined above, which miR regulates expression of at least one gene involved in a pathology.

In a particular embodiment, the invention relates to a miPEP, or a fragment of said miPEP, for its use as defined above, said miPEP being identified, or as identified, by implementing of a process for identifying a miPEP modulating the accumulation of a miR involved in a pathology, comprising:
  a) a step of detecting an open reading frame from 12 to 1 503 nucleotides contained in the sequence of the primary transcript of said miR, then
  b) a step of comparison between:
    i. the accumulation of said miR in a specified eukaryotic cell expressing the primary transcript of said miR, in the presence of a peptide encoded by a nucleotide sequence that is identical or degenerate relative to that of said open reading frame, said peptide being present in the cell independently of transcription of the primary transcript of said miR, and
    ii. the accumulation of said miR in a eukaryotic cell of the same type as the aforesaid specified eukaryotic cell expressing the primary transcript of said miR, in the absence of said peptide, in which a modulation of the accumulation of said miR in the presence of said peptide relative to the accumulation of said miR in the absence of said peptide indicates the existence of a miPEP, the latter being encoded by said open reading frame and being capable of modulating the accumulation of said miR involved in a pathology.

In a particular embodiment, the invention relates to a miPEP, or a fragment of said miPEP, for its use as defined above, said miPEP being selected from the group consisting of SEQ ID NO: 2q-1, q varying from 1 to 5 875.

In a particular embodiment, the invention relates to a miPEP, or a fragment of said miPEP, for its use as defined above, said miPEP being selected from the group consisting of: miPEP 145-2 (SEQ ID NO: 11745), miPEP 125a-1 (SEQ ID NO: 11747) and miPEP 15a-16-1 (SEQ ID NO: 11 749).

In a particular embodiment, the invention relates to a miPEP, or a fragment of said miPEP, for its use as defined above, said miPEP fragment being a fragment of miPEP 145-2, preferably consisting of SEQ ID NO: 11 751.

In a particular embodiment, the invention relates to a miPEP, or a fragment of said miPEP, for its use as defined above, said miPEP fragment being miPEP//145-2 consisting of SEQ ID NO: 11 751.

In a particular embodiment, the invention relates to a miPEP, or a fragment of said miPEP, for its use as defined above, said miPEP fragment being a fragment of miPEP 125a-1, preferably consisting of SEQ ID NO: 11 752.

In a particular embodiment, the invention relates to a miPEP, or a fragment of said miPEP, for its use as defined above, said miPEP fragment being miPEP//125a-1 consisting of SEQ ID NO: 11 752.

In a particular embodiment, the invention relates to a miPEP, or a fragment of said miPEP, for its use as defined above, said miPEP fragment being a fragment of miPEP 15a-16-1, preferably consisting of SEQ ID NO: 11 753.

In a particular embodiment, the invention relates to a miPEP, or a fragment of said miPEP, for its use as defined above, said miPEP fragment being miPEP//15a-16-1 consisting of SEQ ID NO: 11 753.

In a particular embodiment, the invention relates to a miPEP, or a fragment of said miPEP, for its use as defined above, wherein said miPEP, or said fragment of said miPEP, is fused to the TAT peptide.

In a particular embodiment, the invention relates to a miPEP fragment for its use as defined above, said miPEP fragment being selected from:

miPEP//145-2-TAT consisting of SEQ ID NO: 11 755 (MVGLNPPLWQ-YGRKKRRQRRR), miPEP//125a-1-TAT consisting of SEQ ID NO: 11 756 (MSLCLSPSLT-YGRKKRRQRRR), and miPEP//15a-16-1-TAT consisting of SEQ ID NO: 11 757 (MFKHRFFYMH-YGRKKRRQRRR).

In a particular embodiment, the invention relates to a miPEP, or a fragment of said miPEP, for its use as defined above, wherein said miPEP, or said fragment of said miPEP, being fused to penetratin, to a polyhistidine peptide (in particular a peptide of at least 6 histidine residues) or to a polyarginine peptide (in particular a peptide of 9 arginine residues).

In a particular embodiment, the invention relates to a miPEP, or a fragment of said miPEP, for its use as defined above, wherein said miPEP, or said fragment of said miPEP, being linked to one or more palmitic acid molecules.

Tables 2 to 6 present the different miRs and the pathologies in which they are involved.

In a particular embodiment, the invention relates to a miPEP, or a fragment of said miPEP, for its use as defined above, said pathology being a cancer, said miPEP being encoded by a nucleotide sequence contained in the primary transcript of a miR selected from the cancer-related miRs in Table 2, particularly among the cancer-related miRs in Table 5.

In a particular embodiment, the invention relates to a miPEP, or a fragment of said miPEP, for its use as defined above, said pathology being a bacterial infection or mycosis, said miPEP being encoded by a nucleotide sequence contained in the primary transcript of a miR selected from the bacterial infection- and mycosis-related miRs in Table 2, particularly among the bacterial infection- and mycosis-related miRs in Table 5.

In a particular embodiment, the invention relates to a miPEP, or a fragment of said miPEP, for its use as defined above, said pathology being a cardiovascular disease, said miPEP being encoded by a nucleotide sequence contained in the primary transcript of a miR selected from the cardiovascular disease-related miRs in Table 2, particularly among the cardiovascular disease-related miRs in Table 5.

In a particular embodiment, the invention relates to a miPEP, or a fragment of said miPEP, for its use as defined above, said pathology being a hereditary congenital disease, said miPEP being encoded by a nucleotide sequence contained in the primary transcript of a miR selected from the hereditary congenital disease-related miRs in Table 2, particularly among the hereditary congenital disease-related miRs in Table 5.

In a particular embodiment, the invention relates to a miPEP, or a fragment of said miPEP, for its use as defined above, said pathology being a skin disease, said miPEP being encoded by a nucleotide sequence contained in the primary transcript of a miR selected from the skin disease-related miRs in Table 2, particularly among the skin disease-related miRs in Table 5.

In a particular embodiment, the invention relates to a miPEP, or a fragment of said miPEP, for its use as defined above, said pathology being a eye disease, said miPEP being encoded by a nucleotide sequence contained in the primary transcript of a miR selected from the eye disease-related miRs in Table 2, particularly among the eye disease-related miRs in Table 5.

In a particular embodiment, the invention relates to a miPEP, or a fragment of said miPEP, for its use as defined above, said pathology being a disease of the digestive system, said miPEP being encoded by a nucleotide sequence contained in the primary transcript of a miR selected from disease of the digestive system-related miRs in Table 3, particularly among disease of the digestive system-related miRs in Table 5.

In a particular embodiment, the invention relates to a miPEP, or a fragment of said miPEP, for its use as defined above, said pathology being a disease of the endocrine system, said miPEP being encoded by a nucleotide sequence contained in the primary transcript of a miR selected from disease of the endocrine system-related miRs in Table 3, particularly among disease of the endocrine system-related miRs in Table 6.

In a particular embodiment, the invention relates to a miPEP, or a fragment of said miPEP, for its use as defined above, said pathology being a disease of the nervous system, said miPEP being encoded by a nucleotide sequence contained in the primary transcript of a miR selected from disease of the nervous system-related miRs in Table 3, particularly among disease of the nervous system-related miRs in Table 6.

In a particular embodiment, the invention relates to a miPEP, or a fragment of said miPEP, for its use as defined above, said pathology being a disease linked to a virus, said miPEP being encoded by a nucleotide sequence contained in the primary transcript of a miR selected from disease linked to a virus-related miRs in Table 3, particularly among disease linked to a virus-related miRs in Table 6.

In a particular embodiment, the invention relates to a miPEP, or a fragment of said miPEP, for its use as defined above, said pathology being a disease related to nutrition and metabolism, said miPEP being encoded by a nucleotide sequence contained in the primary transcript of a miR selected from disease related to nutrition and metabolism-related miRs in Table 3, particularly among disease related to nutrition and metabolism-related miRs in Table 6.

In a particular embodiment, the invention relates to a miPEP, or a fragment of said miPEP, for its use as defined above, said pathology being a lymphatic disease or hemopathy, said miPEP being encoded by a nucleotide sequence contained in the primary transcript of a miR selected from lymphatic disease or hemopathy-related miRs in Table 3, particularly among lymphatic disease or hemopathy-related miRs in Table 6.

In a particular embodiment, the invention relates to a miPEP, or a fragment of said miPEP, for its use as defined above, said pathology being a neonatal and hereditary disease, said miPEP being encoded by a nucleotide sequence contained in the primary transcript of a miR selected from neonatal and hereditary disease-related miRs in Table 3, particularly among neonatal and hereditary disease-related miRs in Table 6.

In a particular embodiment, the invention relates to a miPEP, or a fragment of said miPEP, for its use as defined above, said pathology being a respiratory disease, said miPEP being encoded by a nucleotide sequence contained in the primary transcript of a miR selected from respiratory disease-related miRs in Table 4, particularly among respiratory disease-related miRs in Table 6.

In a particular embodiment, the invention relates to a miPEP, or a fragment of said miPEP, for its use as defined above, said pathology being a urogenital disease in men, said miPEP being encoded by a nucleotide sequence contained in the primary transcript of a miR selected from urogenital disease in men-related miRs in Table 4, particularly among urogenital disease in men-related miRs in Table 6.

In a particular embodiment, the invention relates to a miPEP, or a fragment of said miPEP, for its use as defined above, said pathology being a urogenital disease in women, said miPEP being encoded by a nucleotide sequence contained in the primary transcript of a miR selected from urogenital disease in women-related miRs in Table 4, particularly among urogenital disease in women-related miRs in Table 6.

In a particular embodiment, the invention relates to a miPEP, or a fragment of said miPEP, for its use as defined above, said pathology being a disorder of the immune system, said miPEP being encoded by a nucleotide sequence contained in the primary transcript of a miR selected from disorder of the immune system-related miRs in Table 4, particularly among disorder of the immune system-related miRs in Table 6.

In a particular embodiment, the invention relates to a miPEP, or a fragment of said miPEP, for its use as defined above, said pathology being a musculoskeletal disorder, said miPEP being encoded by a nucleotide sequence contained in the primary transcript of a miR selected from musculoskeletal disorder-related miRs in Table 4, particularly among musculoskeletal disorder-related miRs in Table 6.

In a particular embodiment, the invention relates to a miPEP, or a fragment of said miPEP, for its use as defined above, said pathology being a metabolism disorder, said miR being selected from: hsa-miR-103-1, hsa-miR-103-2 and hsa-mir-107, said miPEP being preferably selected from SEQ ID NOs: 73, 75, 77, 79, 81, 83, 85, 87, 2 547, 2 549, 2 551, 2 553, 3 921, 3 923, 3 925 and 3 927.

In a particular embodiment, the invention relates to a miPEP, or a fragment of said miPEP, for its use as defined above, said pathology being a hepatitis C virus infection, said miR being the hsa-miR-122, said miPEP being preferably selected from SEQ ID NOs: 97, 99, 101, 103, 2561, 2563, 2 565 and 2 567.

In a particular embodiment, the invention relates to a miPEP, or a fragment of said miPEP, for its use as defined above, said pathology being an inflammatory disease, said miR being the hsa-miR-155, said miPEP being preferably selected from SEQ ID NOs: 4 433, 4 435, 4 437, 4 439, 4 441, 4 443, 4 445, 4 447, 8 377, 8 379, 8 381 and 8 383.

In a particular embodiment, the invention relates to a miPEP, or a fragment of said miPEP, for its use as defined above, said pathology being a fibrosis, said miR being the hsa-miR-21, said miPEP being preferably selected from SEQ ID NOs: 497, 499, 501, 503, 2 793, 2 795, 2 797, 2 799, 3 425, 3 427, 3 429, 3 431, 4 937, 4 939, 4 941, 4 943, 8 545, 8 547, 8 549, 8 551, 801, 10 803, 10 805 and 10 807.

In a particular embodiment, the invention relates to a miPEP, or a fragment of said miPEP, for its use as defined above, said pathology being atherosclerosis, said miR being the hsa-miR-33, said miPEP being preferably selected from SEQ ID NOs: 5 609, 5 611, 5 613, 5 615, 8 673, 8 675, 8 677 and 8 679.

In a particular embodiment, the invention relates to a miPEP, or a fragment of said miPEP, for its use as defined above, said pathology being a cardiovascular disease, said miR being selected from: hsa-miR-15a and has-miR-15b, said miPEP being preferably selected from SEQ ID NOs: 4 449, 4 451, 4 453, 4 455, 4 457, 4 459, 4 461, 4 463, 4 465, 4 467, 4 469 and 4 471.

In a particular embodiment, the invention relates to a miPEP, or a fragment of said miPEP, for its use as defined above, said pathology being a myeloproliferative disease, said miR being the hsa-miR-451, said miPEP being preferably selected from SEQ ID NOs: 1 017, 1 019, 1 021, 1 023, 3 609, 3 611, 3 613, 3 615, 6 113, 6 115, 6 117 and 6 119.

In a particular embodiment, the invention relates to a miPEP, or a fragment of said miPEP, for its use as defined above, said pathology being linked to neoangiogenesis, said miR being selected from: hsa-mir-92a-1, hsa-mir-92a-2 and hsa-mir-92b, said miPEP being preferably selected from SEQ ID NOs: 1 777, 1 779, 1 781, 1 783, 1 785, 1 787, 1 789, 1 791, 8 033, 8 035, 8 037, 8 039, 8 041, 8 043, 8 045, 8 047, 8 049, 8 051, 8 053, 8 055, 9 225, 9 227, 9 229, 9 231, 9 233, 9 235, 9 237, 9 239, 9 241, 9 243, 9 245, 9 247, 10 345, 10 347, 10 349, 351, 10 353, 10 355, 10 357, 10 359, 10 361, 10 363, 10 365, 10 367, 11 489, 11 491, 11 493, 11 495, 11 497, 11 499, 11 501, 11 503, 11 505, 11 507, 11 509 and 11 511.

In a particular embodiment, the invention relates to a miPEP, or a fragment of said miPEP, for its use as defined above, said pathology being a cardiac disorder, said miR being selected from: hsa-mir-208 and hsa-mir-208b, said miPEP being preferably selected from SEQ ID NOs: 4 889, 4 891, 4 893, 4 895, 4 897, 4 899, 4 901, 4 903, 4 905, 4 907, 4 909, 4911, 4913, 4915, 4 917 and 4919.

In a particular embodiment, the invention relates to a miPEP, or a fragment of said miPEP, for its use as defined above, said pathology being a pulmonary fibrosis, said miR being the hsa-mir-208, said miPEP being preferably selected from SEQ ID NOs: 4 889, 4 891, 4 893, 4 895, 4 897, 4 899, 4 901, 4 903, 4 905, 4 905, 4 907, 4 909, 4 911, 4 913, 4 915, 4 917 and 4 919.

In a particular embodiment, the invention relates to a miPEP, or a fragment of said miPEP, for its use as defined above, said pathology being a cancer, said miR being the hsa-let-7, said miPEP being preferably selected from SEQ ID NO: 2q-1, q varying from 1 to 28, from 1 225 to 1 260, from 1 561 to 1 576, from 1 865 to 1 916, from 4 065 to 4 100, from 4 645 to 4 668, from 5 197 to 5 228.

In a particular embodiment, the invention relates to a miPEP, or a fragment of said miPEP, for its use as defined above, said pathology being a cardiovascular disease, in particular the ischemia-reperfusion syndrome, said miR being the hsa-miR-7, said miPEP being preferably selected from SEQ ID NOs: 3 089, 3 091, 3 093, 3 095, 3 689, 3 691, 3 693, 3 695, 7 881, 7 883, 7 885, 7 887, 7 889, 7 891, 7 893, 7 895, 7 897, 7 899, 7 901, 7 903, 9 209, 9 211, 9 213, 9 215, 11 473, 11 475, 11 477 and 11 479.

In a particular embodiment, the invention relates to a miPEP, or a fragment of said miPEP, for its use as defined above, said pathology being a hepatitis C virus infection, said miR being the hsa-mir-181c, said miPEP being preferably selected from SEQ ID NOs: 321, 323, 325, 327, 2 657, 2 659, 2 661, 2 663, 4 537, 4 539, 4 541, 4 543, 8 409, 8 411, 8 413, 8 415, 9 497, 9499, 9 501 and 9503.

In a particular embodiment, the invention relates to a miPEP, or a fragment of said miPEP, for its use as defined above, said pathology being a pulmonary fibrosis, said miR being the hsa-miR-29, said miPEP being preferably selected from SEQ ID NOs: 633, 635, 637, 639, 641, 643, 645, 647, 649, 651, 653, 655, 657, 659, 661, 663, 2 905, 2 907, 2 909, 2 911, 2 913, 2 915, 2 917, 2 919, 3 529, 3 531, 3 533, 3 535, 3 537, 3 539, 3 541, 3 543, 5 281, 5 283, 285, 5 287, 5 289, 5 291, 5 293, 5 295, 5 297, 5 299, 5 301, 5 303, 5 305, 5 307, 5 309, 311, 11 657, 11 659, 11 661, 11 663, 11 665, 11 667, 11 669 and 11 671.

In a particular embodiment, the invention relates to a miPEP for its use in the treatment of a disease or trauma of bone tissue or cartilage tissue, said miPEP being selected from the group of miPEPs consisting of: miPEP 145-2 (SEQ ID NO: 11 745), miPEP 125a-1 (SEQ ID NO: 11 747) and miPEP 15a-16-1 (SEQ ID NO: 11 749).

In a particular embodiment, the invention relates to a miPEP fragment for its use in the treatment of a disease or trauma of bone tissue or cartilage tissue, said miPEP fragment being a fragment of the miPEP 145-2, preferably consisting of SEQ ID NO: 11 751.

In a particular embodiment, the invention relates to a miPEP fragment for its use in the treatment of a disease or trauma of bone tissue or cartilage tissue, said miPEP fragment being the miPEP//145-2 consisting of SEQ ID NO: 11 751.

In a particular embodiment, the invention relates to a miPEP fragment for its use in the treatment of a disease or trauma of bone tissue or cartilage tissue, said miPEP fragment being a fragment of the miPEP 125a-1, preferably consisting of SEQ ID NO: 11 752.

In a particular embodiment, the invention relates to a miPEP fragment for its use in the treatment of a disease or trauma of bone tissue or cartilage tissue, said miPEP fragment being the miPEP//125a-1 consisting of SEQ ID NO: 11 752.

In a particular embodiment, the invention relates to a miPEP fragment for its use in the treatment of a disease or trauma of bone tissue or cartilage tissue, said miPEP fragment being a fragment of the miPEP 15a-16-1, preferably consisting of SEQ ID NO: 11 753.

In a particular embodiment, the invention relates to a miPEP fragment for its use in the treatment of a disease or trauma of bone tissue or cartilage tissue, said miPEP fragment being the miPEP//15a-16-1 consisting of SEQ ID NO: 11 754.

In a particular embodiment, the invention relates to a miPEP fragment for its use in the treatment of a disease or trauma of bone tissue or cartilage tissue, said miPEP fragment being selected from:

```
miPEP//145-2-TAT consisting of SEQ ID NO: 11 755
(MVGLNPPLWQ-YGRKKRRQRRR), miPEP//125a-1-TAT consisting of SEQ ID NO: 11 756
(MSLCLSPSLT-YGRKKRRQRRR),
and
```

-continued miPEP//15a-16-1-TAT consisting of SEQ ID NO: 11 757
(MFKHRFFYMH-YGRKKRRQRRR).

Another aspect of the invention relates to process for identifying a miPEP, or a fragment of said miPEP, modulating the accumulation of a miR involved in a pathology, said miPEP being encoded by a nucleotide sequence contained in the primary transcript of a miR, comprising:
 a) a step of detecting an open reading frame from 12 to 1 503 nucleotides contained in the sequence of the primary transcript of said miR, then
 b) a step of comparison between:
  i. the accumulation of said miR in a specified eukaryotic cell expressing the primary transcript of said miR, in the presence of a peptide encoded by a nucleotide sequence that is identical or degenerate relative to that of said open reading frame, said peptide being present in the cell independently of transcription of the primary transcript of said miR, and
  ii. the accumulation of said miR in a eukaryotic cell of the same type as the aforesaid specified eukaryotic cell expressing the primary transcript of said miR, in the absence of said peptide,
in which a modulation of the accumulation of said miR in the presence of said peptide relative to the accumulation of said miR in the absence of said peptide indicates the existence of a miPEP, the latter being encoded by said open reading frame and being capable of modulating the accumulation of said miR involved in a pathology.

Another aspect of the invention also relates to a miPEP from 101 to 500 amino acids, or a fragment of said miPEP, encoded by a nucleotide sequence contained in the primary transcript of a microRNA, said miPEP being capable of modulating the accumulation of said miR in a eukaryotic cell.

In particular, a miPEP may have a size from 200 to 500 amino acids, from 300 to 500 amino acids or from 400 to 500 amino acids.

In particular, a miPEP may have a size of 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 amino acids.

In a particular embodiment, the invention relates to a miPEP selected from the group consisting of SEQ ID NO: 2q-1, q varying from 1 to 5 875, or a fragment of said miPEP.

In a particular embodiment, the invention relates to a miPEP selected from the group consisting of: miPEP 145-2 (SEQ ID NO: 11 745), miPEP 125a-1 (SEQ ID NO: 11 747) and miPEP 15a-16-1 (SEQ ID NO: 11 749).

In a particular embodiment, the invention relates to a fragment of miPEP 145-2, preferably consisting of SEQ ID NO: 11 751.

In a particular embodiment, the invention relates to miPEP//145-2 consisting of SEQ ID NO: 11 751.

In a particular embodiment, the invention relates to a fragment of miPEP 125a-1, preferably consisting of SEQ ID NO: 11 752.

In a particular embodiment, the invention relates to miPEP//125a-1 consisting of SEQ ID NO: 11 752.

In a particular embodiment, the invention relates to a fragment of miPEP 15a-16-1, preferably consisting of SEQ ID NO: 11 753.

In a particular embodiment, the invention relates to miPEP//15a-16-1 consisting of SEQ ID NO: 11 753.

In a particular embodiment, the invention relates to a miPEP, or a fragment of said miPEP, vectorized or encapsulated.

In a particular embodiment, the invention relates to a miPEP, or a fragment of said miPEP, fused to a peptide facilitating the entry into the cell of the miPEP, or miPEP fragment.

In a particular embodiment, the invention relates to a miPEP, or a fragment of said miPEP, wherein said miPEP, or said fragment of said miPEP, fused to the TAT peptide (YGRKKRRQRRR, SEQ ID NO: 11 754).

In a particular embodiment, the invention relates to a miPEP fragment, said miPEP fragment being selected from:

miPEP//145-2-TAT consisting of SEQ ID NO: 11 755
(MVGLNPPLWQ-YGRKKRRQRRR), miPEP//125a-1-TAT consisting of SEQ ID NO: 11 756
(MSLCLSPSLT-YGRKKRRQRRR),
and miPEP//15a-16-1-TAT consisting of SEQ ID NO: 11 757
(MFKHRFFYMH-YGRKKRRQRRR).

In a particular embodiment, the invention relates to a miPEP, or a fragment of said miPEP, as defined above, fused to penetratin, to a polyhistidine peptide (in particular a peptide of at least 6 histidine residues) or to a polyarginine peptide (in particular a peptide of 9 arginine residues).

In a particular embodiment, the invention relates to a miPEP, or a fragment of said miPEP, as defined above, linked to one or more palmitic acid molecules.

In another aspect, the invention relates to a composition comprising a miPEP or a fragment of said miPEP.

In a particular embodiment, the invention relates to a composition as defined above, wherein said miPEP is selected from the group of miPEP consisting of SEQ ID NO: 2q-1, q varying from 1 to 5 875.

In a particular embodiment, the invention relates to a composition as defined above, wherein said miPEP is selected from the group of miPEP consisting of: miPEP 145-2 (SEQ ID NO: 11745), miPEP 125a-1 (SEQ ID NO: 11747) and miPEP 15a-16-1 (SEQ ID NO: 11 749).

In a particular embodiment, the invention relates to a composition as defined above, wherein said miPEP fragment is a fragment of miPEP 145-2, preferably consisting of SEQ ID NO: 11 751.

In a particular embodiment, the invention relates to a composition as defined above, wherein said miPEP fragment is the miPEP//145-2 consisting of SEQ ID NO: 11 751.

In a particular embodiment, the invention relates to a composition as defined above, wherein said miPEP fragment is a fragment of miPEP 125a-1, preferably consisting of SEQ ID NO: 11 752.

In a particular embodiment, the invention relates to a composition as defined above, wherein said miPEP fragment is the miPEP//125a-1 consisting of SEQ ID NO: 11 752.

In a particular embodiment, the invention relates to a composition as defined above, wherein said miPEP fragment is a fragment of miPEP 15a-16-1, preferably consisting of SEQ ID NO 11 753.

In a particular embodiment, the invention relates to a composition as defined above, wherein said miPEP fragment is the miPEP//15a-16-1 consisting of SEQ ID NO: 11 753.

In a particular embodiment, the invention relates to a composition as defined above, wherein said miPEP fragment being selected from:

```
miPEP//145-2-TAT consisting of SEQ ID NO: 11 755
(MVGLNPPLWQ-YGRKKRRQRRR), miPEP//125a-1-TAT consisting of SEQ ID NO: 11 756
(MSLCLSPSLT-YGRKKRRQRRR),
and miPEP//15a-16-1-TAT consisting of SEQ ID NO: 11 757
(MFKHRFFYMH-YGRKKRRQRRR).
```

In a particular embodiment, the invention relates to a composition as defined above, wherein said composition additionally contains growth factors and/or cell differentiation factors.

In a particular embodiment, the invention relates to a composition as defined above, wherein said composition additionally contains BMP4.

In a particular embodiment, the invention relates to a composition as defined above, wherein said composition additionally contains cell culture medium.

In another aspect, the invention relates to the in vitro or ex vivo use of a miPEP from 3 to 500 amino acids encoded by a nucleotide sequence contained in the primary transcript of a miR, or a fragment of said miPEP, said miPEP being capable of modulating the accumulation of said miR in a eukaryotic cell, to promote cell differentiation of cells.

In a particular embodiment, the invention relates to the in vitro or ex vivo use of a miPEP, or a fragment of said miPEP, to promote cell differentiation of mesenchymal stem cells (also called bone marrow stromal cells or mesenchymal stromal cells).

In a particular embodiment, the invention relates to the in vitro or ex vivo use of a miPEP, or a fragment of said miPEP, to promote cell differentiation of mesenchymal stem cells in osteoblasts.

In a particular embodiment, the invention relates to the use as defined above, wherein cells are cultured in the presence of said miPEP, or a fragment of said miPEP.

In a particular embodiment, the invention relates to the use as defined above, wherein cells are cultured in the presence of said miPEP, or a fragment of said miPEP, and in the presence of growth factors and/or cell differentiation factors.

In a particular embodiment, the invention relates to the use as defined above, wherein cells are cultured in the presence of said miPEP, or a fragment of said miPEP, and in the presence of BMP4 (Bone Morphogenetic Protein 4).

In a particular embodiment, the invention relates to the use as defined above, wherein said miPEP is selected from the group of miPEPs consisting of SEQ ID NO: 2q-1, q varying from 1 to 5 875.

In a particular embodiment, the invention relates to the use as defined above, wherein said miPEP selected from the group consisting of: miPEP 145-2 (SEQ ID NO: 11 745), miPEP 125a-1 (SEQ ID NO: 11 747) and miPEP 15a-16-1 (SEQ ID NO: 11 749).

In a particular embodiment, the invention relates to the use as defined above, wherein said fragment is a fragment of miPEP 145-2, preferably consisting of SEQ ID NO: 11 751.

In a particular embodiment, the invention relates to the use as defined above, wherein said fragment is the miPEP//145-2 consisting of SEQ ID NO: 11 751.

In a particular embodiment, the invention relates to the use as defined above, wherein said fragment is a fragment of miPEP 125a-1, preferably consisting of SEQ ID NO: 11 752.

In a particular embodiment, the invention relates to the use as defined above, wherein said fragment is the miPEP//125a-1 consisting of SEQ ID NO: 11 752.

In a particular embodiment, the invention relates to the use as defined above, wherein said fragment is a fragment of miPEP 15a-16-1, preferably consisting of SEQ ID NO: 11 753.

In a particular embodiment, the invention relates to the use as defined above, wherein said fragment is the miPEP//15a-16-1 consisting of SEQ ID NO: 11 753.

In a particular embodiment, the invention relates to the use as defined above, wherein said miPEP fragment is selected from:

```
miPEP//145-2-TAT consisting of SEQ ID NO: 11 755
(MVGLNPPLWQ-YGRKKRRQRRR), miPEP//125a-1-TAT consisting of SEQ ID NO: 11 756
(MSLCLSPSLT-YGRKKRRQRRR),
and miPEP//15a-16-1-TAT consisting of SEQ ID NO: 11 757
(MFKHRFFYMH-YGRKKRRQRRR).
```

In a particular embodiment, the invention relates to the in vitro or ex vivo use of a miPEP, or a fragment of said miPEP, to induce or promote bone formation.

In a particular embodiment, the invention relates to the in vitro or ex vivo use of a miPEP, or a fragment of said miPEP, to form a mineralized bone matrix.

In a particular embodiment, the invention relates to the in vitro or ex vivo use of a miPEP, or a fragment of said miPEP, to promote bone formation with the help of a bone biomaterial.

In a particular embodiment, the invention relates to the use as defined above, wherein mesenchymal stem cells are cultured in the presence of said miPEP, or a fragment of said miPEP.

In a particular embodiment, the invention relates to the use as defined above, wherein mesenchymal stem cells are cultured in the presence of said miPEP, or a fragment of said miPEP, and in the presence of growth factors and/or cell differentiation factors.

In a particular embodiment, the invention relates to the use as defined above, wherein mesenchymal stem cells are cultured in the presence of said miPEP, or a fragment of said miPEP, and in the presence of BMP4.

In a particular embodiment, the invention relates to the use as defined above, wherein said miPEP is selected from the group of miPEPs consisting of SEQ ID NO: 2q-1, q varying from 1 to 5 875.

In a particular embodiment, the invention relates to the use as defined above, wherein said miPEP selected from the group consisting of: miPEP 145-2 (SEQ ID NO: 11 745), miPEP 125a-1 (SEQ ID NO: 11 747) and miPEP 15a-16-1 (SEQ ID NO: 11 749).

In a particular embodiment, the invention relates to the use as defined above, wherein said fragment is a fragment of miPEP 145-2, preferably consisting of SEQ ID NO: 11 751.

In a particular embodiment, the invention relates to the use as defined above, wherein said fragment is the miPEP// 145-2 consisting of SEQ ID NO: 11 751.

In a particular embodiment, the invention relates to the use as defined above, wherein said fragment is a fragment of miPEP 125a-1, preferably consisting of SEQ ID NO: 11 752.

In a particular embodiment, the invention relates to the use as defined above, wherein said fragment is the miPEP// 125a-1 consisting of SEQ ID NO: 11 752.

In a particular embodiment, the invention relates to the use as defined above, wherein said fragment is a fragment of miPEP 15a-16-1, preferably consisting of SEQ ID NO: 11 753.

In a particular embodiment, the invention relates to the use as defined above, wherein said fragment is the miPEP// 15a-16-1 consisting of SEQ ID NO: 11 753.

In a particular embodiment, the invention relates to the use as defined above, wherein said miPEP fragment is selected from:

```
miPEP//145-2-TAT consisting of SEQ ID NO: 11 755
(MVGLNPPLWQ-YGRKKRRQRRR), miPEP//125a-1-TAT consisting of SEQ ID NO: 11 756
(MSLCLSPSLT-YGRKKRRQRRR),
and miPEP//15a-16-1-TAT consisting of SEQ ID NO: 11 757
(MFKHRFFYMH-YGRKKRRQRRR).
```

In another aspect, the invention relates to the in vivo use of a miPEP, or a fragment of said miPEP, to induce or promote bone formation.

In another aspect, the invention relates to the in vivo use of a miPEP, or a fragment of said miPEP, to form a mineralized bone matrix.

In another aspect, the invention relates to the in vivo use of a miPEP, or a fragment of said miPEP, to promote bone formation with the help of a bone biomaterial.

Another aspect of the invention relates to a nucleic acid encoding a miPEP as defined above, or a fragment of said miPEP.

In a particular embodiment, the invention relates to a nucleic acid as defined above, said nucleic acid being selected from the group consisting of SEQ ID NO: 2q, q varying from 1 to 5 875.

In another aspect, the invention relates to an antibody specifically recognizing a miPEP selected from the group consisting of SEQ ID NO: 2q-1, q varying from 1 to 5 875, or a fragment of said miPEP.

Such antibody can be obtained from a method known to those skilled in the art, such as for example by injecting said miPEP with a non-human animal to trigger an immunization reaction and the production of antibodies by said animal.

In another aspect, the invention relates to an antibody specifically recognizing a miPEP, or a fragment of said miPEP, for its use as a drug.

In a particular embodiment, the invention relates to an antibody specifically recognizing a miPEP selected from the group consisting of SEQ ID NO: 2q-1, q varying from 1 to 5 875, or a fragment of said miPEP, for its use as a drug.

In another aspect, the invention relates to an antibody specifically recognizing a miPEP, or a fragment of said miPEP, for immunostaining said miPEP or a fragment of said miPEP.

In a particular embodiment, the invention relates to the use of an antibody as defined above, wherein said specifically recognizing a miPEP selected from the group consisting of SEQ ID NO: 2q-1, q varying from 1 to 5 875, or a fragment of said miPEP.

According to a particular embodiment, the invention relates to a miPEP from 3 to 500 amino acids encoded by a nucleotide sequence contained in the primary transcript of a miR, or a fragment of said miPEP, said miPEP being capable of modulating the accumulation of said miR in a eukaryotic cell, for its use as a drug in the treatment of musculoskeletal disorders, or disease or trauma of bone tissue or cartilage tissue, said primary transcript of a miR being selected from the group consisting of:

let-7b, let-7g, miR-15a, miR16-1, miR106a, miR10a, miR10b, miR1246, miR125a-1, miR132, miR134, miR142, miR145, miR145-2, miR146a, miR150, miR155, miR181c, miR182, miR183, miR184, miR18b, miR192, miR195, miR200a, miR202, miR203, miR205, miR206, miR20b, miR21, miR210, miR27a, miR29a, miR29c, miR30b, miR345, miR377, miR409, miR495, miR520h, miR542, miR572, miR648, miR96 and miR99b;

preferably among the group consisting of: miR15a, miR16-1, miR125a-1 and miR145-2.

According to another particular embodiment, the invention relates to a miPEP as defined above having in particular a size from 3 to 50 amino acids, from 50 to 100 amino acids, from 100 to 500 amino acids, from 101 to 500 amino acids, from 200 to 500 amino acids, from 300 to 500 amino acids, from 400 to 500 amino acids, from 100 to 200 amino acids, from 200 to 300 amino acids or from 300 to 400 amino acids.

According to another particular embodiment, the invention relates to a miPEP, or a fragment of said miPEP, for its use as defined above, said miPEP being identified, or as identified, by implementing of a process for identifying a miPEP modulating the accumulation of a miR involved in a musculoskeletal disorder, or disease or trauma of bone tissue or cartilage tissue, comprising:

a) a step of detecting an open reading frame from 12 to 1 503 nucleotides contained in the sequence of the primary transcript of said miR, then b) a step of comparison between:
   i. the accumulation of said miR in a specified eukaryotic cell expressing the primary transcript of said miR, in the presence of a peptide encoded by a nucleotide sequence that is identical or degenerate relative to that of said open reading frame, said peptide being present in the cell independently of transcription of the primary transcript of said miR, and ii. the accumulation of said miR in a eukaryotic cell of the same type as the aforesaid specified eukaryotic cell expressing the primary transcript of said miR, in the absence of said peptide, in which a modulation of the accumulation of said miR in the presence of said peptide relative to the accumulation of said miR in the absence of said peptide indicates the existence of a miPEP, the latter being encoded by said open reading frame and being capable of modulating the accumulation of said miR involved in a musculoskeletal disorder, or disease or trauma of bone tissue or cartilage tissue.

According to another particular embodiment, the invention relates to a miPEP, or a fragment of said miPEP, for its use as defined above, said miPEP being selected from the group of miPEPs consisting of SEQ ID NO: 2q-1, q varying from 45 to 48, from 89 to 92, from 101 to 104, from 121 to 124, from 133 to 140, from 153 to 156, from 161 to 164, from 169 to 192, from 221 to 224, from 233 to 256, from 301 to 304, from 317 to 320, from 329 to 332, from 337 to 340, from 381 to 384, from 445 to 448, from 469 to 472, from 533 to 536, from 693 to 696, from 789 to 792, from 909 to 916, from 977 to 980, from 1 021 to 1 024, from 1 237 to 1 240, from 1 277 to 1 280, from 1 329 to 1 332, from 1 337 to 1 344, from 1 350 to 1 353, from 1 361 to 1 364, from 1 374 to 1 377, from 1 385 to 1 388, from 1 393 to 1 404, from 1 445 to 1 448, from 1 453 to 1 456, from 1 469 to 1 472, from 1 533 to 1 536, from 1 549 to 1 552, from 1 557 to 1 560, from 1 581 to 1 584, from 1 645 to 1 652, from 1 677 to 1 680, from 1 705 to 1 716, from 1 769 to 1 772, from 1 877 to 1 880, from 1 909 to 1 912, from 1 953 to 1 956, from 1 965 to 1972, from 2 061 to 2 064, from 2 073 to 2 076, from 2 117 to 2 120, from 2 129 to 2 140, from 2 185 to 2 188, from 2 217 to 2 244, from 2 269 to 2 288, from 2 317 to 2 320, from 2 337 to 2 340, from 2 361 to 2 364, from 2 413 to 2 416, from 2 425 to 2 432, from 2 437 to 2 444, from 2 465 to 2 476, from 2 609 to 2 612, from 2 641 to 2 644, from 2 653 to 2 656, from 2 689 to 2 692, from 2 825 to 2 828, from 2 949 to 2 952, from 2 977 to 2 980, from 3 141 to 3 144, from 3 317 to 3 320, from 3 373 to 3 376, from 3 517 to 3 520, from 3 861 to 3 868, from 4 041 to 4 044, from 4 061 to 4 064, from 4 093 to 4 096, from 4 113 to 4 116, from 4 121 to 4 128, from 4 157 to 4 164, from 4 189 to 4 192, from 4 205 to 4 208, from 4 225 to 4 228, from 4 242 to 4 245, from 4 269 to 4 276, from 4 309 to 4 312, from 4 341 to 4 344, from 4 421 to 4 424, from 4 637 to 4 640, from 4 661 to 4 664, from 4 677 to 4 680, from 4 685 to 4 692, from 4 705 to 4 708, from 4 749 to 4 752, from 4 757 to 4 764, from 4 777 to 4 780, from 4 793 to 4 796, from 4 813 to 4 816, from 4 825 to 4 828, from 4 833 to 4 840, from 4 898 to 4 901, from 4 985 to 4 988, from 5 157 to 5 160, from 5 189 to 5 196, from 5 221 to 5 224, from 5 241 to 5 244, from 5 249 to 5 300, from 5 341 to 5 344, from 5 357 to 5 360, from 5 381 to 5 384, from 5 397 to 5 408, from 5 437 to 5 440, from 5 473 to 5 476, from 5 563 to 5 570, from 5 717 to 5 720, from 5 765 to 5 768, from 5 793 to 5 800, from 5 809 to 5 812, from 5 826 to 5 829, from 5 833 to 5 836 and from 5 869 to 5 875;

preferably selected from the group consisting of: SEQ ID NO: 11 745, SEQ ID NO: 11 747 and SEQ ID NO: 11 749.

According to another particular embodiment, the invention relates to a miPEP, or a fragment of said miPEP, for its use as defined above for its use in the treatment of one or more musculoskeletal disorders, or diseases or traumas of bone tissue or cartilage tissue, selected from the group comprising:

arthritis, craniosynostosis, fibrous dysplasia, multiple hereditary exostoses, cleft palates, fibrodysplasia ossificans progressiva, non-ossifying fibroma, bone fracture, hyperostosis, infantile cortical hyperostosis, hyperostosis porotid, hyperparathyroidism, hypophosphatasia, Kienbock's disease, Kohler-Mouchet's disease, Paget's disease, Panner's disease, Scheuermann's disease, Osgood-Schlatter's disease or tibial osteochondrosis, melorheostosis, multiple myeloma, osteitis, osteitis condensas, osteitis fibrosa cystica or osteitis fibrosa or von Recklinghausen's disease, osteoarthritis, deforming osteochondritis of the hip, osteochondritis dissecans, osteochondroma, osteogenesis imperfecta or glass bone disease, osteolysis, osteomalacia, osteomyelitis, osteopenia, osteopetrosis, osteophyte, osteoporosis, osteosclerosis, pseudarthrosis, pseudarthritis pink (or non-consolidation or delayed consolidation), pycnodysostosis, Coffin-Lowry syndrome, Hajdu-Cheney syndrome, Klippel-Feil syndrome, giant cell tumor and bone tumor.

According to another particular embodiment, the invention relates to a miPEP, or a fragment of said miPEP, for its use as defined above, said miPEP being selected from the group of miPEPs consisting of: SEQ ID NO: 2q-1, q varying from 45 to 48, from 89 to 92, from 101 to 104, from 121 to 124, from 133 to 140, from 153 to 156, from 161 to 164, from 169 to 192, from 221 to 224, from 233 to 256, from 301 to 304, from 317 to 320, from 329 to 332, from 337 to 340, from 381 to 384, from 445 to 448, from 469 to 472, from 533 to 536, from 693 to 696, from 789 to 792, from 909 to 916, from 977 to 980, from 1 021 to 1 024, from 1 237 to 1 240, from 1 277 to 1 280, from 1 329 to 1 332, from 1 337 to 1 344, from 1 350 to 1 353, from 1 361 to 1 364, from 1 374 to 1 377, from 1 385 to 1 388, from 1 393 to 1 404, from 1 445 to 1 448, from 1 453 to 1 456, from 1 469 to 1 472, from 1 533 to 1 536, from 1 549 to 1 552, from 1 557 to 1 560, from 1 581 to 1 584, from 1 645 to 1 652, from 1 677 to 1 680, from 1 705 to 1 716, from 1 769 to 1 772, from 1 877 to 1 880, from 1 909 to 1 912, from 1 953 to 1 956, from 1 965 to 1 972, from 2 061 to 2 064, from 2 073 to 2 076, from 2 117 to 2 120, from 2 129 to 2 140, from 2 185 to 2 188, from 2 217 to 2 244, from 2 269 to 2 288, from 2 317 to 2 320, from 2 337 to 2 340, from 2 361 to 2 364, from 2 413 to 2 416, from 2 425 to 2 432, from 2 437 to 2 444, from 2 465 to 2 476, from 2 609 to 2 612, from 2 641 to 2 644, from 2 653 to 2 656, from 2 689 to 2 692, from 2 825 to 2 828, from 2 949 to 2 952, from 2 977 to 2 980, from 3 141 to 3 144, from 3 317 to 3 320, from 3 373 to 3 376, from 3 517 to 3 520, from 3 861 to 3 868, from 4 041 to 4 044, from 4 061 to 4 064, from 4 093 to 4 096, from 4 113 to 4 116, from 4 121 to 4 128, from 4 157 to 4 164, from 4 189 to 4 192, from 4 205 to 4 208, from 4 225 to 4 228, from 4 242 to 4 245, from 4 269 to 4 276, from 4 309 to 4 312, from 4 341 to 4 344, from 4 421 to 4 424, from 4 637 to 4 640, from 4 661 to 4 664, from 4 677 to 4 680, from 4 685 to 4 692, from 4 705 to 4 708, from 4 749 to 4 752, from 4 757 to 4 764, from 4 777 to 4 780, from 4 793 to 4 796, from 4 813 to 4 816, from 4 825 to 4 828, from 4 833 to 4 840, from 4 898 to 4 901, from 4 985 to 4 988, from 5 157 to 5 160, from 5 189 to 5 196, from 5 221 to 5 224, from 5 241 to 5 244, from 5 249 to 5 300, from 5 341 to 5 344, from 5 357 to 5 360, from 5 381 to 5 384, from 5 397 to 5 408, from 5 437 to 5 440, from 5 473 to 5 476, from 5 563 to 5 570, from 5 717 to 5 720, from 5 765 to 5 768, from 5 793 to 5 800, from 5 809 to 5 812, from 5 826 to 5 829, from 5 833 to 5 836 and from 5 869 to 5 875;

preferably selected from the group consisting of: SEQ ID NO: 11 745, SEQ ID NO: 11 747 and SEQ ID NO: 11 749.

According to another particular embodiment, the invention relates to a miPEP fragment for its use as defined above, said miPEP fragment being selected from:
 miPEP//145-2 consisting of SEQ ID NO: 11 751,
 miPEP//125a-1 consisting of SEQ ID NO: 11 752, and
 miPEP//15a-16-1 consisting of SEQ ID NO: 11 753.

According to another particular embodiment, the invention relates to a miPEP, or a fragment of said miPEP, for its use as defined above, said miPEP, or said fragment of said miPEP, being fused to or linked to one or more molecules facilitating the entry into the cell of the miPEP or miPEP fragment,
 said miPEP, or fragment of said miPEP, being preferably fused in N-ter or in C-ter to the TAT peptide (YGRKKRRQRRR, SEQ ID NO: 11 754).

According to another particular embodiment, the invention relates to a miPEP selected from the group of miPEPs consisting of: SEQ ID NO: 2q-1, q varying from 45 to 48, from 89 to 92, from 101 to 104, from 121 to 124, from 133 to 140, from 153 to 156, from 161 to 164, from 169 to 192, from 221 to 224, from 233 to 256, from 301 to 304, from 317 to 320, from 329 to 332, from 337 to 340, from 381 to 384, from 445 to 448, from 469 to 472, from 533 to 536, from 693 to 696, from 789 to 792, from 909 to 916, from 977 to 980, from 1 021 to 1 024, from 1 237 to 1 240, from 1 277 to 1 280, from 1 329 to 1 332, from 1 337 to 1 344, from 1 350 to 1 353, from 1 361 to 1 364, from 1 374 to 1 377, from 1 385 to 1 388, from 1 393 to 1 404, from 1 445 to 1 448, from 1 453 to 1 456, from 1 469 to 1 472, from 1 533 to 1 536, from 1 549 to 1 552, from 1 557 to 1 560, from 1 581 to 1 584, from 1 645 to 1 652, from 1 677 to 1 680, from 1 705 to 1 716, from 1 769 to 1 772, from 1 877 to 1 880, from 1 909 to 1 912, from 1 953 to 1 956, from 1 965 to 1 972, from 2 061 to 2 064, from 2 073 to 2 076, from 2 117 to 2 120, from 2 129 to 2 140, from 2 185 to 2 188, from 2 217 to 2 244, from 2 269 to 2 288, from 2 317 to 2 320, from 2 337 to 2 340, from 2 361 to 2 364, from 2 413 to 2 416, from 2 425 to 2 432, from 2 437 to 2 444, from 2 465 to 2 476, from 2 609 to 2 612, from 2 641 to 2 644, from 2 653 to 2 656, from 2 689 to 2 692, from 2 825 to 2 828, from 2 949 to 2 952, from 2 977 to 2 980, from 3 141 to 3 144, from 3 317 to 3 320, from 3 373 to 3 376, from 3 517 to 3 520, from 3 861 to 3 868, from 4 041 to 4 044, from 4 061 to 4 064, from 4 093 to 4 096, from 4 113 to 4 116, from 4 121 to 4 128, from 4 157 to 4 164, from 4 189 to 4 192, from 4 205 to 4 208, from 4 225 to 4 228, from 4 242 to 4 245, from 4 269 to 4 276, from 4 309 to 4 312, from 4 341 to 4 344, from 4 421 to 4 424, from 4 637 to 4 640, from 4 661 to 4 664, from 4 677 to 4 680, from 4 685 to 4 692, from 4 705 to 4 708, from 4 749 to 4 752, from 4 757 to 4 764, from 4 777 to 4 780, from 4 793 to 4 796, from 4 813 to 4 816, from 4 825 to 4 828, from 4 833 to 4 840, from 4 898 to 4 901, from 4 985 to 4 988, from 5 157 to 5 160, from 5 189 to 5 196, from 5 221 to 5 224, from 5 241 to 5 244, from 5 249 to 5 300, from 5 341 to 5 344, from 5 357 to 5 360, from 5 381 to 5 384, from 5 397 to 5 408, from 5 437 to 5 440, from 5 473 to 5 476, from 5 563 to 5 570, from 5 717 to 5 720, from 5 765 to 5 768, from 5 793 to 5 800, from 5 809 to 5 812, from 5 826 to 5 829, from 5 833 to 5 836 and from 5 869 to 5 875;
 preferably selected from the group consisting of: SEQ ID NO: 11 745, SEQ ID NO: 11 747 and SEQ ID NO: 11 749,
 said miPEP, or fragment of said miPEP, being preferably fused to the TAT peptide (YGRKKRRQRRR, SEQ ID NO: 11 754), fused to penetratin, fused to a polyhistidine peptide, fused to a polyarginine peptide, or linked to one or more palmitic acid molecules.

According to another particular embodiment, the invention relates to a nucleic acid encoding one of the miPEPs selected from the group of miPEPs consisting of SEQ ID NO: 2q, q varying from 45 to 48, from 89 to 92, from 101 to 104, from 121 to 124, from 133 to 140, from 153 to 156, from 161 to 164, from 169 to 192, from 221 to 224, from 233 to 256, from 301 to 304, from 317 to 320, from 329 to 332, from 337 to 340, from 381 to 384, from 445 to 448, from 469 to 472, from 533 to 536, from 693 to 696, from 789 to 792, from 909 to 916, from 977 to 980, from 1 021 to 1 024, from 1 237 to 1 240, from 1 277 to 1 280, from 1 329 to 1 332, from 1 337 to 1 344, from 1 350 to 1 353, from 1 361 to 1 364, from 1 374 to 1 377, from 1 385 to 1 388, from 1 393 to 1 404, from 1 445 to 1 448, from 1 453 to 1 456, from 1 469 to 1 472, from 1 533 to 1 536, from 1 549 to 1 552, from 1 557 to 1 560, from 1 581 to 1 584, from 1 645 to 1 652, from 1 677 to 1 680, from 1 705 to 1 716, from 1 769 to 1 772, from 1 877 to 1 880, from 1 909 to 1 912, from 1 953 to 1 956, from 1 965 to 1 972, from 2 061 to 2 064, from 2 073 to 2 076, from 2 117 to 2 120, from 2 129 to 2 140, from 2 185 to 2 188, from 2 217 to 2 244, from 2 269 to 2 288, from 2 317 to 2 320, from 2 337 to 2 340, from 2 361 to 2 364, from 2 413 to 2 416, from 2 425 to 2 432, from 2 437 to 2 444, from 2 465 to 2 476, from 2 609 to 2 612, from 2 641 to 2 644, from 2 653 to 2 656, from 2 689 to 2 692, from 2 825 to 2 828, from 2 949 to 2 952, from 2 977 to 2 980, from 3 141 to 3 144, from 3 317 to 3 320, from 3 373 to 3 376, from 3 517 to 3 520, from 3 861 to 3 868, from 4 041 to 4 044, from 4 061 to 4 064, from 4 093 to 4 096, from 4 113 to 4 116, from 4 121 to 4 128, from 4 157 to 4 164, from 4 189 to 4 192, from 4 205 to 4 208, from 4 225 to 4 228, from 4 242 to 4 245, from 4 269 to 4 276, from 4 309 to 4 312, from 4 341 to 4 344, from 4 421 to 4 424, from 4 637 to 4 640, from 4 661 to 4 664, from 4 677 to 4 680, from 4 685 to 4 692, from 4 705 to 4 708, from 4 749 to 4 752, from 4 757 to 4 764, from 4 777 to 4 780, from 4 793 to 4 796, from 4 813 to 4 816, from 4 825 to 4 828, from 4 833 to 4 840, from 4 898 to 4 901, from 4 985 to 4 988, from 5 157 to 5 160, from 5 189 to 5 196, from 5 221 to 5 224, from 5 241 to 5 244, from 5 249 to 5 300, from 5 341 to 5 344, from 5 357 to 5 360, from 5 381 to 5 384, from 5 397 to 5 408, from 5 437 to 5 440, from 5 473 to 5 476, from 5 563 to 5 570, from 5 717 to 5 720, from 5 765 to 5 768, from 5 793 to 5 800, from 5 809 to 5 812, from 5 826 to 5 829, from 5 833 to 5 836 and from 5 869 to 5 875;
 preferably selected from the group consisting of: SEQ ID NO: 11 746, SEQ ID NO: 11 748 and SEQ ID NO: 11 750.

Furthermore, the invention also relates to a process for identifying a miPEP modulating the accumulation of a miR involved in a musculoskeletal disorder, or disease or trauma of bone tissue or cartilage tissue, said miPEP being encoded by a nucleotide sequence contained in the primary transcript of a miR, comprising:
 a) a step of detecting an open reading frame from 12 to 1 503 nucleotides contained in the sequence of the primary transcript of said miR, then
 b) a step of comparison between:
  i. the accumulation of said miR in a specified eukaryotic cell expressing the primary transcript of said miR,
   in the presence of a peptide encoded by a nucleotide sequence that is identical or degenerate relative to that of said open reading frame, said peptide being present in the cell independently of transcription of the primary transcript of said miR, and
  ii. the accumulation of said miR in a eukaryotic cell of the same type as the aforesaid specified eukaryotic cell expressing the primary transcript of said miR, in the absence of said peptide, in which a modulation of the accumulation of said miR in the presence of said peptide relative to the accumulation of said miR in the absence of said peptide indicates the existence of a miPEP, the latter being encoded by said open reading frame and being capable of modulating the accumulation of said miR involved in a musculoskeletal disorder, or disease or trauma of bone tissue or cartilage tissue.

According to another aspect, the invention also relates to the in vitro, in vivo or ex vivo use of a miPEP or a fragment of said miPEP, said miPEP being selected from the group of miPEPs consisting of: SEQ ID NO: 2q-1, q varying from 45 to 48, from 89 to 92, from 101 to 104, from 121 to 124, from 133 to 140, from 153 to 156, from 161 to 164, from 169 to 192, from 221 to 224, from 233 to 256, from 301 to 304, from 317 to 320, from 329 to 332, from 337 to 340, from 381 to 384, from 445 to 448, from 469 to 472, from 533 to 536, from 693 to 696, from 789 to 792, from 909 to 916, from 977 to 980, from 1 021 to 1 024, from 1 237 to 1 240, from 1 277 to 1 280, from 1 329 to 1 332, from 1 337 to 1 344, from 1 350 to 1 353, from 1 361 to 1 364, from 1 374 to 1 377, from 1 385 to 1 388, from 1 393 to 1 404, from 1 445 to 1 448, from 1 453 to 1 456, from 1 469 to 1 472, from 1 533 to 1 536, from 1 549 to 1 552, from 1 557 to 1 560, from 1 581 to 1 584, from 1 645 to 1 652, from 1 677 to 1 680, from 1 705 to 1 716, from 1 769 to 1 772, from 1 877 to 1 880, from 1 909 to 1 912, from 1 953 to 1 956, from 1 965 to 1972, from 2 061 to 2 064, from 2 073 to 2 076, from 2 117 to 2 120, from 2 129 to 2 140, from 2 185 to 2 188, from 2 217 to 2 244, from 2 269 to 2 288, from 2 317 to 2 320, from 2 337 to 2 340, from 2 361 to 2 364, from 2 413 to 2 416, from 2 425 to 2 432, from 2 437 to 2 444, from 2 465 to 2 476, from 2 609 to 2 612, from 2 641 to 2 644, from 2 653 to 2 656, from 2 689 to 2 692, from 2 825 to 2 828, from 2 949 to 2 952, from 2 977 to 2 980, from 3 141 to 3 144, from 3 317 to 3 320, from 3 373 to 3 376, from 3 517 to 3 520, from 3 861 to 3 868, from 4 041 to 4 044, from 4 061 to 4 064, from 4 093 to 4 096, from 4 113 to 4 116, from 4 121 to 4 128, from 4 157 to 4 164, from 4 189 to 4 192, from 4 205 to 4 208, from 4 225 to 4 228, from 4 242 to 4 245, from 4 269 to 4 276, from 4 309 to 4 312, from 4 341 to 4 344, from 4 421 to 4 424, from 4 637 to 4 640, from 4 661 to 4 664, from 4 677 to 4 680, from 4 685 to 4 692, from 4 705 to 4 708, from 4 749 to 4 752, from 4 757 to 4 764, from 4 777 to 4 780, from 4 793 to 4 796, from 4 813 to 4 816, from 4 825 to 4 828, from 4 833 to 4 840, from 4 898 to 4 901, from 4 985 to 4 988, from 5 157 to 5 160, from 5 189 to 5 196, from 5 221 to 5 224, from 5 241 to 5 244, from 5 249 to 5 300, from 5 341 to 5 344, from 5 357 to 5 360, from 5 381 to 5 384, from 5 397 to 5 408, from 5 437 to 5 440, from 5 473 to 5 476, from 5 563 to 5 570, from 5 717 to 5 720, from 5 765 to 5 768, from 5 793 to 5 800, from 5 809 to 5 812, from 5 826 to 5 829, from 5 833 to 5 836 and from 5 869 to 5 875;

preferably selected from the group consisting of: SEQ ID NO: 11 745, SEQ ID NO: 11 747 and SEQ ID NO: 11 749, to promote osteogenesis of cells, particularly mesenchymal stem cells.

According to another particular aspect, the invention relates to the use of a miPEP or fragment of said miPEP as defined above, in combination with one or more additives, said additives being selected from the group consisting of: cytokines such as bone morphogenetic protein (BMP) and/or dexamethasone.

According to another particular aspect, the invention relates to a use of a miPEP or fragment of said miPEP as defined above, in combination with a biomaterial, said biomaterial being selected from the following table:

TABLE 1

List of possible biomaterials for implementing the invention.

| a) natural polymers | b) synthetic polymers | c) bioactive glasses |
|---|---|---|
| gelatin/chitooligosaccharide, collagen, chitosan, chitosan/collagen/beta-glycerophosphate (β-GP), silk fibroins, alginate/calcium phosphate cement (CPC)[= alginate/CPC] alginate, hyaluronic acid, RAD16-I BD ™ (PuraMatrix ™, registered trademark of 3-D Matrix, Ltd.), or chitosan/peptide "Arginine-Glycine-Aspartic acid" (RGD) [=chitosan/peptide RGD] | poly(lactide-co-glycolide) [PLGA], poly(ε-caprolactone) [PCL] or poly(hydroxymethylglycolide-co-ε-caprolactone) [pHMGCL], PLGA-poly(ethylene oxide) (PEO) [=PLGA-PEO], poly(L-lactide-co-ε-caprolactone)/poly(L-lactide-co-1,5-dioxepan-2-one)[poly(LLA-co-CL)/poly(LLA-co-DXO)], poly[(ethylglycinato)(p-methylphenoxy) phosphazene]/PLGA [= PPHOS/PLGA], PCL/poly(diisopropyl fumarate) (PDIPF) [= PCL/PDIPF], poly(ester amide)-g-TA [PEA-g-TA], PLGA-poly(ethylene glycol-aspartic acid (PEG-ASP) [=PLGA-(PEG-ASP)], poly(ethylene oxide terephthalate)/poly(butylene terephthalate) [PEOT/PBT], or poly (hydroxyethyl methacrylate) [poly-HEMA] | 45S5 Bioglass ® (registered trademark of the University of Florida), $CaMgSi_2O_6$, 45S5 bioactive glass ® (registered trademark of the University of Florida), 45S bioactive glass ®, bioactive glass ® (BG20), bioglass ®, or bioactive glass ® (13-93) |
| d) calcium phosphates | e) coral | f) metals |
| CPC, hydroxyapatite [HA] β-tricalcium phosphate [βTCP] HA/βTCP, calcium Aluminate/melatonine, or | Porites sp., Goniopora coral, hydroxyapatite coral, coralline in the shape of a condyle, Porites lutea, | NiTi/Ti, titanium (Ti) fiber sheets, titanium wire, Ti, $TiO_2$, |

TABLE 1-continued

List of possible biomaterials for implementing the invention.

| CPC/Bioglass ® | Porites acropora, or natural coral matrices | $Ti_6Ta_4Sn$ alloy, Magnesium W4 alloy (MgY4), or Iron-Manganese alloy |
|---|---|---|

| g) polymer/ceramic composites | h) metal/ceramic composites |
|---|---|
| Nano-apatite/PCL,<br>PLGA-PCL-Calcium Phosphate (CP)<br>[= PLGA-PCL-CP],<br>PEOT/PBT-CP,<br>Collagen-CPC,<br>PCL-TCP,<br>Chitosan-CPC,<br>Magnesium Phosphate-PCL,<br>PLGA-βTCP,<br>PCLF-PVA-HA (PVA: poly(alcool vinylic)),<br>Chitosan/poly(DL, lactide-co-glycolide),<br>PLGA-nHA, ou<br>poly-3-hydroxybutyrate-HA (P3HB-HA) | polyNaSS/Ti,<br>polylactic acid in crystalline form/PLGA/Ti<br>[=PLLA/PLGA/Ti],<br>polyNaSS/Ti,<br>NaSS/methacrylic acid,<br>$MA/Ti_6Al_4V$ alloy,<br>polyNaSS/Ti,<br>$SiO_2/CaO/Na_2O/MgO/B_2O_3$,<br>Niobium/fluorapatite,<br>Ti-HA,<br>$TiO_2$,<br>$ZrO_2$-CP/PCL,<br>K/Sr-calcium polyphosphate (CPP)<br>[=K/Sr-CPP],<br>$ZrO_2$/HA,<br>porous material containing cobalt and a mesoporous Bioglass ® [Co-MBG],<br>porous material containing copper and a mesoporous Bioglass ® [Cu-MBG],<br>β-TCP/Mg, or<br>Sr/CPP |

According to another particular aspect, the invention relates to the use of a miPEP or fragment of said miPEP as defined above, in combination with one or more additives, said additives being chosen from the group consisting of: cytokines as well as bone morphogenetic protein (BMP) and/or dexamethasone;

and in combination with a biomaterial, said biomaterial being selected from the group shown in Table 1 (cf. p 39-41).

According to another particular aspect, the invention relates to the use of a miPEP fragment of sequence SEQ ID NO: 11 752 to promote osteogenesis of mesenchymal stem cells in combination with a biomaterial, said biomaterial being the HA/β-TCP in a ratio of 20/80.

Another aspect of the invention is that it relates to osteo-induced cells with one or more miPEP or fragment of said miPEP as defined above, said cells being in particular mesenchymal stem cells.

Another aspect of the invention is that it relates to cells comprising a nucleic acid encoding one or more of the miPEPs as defined above, the expression of said nucleic acid being inducible or not, said cells being in particular mesenchymal stem cells.

According to another particular aspect, the invention relates to a composite biomaterial comprising osteo-induced cells as defined above or cells as defined above, in combination or not with one or more additives, said additives being chosen from the group consisting of: cytokines such as bone morphogenetic proteins (BMP) and/or dexamethasone, said biomaterial being selected from the group shown in Table 1 (cf. p. 39-41).

According to another particular aspect, the invention relates to a composite biomaterial comprising osteo-induced mesenchymal stem cells with a miPEP fragment of sequence SEQ ID NO: 11 752, said biomaterial being the HA/β-TCP in a ratio of 20/80.

TABLE 2

MiRs involved in cancer, bacterial or fungal infections, cardiovascular diseases, hereditary congenital diseases, skin diseases and eye diseases

| Cancer | Bacterial or fungal infections | Cardiovascular diseases | Hereditary congenital diseases | Skin diseases | Eye diseases |
|---|---|---|---|---|---|
| hsa-let-7a-2 | hsa-let-7a-2 | hsa-let-7a-2 | hsa-let-7a-2 | hsa-let-7b | hsa-let-7a-2 |
| hsa-let-7a-3 | hsa-let-7a-3 | hsa-let-7a-3 | hsa-let-7a-3 | hsa-let-7g | hsa-let-7a-3 |
| hsa-let-7b | hsa-let-7b | hsa-let-7b | hsa-let-7i | hsa-let-7i | hsa-let-7b |
| hsa-let-7d | hsa-let-7d | hsa-let-7d | hsa-let-7d | hsa-mir-106a | hsa-let-7d |
| hsa-let-7e | hsa-let-7e | hsa-let-7e | hsa-let-7e | hsa-mir-10a | hsa-let-7e |
| hsa-let-7g | hsa-let-7g | hsa-let-7g | hsa-let-7g | hsa-mir-10b | hsa-let-7g |
| hsa-let-7i | hsa-let-7i | hsa-let-7i | hsa-let-7i | hsa-mir-1246 | hsa-let-7i |
| hsa-mir-100 | hsa-mir-100 | hsa-mir-100 | hsa-mir-100 | hsa-mir-132 | hsa-mir-106a |
| hsa-mir-106a | hsa-mir-106a | hsa-mir-106a | hsa-mir-106a | hsa-mir-134 | hsa-mir-10a |
| hsa-mir-10a | hsa-mir-10a | hsa-mir-10a | hsa-mir-10a | hsa-mir-141 | hsa-mir-10b |
| hsa-mir-10b | hsa-mir-10b | hsa-mir-10b | hsa-mir-10b | hsa-mir-142 | hsa-mir-1246 |
| hsa-mir-122 | hsa-mir-122 | hsa-mir-122 | hsa-mir-122 | hsa-mir-145 | hsa-mir-125a |
| hsa-mir-1246 | hsa-mir-1246 | hsa-mir-1246 | hsa-mir-1246 | hsa-mir-146a | hsa-mir-134 |
| hsa-mir-125a | hsa-mir-129-1 | hsa-mir-125a | hsa-mir-125a | hsa-mir-148a | hsa-mir-141 |
| hsa-mir-130b | hsa-mir-130b | hsa-mir-129-1 | hsa-mir-130b | hsa-mir-150 | hsa-mir-143 |
| hsa-mir-132 | hsa-mir-133b | hsa-mir-130b | hsa-mir-132 | hsa-mir-155 | hsa-mir-144 |

TABLE 2-continued

MiRs involved in cancer, bacterial or fungal infections, cardiovascular diseases, hereditary congenital diseases, skin diseases and eye diseases

| Cancer | Bacterial or fungal infections | Cardiovascular diseases | Hereditary congenital diseases | Skin diseases | Eye diseases |
|---|---|---|---|---|---|
| hsa-mir-133b | hsa-mir-134 | hsa-mir-132 | hsa-mir-134 | hsa-mir-181c | hsa-mir-145 |
| hsa-mir-134 | hsa-mir-141 | hsa-mir-133b | hsa-mir-141 | hsa-mir-182 | hsa-mir-155 |
| hsa-mir-141 | hsa-mir-142 | hsa-mir-134 | hsa-mir-142 | hsa-mir-183 | hsa-mir-181c |
| hsa-mir-142 | hsa-mir-143 | hsa-mir-141 | hsa-mir-143 | hsa-mir-184 | hsa-mir-182 |
| hsa-mir-143 | hsa-mir-144 | hsa-mir-142 | hsa-mir-145 | hsa-mir-18b | hsa-mir-183 |
| hsa-mir-144 | hsa-mir-145 | hsa-mir-143 | hsa-mir-146a | hsa-mir-192 | hsa-mir-18b |
| hsa-mir-145 | hsa-mir-146a | hsa-mir-144 | hsa-mir-146b | hsa-mir-195 | hsa-mir-192 |
| hsa-mir-146a | hsa-mir-154 | hsa-mir-145 | hsa-mir-148a | hsa-mir-200a | hsa-mir-195 |
| hsa-mir-146b | hsa-mir-155 | hsa-mir-146a | hsa-mir-154 | hsa-mir-202 | hsa-mir-200b |
| hsa-mir-148a | hsa-mir-181a-1 | hsa-mir-146b | hsa-mir-155 | hsa-mir-203 | hsa-mir-202 |
| hsa-mir-150 | hsa-mir-181a-2 | hsa-mir-150 | hsa-mir-181a-2 | hsa-mir-205 | hsa-mir-203 |
| hsa-mir-154 | hsa-mir-181c | hsa-mir-154 | hsa-mir-181c | hsa-mir-206 | hsa-mir-205 |
| hsa-mir-155 | hsa-mir-182 | hsa-mir-155 | hsa-mir-181d | hsa-mir-20b | hsa-mir-20b |
| hsa-mir-181c | hsa-mir-183 | hsa-mir-181a-1 | hsa-mir-182 | hsa-mir-21 | hsa-mir-21 |
| hsa-mir-181d | hsa-mir-184 | hsa-mir-181a-2 | hsa-mir-183 | hsa-mir-210 | hsa-mir-210 |
| hsa-mir-182 | hsa-mir-187 | hsa-mir-181c | hsa-mir-18b | hsa-mir-221 | hsa-mir-212 |
| hsa-mir-183 | hsa-mir-18b | hsa-mir-181d | hsa-mir-192 | hsa-mir-222 | hsa-mir-221 |
| hsa-mir-184 | hsa-mir-192 | hsa-mir-182 | hsa-mir-193a | hsa-mir-27a | hsa-mir-222 |
| hsa-mir-187 | hsa-mir-193b | hsa-mir-183 | hsa-mir-193b | hsa-mir-29a | hsa-mir-23a |
| hsa-mir-18b | hsa-mir-195 | hsa-mir-184 | hsa-mir-195 | hsa-mir-29c | hsa-mir-27a |
| hsa-mir-192 | hsa-mir-196a-2 | hsa-mir-187 | hsa-mir-202 | hsa-mir-30a | hsa-mir-298 |
| hsa-mir-193b | hsa-mir-19b-2 | hsa-mir-18b | hsa-mir-203 | hsa-mir-30b | hsa-mir-30a |
| hsa-mir-195 | hsa-mir-200b | hsa-mir-192 | hsa-mir-206 | hsa-mir-345 | hsa-mir-30d |
| hsa-mir-200a | hsa-mir-200c | hsa-mir-193a | hsa-mir-20b | hsa-mir-34a | hsa-mir-331 |
| hsa-mir-200b | hsa-mir-202 | hsa-mir-193b | hsa-mir-21 | hsa-mir-377 | hsa-mir-345 |
| hsa-mir-200c | hsa-mir-203 | hsa-mir-195 | hsa-mir-210 | hsa-mir-409 | hsa-mir-377 |
| hsa-mir-202 | hsa-mir-205 | hsa-mir-19b-2 | hsa-mir-212 | hsa-mir-495 | hsa-mir-495 |
| hsa-mir-203 | hsa-mir-206 | hsa-mir-200a | hsa-mir-217 | hsa-mir-520h | hsa-mir-542 |
| hsa-mir-205 | hsa-mir-20b | hsa-mir-200c | hsa-mir-221 | hsa-mir-542 | hsa-mir-572 |
| hsa-mir-206 | hsa-mir-21 | hsa-mir-202 | hsa-mir-222 | hsa-mir-572 | hsa-mir-648 |
| hsa-mir-20b | hsa-mir-210 | hsa-mir-203 | hsa-mir-23a | hsa-mir-648 | hsa-mir-96 |
| hsa-mir-21 | hsa-mir-2114 | hsa-mir-205 | hsa-mir-27a | hsa-mir-92b | hsa-mir-99b |
| hsa-mir-210 | hsa-mir-212 | hsa-mir-206 | hsa-mir-29a | hsa-mir-96 | |
| hsa-mir-212 | hsa-mir-217 | hsa-mir-20b | hsa-mir-29c | hsa-mir-99b | |
| hsa-mir-216a | hsa-mir-219-2 | hsa-mir-21 | hsa-mir-30a | | |
| hsa-mir-217 | hsa-mir-221 | hsa-mir-210 | hsa-mir-30b | | |
| hsa-mir-221 | hsa-mir-222 | hsa-mir-212 | hsa-mir-30c-2 | | |
| hsa-mir-222 | hsa-mir-23a | hsa-mir-217 | hsa-mir-30d | | |
| hsa-mir-23a | hsa-mir-24-2 | hsa-mir-221 | hsa-mir-3178 | | |
| hsa-mir-27a | hsa-mir-27a | hsa-mir-222 | hsa-mir-331 | | |
| hsa-mir-297 | hsa-mir-296 | hsa-mir-23a | hsa-mir-345 | | |
| hsa-mir-298 | hsa-mir-29a | hsa-mir-24-2 | hsa-mir-34a | | |
| hsa-mir-29a | hsa-mir-29b-1 | hsa-mir-27a | hsa-mir-363 | | |
| hsa-mir-29b-1 | hsa-mir-29b-2 | hsa-mir-29a | hsa-mir-369 | | |
| hsa-mir-29c | hsa-mir-29c | hsa-mir-29b-1 | hsa-mir-371 | | |
| hsa-mir-301b | hsa-mir-30a | hsa-mir-29b-2 | hsa-mir-372 | | |
| hsa-mir-30a | hsa-mir-30b | hsa-mir-29c | hsa-mir-373 | | |
| hsa-mir-30b | hsa-mir-30d | hsa-mir-30a | hsa-mir-374a | | |
| hsa-mir-30d | hsa-mir-331 | hsa-mir-30b | hsa-mir-377 | | |
| hsa-mir-320 | hsa-mir-345 | hsa-mir-30c-2 | hsa-mir-379 | | |
| hsa-mir-331 | hsa-mir-34a | hsa-mir-30d | hsa-mir-409 | | |
| hsa-mir-345 | hsa-mir-648 | hsa-mir-3178 | hsa-mir-422a | | |
| hsa-mir-34a | hsa-mir-96 | hsa-mir-331 | hsa-mir-494 | | |
| hsa-mir-373 | hsa-mir-99b | hsa-mir-345 | hsa-mir-495 | | |
| hsa-mir-374a | | hsa-mir-34a | hsa-mir-497 | | |
| hsa-mir-377 | | hsa-mir-363 | hsa-mir-505 | | |
| hsa-mir-379 | | hsa-mir-369 | hsa-mir-518c | | |
| hsa-mir-382 | | hsa-mir-371 | hsa-mir-519e | | |
| hsa-mir-409 | | hsa-mir-372 | hsa-mir-520a | | |
| hsa-mir-422a | | hsa-mir-373 | hsa-mir-520g | | |
| hsa-mir-429 | | hsa-mir-374a | hsa-mir-522 | | |
| hsa-mir-485 | | hsa-mir-377 | hsa-mir-523 | | |
| hsa-mir-493 | | hsa-mir-379 | hsa-mir-542 | | |
| hsa-mir-494 | | hsa-mir-409 | hsa-mir-572 | | |
| hsa-mir-495 | | hsa-mir-422a | hsa-mir-648 | | |
| hsa-mir-496 | | hsa-mir-494 | hsa-mir-654 | | |
| hsa-mir-497 | | hsa-mir-495 | hsa-mir-665 | | |
| hsa-mir-506 | | hsa-mir-497 | hsa-mir-769 | | |
| hsa-mir-507 | | hsa-mir-505 | hsa-mir-92b | | |
| hsa-mir-508 | | hsa-mir-518c | hsa-mir-96 | | |
| hsa-mir-509-1 | | hsa-mir-519e | hsa-mir-99b | | |
| hsa-mir-510 | | hsa-mir-520a | | | |
| hsa-mir-520h | | hsa-mir-520g | | | |

TABLE 2-continued

MiRs involved in cancer, bacterial or fungal infections, cardiovascular diseases, hereditary congenital diseases, skin diseases and eye diseases

| Cancer | Bacterial or fungal infections | Cardiovascular diseases | Hereditary congenital diseases | Skin diseases | Eye diseases |
|---|---|---|---|---|---|
| hsa-mir-523 | | hsa-mir-520h | | | |
| hsa-mir-525 | | hsa-mir-522 | | | |
| hsa-mir-542 | | hsa-mir-523 | | | |
| hsa-mir-568 | | hsa-mir-542 | | | |
| hsa-mir-570 | | hsa-mir-572 | | | |
| hsa-mir-572 | | hsa-mir-648 | | | |
| hsa-mir-633 | | hsa-mir-654 | | | |
| hsa-mir-648 | | hsa-mir-665 | | | |
| hsa-mir-7-2 | | hsa-mir-769 | | | |
| hsa-mir-92b | | hsa-mir-92b | | | |
| hsa-mir-940 | | hsa-mir-96 | | | |
| hsa-mir-96 | | hsa-mir-99b | | | |
| hsa-mir-99b | | hsa-mir-15a | | | |
| | | hsa-mir-15b | | | |

TABLE 3

MiRs involved in diseases of the digestive system, diseases of the endocrine system, diseases of the nervous system, diseases related to viruses, diseases related to nutrition and metabolism and lymphatic diseases and hemopathies

| Diseases of the digestive system | Diseases of the endocrine system | Diseases of the nervous system | Diseases related to viruses | Diseases related to nutrition and metabolism | Lymphatic diseases and hemopathies |
|---|---|---|---|---|---|
| hsa-let-7a-2 | hsa-let-7a-2 | hsa-let-7b | hsa-let-7b | hsa-let-7b | hsa-let-7a-2 |
| hsa-let-7a-3 | hsa-let-7a-3 | hsa-let-7d | hsa-let-7d | hsa-let-7g | hsa-let-7a-3 |
| hsa-let-7b | hsa-let-7b | hsa-let-7g | hsa-let-7g | hsa-let-7i | hsa-let-7b |
| hsa-let-7d | hsa-let-7d | hsa-let-7i | hsa-mir-106a | hsa-mir-100 | hsa-let-7d |
| hsa-let-7e | hsa-let-7e | hsa-mir-100 | hsa-mir-10a | hsa-mir-106a | hsa-let-7e |
| hsa-let-7g | hsa-let-7g | hsa-mir-106a | hsa-mir-10b | hsa-mir-10a | hsa-let-7g |
| hsa-let-7i | hsa-let-7i | hsa-mir-10a | hsa-mir-122 | hsa-mir-10b | hsa-let-7i |
| hsa-mir-100 | hsa-mir-106a | hsa-mir-10b | hsa-mir-1246 | hsa-mir-122 | hsa-mir-106a |
| hsa-mir-106a | hsa-mir-10a | hsa-mir-122 | hsa-mir-132 | hsa-mir-1246 | hsa-mir-10a |
| hsa-mir-10a | hsa-mir-10b | hsa-mir-1246 | hsa-mir-134 | hsa-mir-125a | hsa-mir-125a |
| hsa-mir-10b | hsa-mir-1246 | hsa-mir-125a | hsa-mir-145 | hsa-mir-129-1 | hsa-mir-130b |
| hsa-mir-122 | hsa-mir-132 | hsa-mir-129-1 | hsa-mir-155 | hsa-mir-130b | hsa-mir-132 |
| hsa-mir-1246 | hsa-mir-134 | hsa-mir-130b | hsa-mir-181c | hsa-mir-132 | hsa-mir-141 |
| hsa-mir-125a | hsa-mir-142 | hsa-mir-132 | hsa-mir-182 | hsa-mir-133b | hsa-mir-142 |
| hsa-mir-130b | hsa-mir-145 | hsa-mir-133b | hsa-mir-183 | hsa-mir-134 | hsa-mir-143 |
| hsa-mir-132 | hsa-mir-150 | hsa-mir-134 | hsa-mir-18b | hsa-mir-141 | hsa-mir-144 |
| hsa-mir-134 | hsa-mir-155 | hsa-mir-141 | hsa-mir-192 | hsa-mir-142 | hsa-mir-145 |
| hsa-mir-141 | hsa-mir-181c | hsa-mir-142 | hsa-mir-195 | hsa-mir-143 | hsa-mir-146a |
| hsa-mir-143 | hsa-mir-182 | hsa-mir-143 | hsa-mir-202 | hsa-mir-144 | hsa-mir-150 |
| hsa-mir-145 | hsa-mir-183 | hsa-mir-144 | hsa-mir-206 | hsa-mir-145 | hsa-mir-155 |
| hsa-mir-146a | hsa-mir-184 | hsa-mir-145 | hsa-mir-20b | hsa-mir-146a | hsa-mir-181c |
| hsa-mir-148a | hsa-mir-18b | hsa-mir-146a | hsa-mir-21 | hsa-mir-146b | hsa-mir-182 |
| hsa-mir-150 | hsa-mir-192 | hsa-mir-146b | hsa-mir-210 | hsa-mir-154 | hsa-mir-183 |
| hsa-mir-154 | hsa-mir-195 | hsa-mir-154 | hsa-mir-212 | hsa-mir-155 | hsa-mir-187 |
| hsa-mir-155 | hsa-mir-200a | hsa-mir-155 | hsa-mir-217 | hsa-mir-181a-1 | hsa-mir-18b |
| hsa-mir-182 | hsa-mir-202 | hsa-mir-181a-1 | hsa-mir-296 | hsa-mir-181a-2 | hsa-mir-192 |
| hsa-mir-183 | hsa-mir-203 | hsa-mir-181a-2 | hsa-mir-30d | hsa-mir-181c | hsa-mir-193b |
| hsa-mir-18b | hsa-mir-205 | hsa-mir-181c | hsa-mir-345 | hsa-mir-181d | hsa-mir-195 |
| hsa-mir-192 | hsa-mir-20b | hsa-mir-181d | hsa-mir-34a | hsa-mir-182 | hsa-mir-200b |
| hsa-mir-195 | hsa-mir-21 | hsa-mir-182 | hsa-mir-648 | hsa-mir-183 | hsa-mir-202 |
| hsa-mir-200a | hsa-mir-210 | hsa-mir-183 | hsa-mir-96 | hsa-mir-184 | hsa-mir-203 |
| hsa-mir-200b | hsa-mir-212 | hsa-mir-184 | hsa-mir-99b | hsa-mir-187 | hsa-mir-205 |
| hsa-mir-200c | hsa-mir-29a | hsa-mir-187 | | hsa-mir-18b | hsa-mir-20b |
| hsa-mir-202 | hsa-mir-29c | hsa-mir-18b | | hsa-mir-192 | hsa-mir-21 |
| hsa-mir-203 | hsa-mir-30b | hsa-mir-192 | | hsa-mir-193a | hsa-mir-210 |
| hsa-mir-205 | hsa-mir-30d | hsa-mir-193a | | hsa-mir-193b | hsa-mir-216a |
| hsa-mir-206 | hsa-mir-331 | hsa-mir-193b | | hsa-mir-195 | hsa-mir-221 |
| hsa-mir-20b | hsa-mir-345 | hsa-mir-195 | | hsa-mir-19b-2 | hsa-mir-222 |
| hsa-mir-21 | hsa-mir-34a | hsa-mir-19b-2 | | hsa-mir-200c | hsa-mir-23a |
| hsa-mir-210 | hsa-mir-377 | hsa-mir-200c | | hsa-mir-202 | hsa-mir-27a |
| hsa-mir-212 | hsa-mir-409 | hsa-mir-202 | | hsa-mir-203 | hsa-mir-298 |
| hsa-mir-217 | hsa-mir-495 | hsa-mir-203 | | hsa-mir-205 | hsa-mir-301b |
| hsa-mir-221 | hsa-mir-520h | hsa-mir-205 | | hsa-mir-206 | hsa-mir-30a |
| hsa-mir-222 | hsa-mir-542 | hsa-mir-206 | | hsa-mir-20b | hsa-mir-331 |
| hsa-mir-23a | hsa-mir-572 | hsa-mir-20b | | hsa-mir-21 | hsa-mir-345 |

TABLE 3-continued

MiRs involved in diseases of the digestive system, diseases of the endocrine system, diseases of the nervous system, diseases related to viruses, diseases related to nutrition and metabolism and lymphatic diseases and hemopathies

| Diseases of the digestive system | Diseases of the endocrine system | Diseases of the nervous system | Diseases related to viruses | Diseases related to nutrition and metabolism | Lymphatic diseases and hemopathies |
|---|---|---|---|---|---|
| hsa-mir-27a | hsa-mir-648 | hsa-mir-21 | | hsa-mir-210 | hsa-mir-34a |
| hsa-mir-296 | hsa-mir-96 | hsa-mir-210 | | hsa-mir-212 | hsa-mir-373 |
| hsa-mir-29a | hsa-mir-99b | hsa-mir-212 | | hsa-mir-217 | hsa-mir-374a |
| hsa-mir-29c | | hsa-mir-217 | | hsa-mir-221 | hsa-mir-377 |
| hsa-mir-30a | | hsa-mir-221 | | hsa-mir-222 | hsa-mir-485 |
| hsa-mir-30b | | hsa-mir-222 | | hsa-mir-23a | hsa-mir-493 |
| hsa-mir-30d | | hsa-mir-23a | | hsa-mir-24-2 | hsa-mir-495 |
| hsa-mir-320 | | hsa-mir-24-2 | | hsa-mir-27a | hsa-mir-496 |
| hsa-mir-331 | | hsa-mir-27a | | hsa-mir-29a | hsa-mir-523 |
| hsa-mir-345 | | hsa-mir-29a | | hsa-mir-29b-1 | hsa-mir-525 |
| hsa-mir-34a | | hsa-mir-29b-1 | | hsa-mir-29b-2 | hsa-mir-542 |
| hsa-mir-377 | | hsa-mir-29b-2 | | hsa-mir-29c | hsa-mir-568 |
| hsa-mir-379 | | hsa-mir-29c | | hsa-mir-30a | hsa-mir-570 |
| hsa-mir-411 | | hsa-mir-30a | | hsa-mir-30b | hsa-mir-572 |
| hsa-mir-429 | | hsa-mir-30b | | hsa-mir-30c-2 | hsa-mir-633 |
| hsa-mir-494 | | hsa-mir-30c-2 | | hsa-mir-30d | hsa-mir-648 |
| hsa-mir-497 | | hsa-mir-30d | | hsa-mir-3178 | hsa-mir-92b |
| hsa-mir-648 | | hsa-mir-3178 | | hsa-mir-331 | hsa-mir-99b |
| hsa-mir-96 | | hsa-mir-331 | | hsa-mir-345 | hsa-mir-451 |
| hsa-mir-99b | | hsa-mir-345 | | hsa-mir-34a | |
| | | hsa-mir-34a | | hsa-mir-363 | |
| | | hsa-mir-363 | | hsa-mir-369 | |
| | | hsa-mir-369 | | hsa-mir-371 | |
| | | hsa-mir-371 | | hsa-mir-372 | |
| | | hsa-mir-372 | | hsa-mir-373 | |
| | | hsa-mir-373 | | hsa-mir-374a | |
| | | hsa-mir-374a | | hsa-mir-379 | |
| | | hsa-mir-379 | | hsa-mir-409 | |
| | | hsa-mir-409 | | hsa-mir-422a | |
| | | hsa-mir-422a | | hsa-mir-494 | |
| | | hsa-mir-494 | | hsa-mir-497 | |
| | | hsa-mir-495 | | hsa-mir-505 | |
| | | hsa-mir-497 | | hsa-mir-518c | |
| | | hsa-mir-505 | | hsa-mir-519e | |
| | | hsa-mir-518c | | hsa-mir-520a | |
| | | hsa-mir-519e | | hsa-mir-520g | |
| | | hsa-mir-520a | | hsa-mir-522 | |
| | | hsa-mir-520g | | hsa-mir-523 | |
| | | hsa-mir-522 | | hsa-mir-572 | |
| | | hsa-mir-523 | | hsa-mir-648 | |
| | | hsa-mir-572 | | hsa-mir-654 | |
| | | hsa-mir-648 | | hsa-mir-665 | |
| | | hsa-mir-654 | | hsa-mir-769 | |
| | | hsa-mir-665 | | hsa-mir-92b | |
| | | hsa-mir-769 | | hsa-mir-96 | |
| | | hsa-mir-92b | | hsa-mir-99b | |
| | | hsa-mir-96 | | hsa-mir-103-1 | |
| | | hsa-mir-99b | | hsa-mir-103-2 | |
| | | | | hsa-mir-107 | |

TABLE 4

MiRs involved in neonatal and hereditary diseases, respiratory diseases, urogenital diseases in men, urogenital diseases in women, disorders of the immune system and musculoskeletal disorders

| Neonatal and hereditary diseases | Respiratory diseases | Urogenital diseases in men | Urogenital diseases in women | Disorders of the immune system | Musculoskeletal disorders |
|---|---|---|---|---|---|
| hsa-let-7a-2 | hsa-let-7a-2 | hsa-let-7a-2 | hsa-let-7a-2 | hsa-let-7a-2 | hsa-let-7b |
| hsa-let-7a-3 | hsa-let-7a-3 | hsa-let-7a-3 | hsa-let-7a-3 | hsa-let-7a-3 | hsa-let-7g |
| hsa-let-7b | hsa-let-7b | hsa-let-7b | hsa-let-7b | hsa-let-7b | hsa-mir-106a |
| hsa-let-7d | hsa-let-7d | hsa-let-7d | hsa-let-7d | hsa-let-7d | hsa-mir-10a |
| hsa-let-7e | hsa-let-7e | hsa-let-7e | hsa-let-7e | hsa-let-7e | hsa-mir-10b |
| hsa-let-7g | hsa-let-7g | hsa-let-7g | hsa-let-7g | hsa-let-7g | hsa-mir-1246 |
| hsa-let-7i | hsa-let-7i | hsa-let-7i | hsa-let-7i | hsa-let-7i | hsa-mir-132 |
| hsa-mir-100 | hsa-mir-106a | hsa-mir-106a | hsa-mir-106a | hsa-mir-100 | hsa-mir-134 |
| hsa-mir-106a | hsa-mir-10a | hsa-mir-10b | hsa-mir-10b | hsa-mir-106a | hsa-mir-142 |
| hsa-mir-10a | hsa-mir-10b | hsa-mir-132 | hsa-mir-132 | hsa-mir-10a | hsa-mir-145 |

TABLE 4-continued

MiRs involved in neonatal and hereditary diseases, respiratory diseases, urogenital diseases in men, urogenital diseases in women, disorders of the immune system and musculoskeletal disorders

| Neonatal and hereditary diseases | Respiratory diseases | Urogenital diseases in men | Urogenital diseases in women | Disorders of the immune system | Musculoskeletal disorders |
|---|---|---|---|---|---|
| hsa-mir-10b | hsa-mir-1197 | hsa-mir-142 | hsa-mir-142 | hsa-mir-10b | hsa-mir-146a |
| hsa-mir-122 | hsa-mir-122 | hsa-mir-143 | hsa-mir-143 | hsa-mir-122 | hsa-mir-150 |
| hsa-mir-1246 | hsa-mir-1246 | hsa-mir-145 | hsa-mir-145 | hsa-mir-1246 | hsa-mir-155 |
| hsa-mir-125a | hsa-mir-125a | hsa-mir-150 | hsa-mir-150 | hsa-mir-125a | hsa-mir-181c |
| hsa-mir-130b | hsa-mir-130b | hsa-mir-181c | hsa-mir-181c | hsa-mir-130b | hsa-mir-182 |
| hsa-mir-132 | hsa-mir-132 | hsa-mir-182 | hsa-mir-182 | hsa-mir-132 | hsa-mir-183 |
| hsa-mir-134 | hsa-mir-134 | hsa-mir-183 | hsa-mir-183 | hsa-mir-134 | hsa-mir-184 |
| hsa-mir-141 | hsa-mir-135b | hsa-mir-184 | hsa-mir-184 | hsa-mir-141 | hsa-mir-18b |
| hsa-mir-142 | hsa-mir-141 | hsa-mir-192 | hsa-mir-192 | hsa-mir-142 | hsa-mir-192 |
| hsa-mir-143 | hsa-mir-142 | hsa-mir-195 | hsa-mir-195 | hsa-mir-143 | hsa-mir-195 |
| hsa-mir-145 | hsa-mir-143 | hsa-mir-200a | hsa-mir-200a | hsa-mir-144 | hsa-mir-200a |
| hsa-mir-146a | hsa-mir-144 | hsa-mir-202 | hsa-mir-202 | hsa-mir-145 | hsa-mir-202 |
| hsa-mir-146b | hsa-mir-145 | hsa-mir-203 | hsa-mir-203 | hsa-mir-146a | hsa-mir-203 |
| hsa-mir-148a | hsa-mir-146a | hsa-mir-205 | hsa-mir-205 | hsa-mir-146b | hsa-mir-205 |
| hsa-mir-154 | hsa-mir-146b | hsa-mir-21 | hsa-mir-21 | hsa-mir-148a | hsa-mir-206 |
| hsa-mir-155 | hsa-mir-148a | hsa-mir-210 | hsa-mir-210 | hsa-mir-150 | hsa-mir-20b |
| hsa-mir-181a-2 | hsa-mir-150 | hsa-mir-212 | hsa-mir-212 | hsa-mir-154 | hsa-mir-21 |
| hsa-mir-181c | hsa-mir-154 | hsa-mir-29a | hsa-mir-29a | hsa-mir-155 | hsa-mir-210 |
| hsa-mir-181d | hsa-mir-155 | hsa-mir-29c | hsa-mir-29c | hsa-mir-181a-2 | hsa-mir-27a |
| hsa-mir-182 | hsa-mir-181a-2 | hsa-mir-30b | hsa-mir-30b | hsa-mir-181c | hsa-mir-29a |
| hsa-mir-183 | hsa-mir-181c | hsa-mir-30d | hsa-mir-30d | hsa-mir-181d | hsa-mir-29c |
| hsa-mir-18b | hsa-mir-182 | hsa-mir-331 | hsa-mir-331 | hsa-mir-182 | hsa-mir-30b |
| hsa-mir-192 | hsa-mir-183 | hsa-mir-34a | hsa-mir-34a | hsa-mir-183 | hsa-mir-345 |
| hsa-mir-193a | hsa-mir-18b | hsa-mir-377 | hsa-mir-377 | hsa-mir-184 | hsa-mir-377 |
| hsa-mir-193b | hsa-mir-192 | hsa-mir-409 | hsa-mir-409 | hsa-mir-187 | hsa-mir-409 |
| hsa-mir-195 | hsa-mir-193a | hsa-mir-495 | hsa-mir-495 | hsa-mir-18b | hsa-mir-495 |
| hsa-mir-202 | hsa-mir-193b | hsa-mir-520h | hsa-mir-520h | hsa-mir-192 | hsa-mir-520h |
| hsa-mir-203 | hsa-mir-195 | hsa-mir-542 | hsa-mir-542 | hsa-mir-193a | hsa-mir-542 |
| hsa-mir-206 | hsa-mir-200a | hsa-mir-572 | hsa-mir-572 | hsa-mir-193b | hsa-mir-572 |
| hsa-mir-20b | hsa-mir-200b | hsa-mir-648 | hsa-mir-648 | hsa-mir-195 | hsa-mir-648 |
| hsa-mir-21 | hsa-mir-200c | hsa-mir-96 | hsa-mir-96 | hsa-mir-200a | hsa-mir-96 |
| hsa-mir-210 | hsa-mir-202 | hsa-mir-99b | hsa-mir-99b | hsa-mir-200b | hsa-mir-99b |
| hsa-mir-212 | hsa-mir-203 | | | hsa-mir-202 | |
| hsa-mir-217 | hsa-mir-205 | | | hsa-mir-203 | |
| hsa-mir-221 | hsa-mir-206 | | | hsa-mir-205 | |
| hsa-mir-222 | hsa-mir-20b | | | hsa-mir-20b | |
| hsa-mir-23a | hsa-mir-21 | | | hsa-mir-21 | |
| hsa-mir-27a | hsa-mir-210 | | | hsa-mir-210 | |
| hsa-mir-29a | hsa-mir-212 | | | hsa-mir-212 | |
| hsa-mir-29c | hsa-mir-221 | | | hsa-mir-216a | |
| hsa-mir-30a | hsa-mir-222 | | | hsa-mir-217 | |
| hsa-mir-30b | hsa-mir-23a | | | hsa-mir-221 | |
| hsa-mir-30c-2 | hsa-mir-24-2 | | | hsa-mir-222 | |
| hsa-mir-30d | hsa-mir-27a | | | hsa-mir-23a | |
| hsa-mir-3178 | hsa-mir-298 | | | hsa-mir-27a | |
| hsa-mir-331 | hsa-mir-29a | | | hsa-mir-298 | |
| hsa-mir-345 | hsa-mir-29c | | | hsa-mir-29a | |
| hsa-mir-34a | hsa-mir-30a | | | hsa-mir-29c | |
| hsa-mir-363 | hsa-mir-30b | | | hsa-mir-301b | |
| hsa-mir-369 | hsa-mir-30d | | | hsa-mir-30a | |
| hsa-mir-371 | hsa-mir-320 | | | hsa-mir-30b | |
| hsa-mir-372 | hsa-mir-331 | | | hsa-mir-30c-2 | |
| hsa-mir-373 | hsa-mir-337 | | | hsa-mir-30d | |
| hsa-mir-374a | hsa-mir-345 | | | hsa-mir-3178 | |
| hsa-mir-377 | hsa-mir-34a | | | hsa-mir-331 | |
| hsa-mir-379 | hsa-mir-369 | | | hsa-mir-345 | |
| hsa-mir-409 | hsa-mir-374a | | | hsa-mir-34a | |
| hsa-mir-422a | hsa-mir-374b | | | hsa-mir-363 | |
| hsa-mir-494 | hsa-mir-377 | | | hsa-mir-369 | |
| hsa-mir-495 | hsa-mir-379 | | | hsa-mir-371 | |
| hsa-mir-497 | hsa-mir-382 | | | hsa-mir-372 | |
| hsa-mir-505 | hsa-mir-409 | | | hsa-mir-373 | |
| hsa-mir-518c | hsa-mir-411 | | | hsa-mir-374a | |
| hsa-mir-519e | hsa-mir-422a | | | hsa-mir-377 | |
| hsa-mir-520a | hsa-mir-429 | | | hsa-mir-379 | |
| hsa-mir-520g | hsa-mir-450b | | | hsa-mir-409 | |
| hsa-mir-522 | hsa-mir-487a | | | hsa-mir-422a | |
| hsa-mir-523 | hsa-mir-493 | | | hsa-mir-485 | |
| hsa-mir-542 | hsa-mir-494 | | | hsa-mir-493 | |
| hsa-mir-572 | hsa-mir-495 | | | hsa-mir-494 | |
| hsa-mir-648 | hsa-mir-505 | | | hsa-mir-495 | |
| hsa-mir-654 | hsa-mir-518d | | | hsa-mir-496 | |
| hsa-mir-665 | hsa-mir-518e | | | hsa-mir-497 | |

TABLE 4-continued

MiRs involved in neonatal and hereditary diseases, respiratory diseases, urogenital diseases in men, urogenital diseases in women, disorders of the immune system and musculoskeletal disorders

| Neonatal and hereditary diseases | Respiratory diseases | Urogenital diseases in men | Urogenital diseases in women | Disorders of the immune system | Musculoskeletal disorders |
|---|---|---|---|---|---|
| hsa-mir-769 | hsa-mir-518f | | | hsa-mir-505 | |
| hsa-mir-92b | hsa-mir-520a | | | hsa-mir-518c | |
| hsa-mir-96 | hsa-mir-520d | | | hsa-mir-519e | |
| hsa-mir-99b | hsa-mir-520e | | | hsa-mir-520a | |
| | hsa-mir-523 | | | hsa-mir-520g | |
| | hsa-mir-542 | | | hsa-mir-520h | |
| | hsa-mir-543 | | | hsa-mir-522 | |
| | hsa-mir-570 | | | hsa-mir-523 | |
| | hsa-mir-572 | | | hsa-mir-525 | |
| | hsa-mir-648 | | | hsa-mir-542 | |
| | hsa-mir-656 | | | hsa-mir-568 | |
| | hsa-mir-668 | | | hsa-mir-570 | |
| | hsa-mir-758 | | | hsa-mir-572 | |
| | hsa-mir-769 | | | hsa-mir-633 | |
| | hsa-mir-96 | | | hsa-mir-648 | |
| | hsa-mir-99b | | | hsa-mir-654 | |
| | | | | hsa-mir-665 | |
| | | | | hsa-mir-769 | |
| | | | | hsa-mir-92b | |
| | | | | hsa-mir-96 | |
| | | | | hsa-mir-99b | |

TABLE 5

The top 10 miRs involved in cancers, bacterial and fungal infections, immune system disorders, cardiovascular diseases, hereditary congenital diseases, skin diseases, musculoskeletal disorders, eye diseases and diseases of the digestive system.

| Cancer | bacterial infections - Mycosis | Immune system disorders | Cardiovascular diseases | Hereditary congenital diseases | Skin diseases | Musculoskeletal disorders | Eye diseases | Diseases of the digestive system |
|---|---|---|---|---|---|---|---|---|
| hsa-mir-21 | hsa-mir-155 | hsa-mir-192 | hsa-mir-192 | hsa-mir-192 | hsa-mir-182 | hsa-mir-192 | hsa-mir-192 | hsa-mir-122 |
| hsa-mir-145 | hsa-mir-21 | hsa-mir-221 | hsa-mir-21 | hsa-mir-221 | hsa-mir-221 | hsa-mir-210 | hsa-mir-145 | hsa-mir-192 |
| hsa-mir-192 | hsa-mir-203 | hsa-mir-141 | hsa-mir-122 | hsa-let-7i | hsa-mir-203 | hsa-mir-182 | hsa-let-7g | hsa-mir-21 |
| hsa-mir-205 | hsa-mir-195 | hsa-mir-145 | hsa-mir-145 | hsa-mir-122 | hsa-mir-106a | hsa-mir-183 | hsa-mir-331 | hsa-mir-210 |
| hsa-mir-143 | hsa-let-7b | hsa-mir-182 | hsa-mir-210 | hsa-mir-141 | hsa-mir-155 | hsa-mir-96 | hsa-mir-99b | hsa-mir-99b |
| hsa-mir-10a | hsa-let-7d | hsa-mir-21 | hsa-mir-29c | hsa-mir-182 | hsa-mir-29a | hsa-mir-106a | hsa-mir-182 | hsa-let-7b |
| hsa-mir-106a | hsa-mir-145 | hsa-mir-203 | hsa-mir-497 | hsa-mir-155 | hsa-mir-210 | hsa-mir-10b | hsa-mir-183 | hsa-let-7d |
| hsa-mir-146a | hsa-mir-1246 | hsa-let-7i | hsa-mir-96 | hsa-mir-145 | hsa-mir-148a | hsa-mir-1246 | hsa-mir-195 | hsa-mir-10a |
| hsa-mir-182 | hsa-mir-192 | hsa-mir-106a | hsa-mir-132 | hsa-mir-222 | hsa-mir-141 | hsa-mir-132 | hsa-mir-106a | hsa-let-7g |
| hsa-mir-221 | hsa-let-7g | hsa-mir-122 | hsa-mir-141 | hsa-mir-20b | hsa-let-7i | hsa-mir-134 | hsa-mir-10a | hsa-let-7i |

TABLE 6

The top 10 miRs involved in diseases of the endocrine system, diseases of the nervous system, diseases related to viruses, diseases related to nutrition and metabolism, lymphatic diseases and hemopathies, neonatal and hereditary diseases, respiratory diseases, urogenital diseases in men, urogenital diseases in women.

| diseases of the endocrine system | diseases of the nervous system | Diseases related to viruses | Diseases related to nutrition and metabolism | Lymphatic diseases and hemopathies | Neonatal and hereditary diseases | Respiratory diseases | Urogenital diseases in men | Urogenital diseases in women |
|---|---|---|---|---|---|---|---|---|
| hsa-mir-145 | hsa-mir-192 | hsa-mir-122 | hsa-mir-192 | hsa-mir-106a | hsa-mir-192 | hsa-mir-21 | hsa-mir-21 | hsa-mir-21 |
| hsa-mir-21 | hsa-mir-122 | hsa-mir-192 | hsa-mir-122 | hsa-mir-205 | hsa-mir-221 | hsa-mir-145 | hsa-let-7b | hsa-let-7b |
| hsa-mir-192 | hsa-mir-145 | hsa-mir-195 | hsa-mir-21 | hsa-mir-145 | hsa-mir-182 | hsa-mir-143 | hsa-mir-145 | hsa-mir-145 |

TABLE 6-continued

The top 10 miRs involved in diseases of the endocrine system, diseases of the nervous system, diseases related to viruses, diseases related to nutrition and metabolism, lymphatic diseases and hemopathies, neonatal and hereditary diseases, respiratory diseases, urogenital diseases in men, urogenital diseases in women.

| diseases of the endocrine system | diseases of the nervous system | Diseases related to viruses | Diseases related to nutrition and metabolism | Lymphatic diseases and hemopathies | Neonatal and hereditary diseases | Respiratory diseases | Urogenital diseases in men | Urogenital diseases in women |
|---|---|---|---|---|---|---|---|---|
| hsa-mir-181c | hsa-mir-141 | hsa-mir-18b | hsa-mir-141 | hsa-mir-125a | hsa-let-7i | hsa-mir-144 | hsa-mir-106a | hsa-mir-181c |
| hsa-mir-182 | hsa-mir-142 | hsa-mir-21 | hsa-mir-145 | hsa-mir-141 | hsa-mir-122 | hsa-mir-182 | hsa-let-7d | hsa-let-7d |
| hsa-mir-183 | hsa-mir-143 | hsa-mir-1246 | hsa-mir-142 | hsa-mir-143 | hsa-mir-141 | hsa-mir-195 | hsa-mir-181c | hsa-mir-106a |
| hsa-mir-96 | hsa-mir-146a | hsa-mir-212 | hsa-mir-143 | hsa-let-7d | hsa-mir-145 | hsa-mir-192 | hsa-mir-192 | hsa-mir-192 |
| hsa-mir-210 | hsa-mir-100 | hsa-mir-34a | hsa-mir-155 | hsa-let-7i | hsa-mir-155 | hsa-mir-221 | hsa-mir-195 | hsa-mir-195 |
| hsa-mir-212 | hsa-mir-155 | hsa-mir-106a | hsa-mir-182 | hsa-mir-331 | hsa-mir-222 | hsa-mir-222 | hsa-mir-200a | hsa-mir-200a |
| hsa-mir-132 | hsa-mir-182 | hsa-mir-10a | hsa-mir-183 | hsa-mir-192 | hsa-mir-20b | hsa-mir-27a | hsa-mir-202 | hsa-mir-202 |

The following examples will better illustrate the invention without limiting its scope.

EXAMPLES

Example 1: miPEP 125a-1 and miPEP 145-2

A transcriptomic analysis carried out by the inventors has revealed that the miR 125a-1 and miR 145-2 are overexpressed during the differentiation of the cells into osteoblasts (unpublished results).

The miPEPs 125a-1 and 145-2 sequences were identified from the primary transcripts of miRs 125a-1 and 145-2.

The respective effects of miPEP 125a-1 and miPEP 145-2 on differentiation of mesenchymal stem cells were analyzed by measuring the expression of the iBSP, PTHR1, STMN2 and OSTERIX genes that correspond to markers of osteogenesis and of osteoblast differentiation (Chiellini et al., Biochem Biophys Res Commun, 374(1):64-8, 2008; Cordonnier et al., Tissue Eng, 17(3): 249-259, 2011).

The experiments were carried out with two fragments of 10 amino acids respectively corresponding to the N-terminal part of the miPEP 125a-1 (=miPEP//125a-1 fragment) and to the N-terminal part of the miPEP 145-2 (=fragment miPEP//145-2).

Mesenchymal stem cells from 4 different donors were cultured for 24 hours in PROLIF medium (αMEM+10% FCS) with or without miPEP//then for 3 days in DIF+BMP4 medium (αMEM+2% FCS+b-Glycerophosphate+Ascorbic acid+BMP4), DIF ΔBMP4 medium (αMEM+2% FCS+b-Glycerophosphate+Ascorbic acid) or PROLIF medium (αMEM+10% FCS), with or without miPEP//.

The expression of the iBSP, PTHR1, STMN2 and OSTERIX genes was then measured in mesenchymal stem cells cultured in the presence or absence of a miPEP*.

1.1—Results

In DIF+BMP4 Medium

The miPEP//125a-1 increases the expression of the iBSP, PTHR1, STMN2 and OSTERIX genes (FIGS. 2, 3, 4 and 5).

The miPEP//145-2 increases the expression of the STMN2 gene (FIG. 6).

In DIF ΔBMP4 Medium

The miPEP//125a-1 increases the expression of the STMN2 and OSTERIX genes (FIGS. 7 and 8).

The miPEP//145-2 increases the expression of the STMN2 and OSTERIX genes (FIGS. 9 and 10).

In PROLIF Medium

The miPEP//145-2 increases the expression STMN2 gene (FIG. 11).

The above results show that miPEP//125a-1 and miPEP//145-2 increase the expression of osteoblast marker genes, indicating that these miPEPs promote osteoblast differentiation of mesenchymal stem cells.

1.2—Materials

MEMα GIBCO (reference 22561-021)⇒"αMEM",
Fetal bovine serum (FBS),
Penicillin/streptomycin GIBCO (reference 15140-122) "P/S",
Dulbecco's PBS GIBCO (reference 14190-169)⇒"PBS",
12-well plate,
βglycerophosphate SIGMA (reference G9422),
Ascorbic acid SIGMA (reference A8960),
BMP4 PEPROTECH (reference 120-05ET)⇒"BMP4",

```
miPEP//125a-1
(MSLCLSPSLT, SEQ ID NO: 11 752), miPEP//145-2
(MVGLNPPLWQ, SEQ ID NO: 11 751),

"scramble" control peptide ScmiPEP//125a
(IQVGHEDETD, SEQ ID NO: 11 758).
```

1.3—Methods a. Composition of Culture Media

Proliferation medium (PROLIF): αMEM+10% FBS+1% P/S

Differentiation medium+BMP4 (DIF+BMP4): αMEM+2% FBS+1% P/S+βglycerophosphate (10 mM)+Ascorbic acid (50 μM)+BMP4 (50 ng/mL)

Differentiation medium without BMP4 (DIF ΔBMP4): αMEM+2% FBS+1% P/S+βglycerophosphate (10 mM)+Ascorbic acid (50 μM)

b. Resuspension of Micropeptides

The miPEP//145-2 was synthesized by Smartbioscience and dissolved at 2 mM in water. The miPEP//125a-1 was synthesized by Smartbioscience and dissolved in water+0.1% ammonium.

c. Seeding of the Cells

The mesenchymal stem cells were seeded in 12-well plates at 70,000 cells/well in 1 mL of PROLIF medium. The cells were then incubated for 72 h at 37° C. in a humid atmosphere with 5% $CO_2$.

d. Cell Treatment with miPEPs

After 72 hours of incubation, the cells were pre-treated with 100 µM of miPEP or "scramble" peptide diluted in PROLIF medium, and then incubated at 37° C. for 24 hours. In parallel, cells treated with PROLIF±water or water+0.1% ammonium medium were used as a negative control.

For 3 days, the cells were treated every 24 h with 100 µM of diluted miPEP either in DIF+BMP4 medium, or in DIF ΔBMP4 medium, or in PROLIF medium. Cells untreated or treated with water or water+0.1% ammonium were used as controls. The cells are incubated at 37° C.

After 3 days of treatment, the culture supernatants were removed, the cell mats were washed once with PBS, and then the plates were frozen at −80° C. until the total RNAs were extracted.

e. Extraction of Total RNA

Total RNAs were extracted according to the supplier's recommendations with the miRNeasy microkit kit (Qiagen).

f. Reverse Transcription Reaction

The RNAs were reverse transcribed with the High Capacity cDNA reverse transcription kit (Applied Biosystem). 600 ng of RNA were added to 2 µL of RT buffer (10×), 2 µL of Random primer (10×), 0.8 µL of dNTPs (25×), 0.5 µL of RNAse OUT (40 U/µL) and 1 µL of multiscribe reverse transcriptase (50 U/µL) in a total volume of 20 µL. The reverse transcription reaction was carried out at 25° C. for 10 min and then 42° C. for 2 h. The activity of the enzyme was stopped by incubating the mixture at 85° C. for 5 min.

g. Evaluation of Gene Expression by Quantitative RT-PCR

The expression of osteoblastic transcription factors iBSP, PTHR1, STMN2 and OSTERIX was evaluated by quantitative RT-PCR with the SsoFast EvagGreen kit. For the RT-PCR reaction, 3 µL of reverse transcriptase diluted 1/8 were added to 1× of SsoFast EvaGreen, 10 µM of each primer and RNase free water in a final volume of 10 µL. The reaction was subjected to the following temperatures: 3 min pre-amplification at 95° C., 40 cycles of 10 sec at 95° C. and sec at 60° C. in a thermal cycler (CFX96 Real-time PCR detection system, Biorad). PPIA was used as a reference gene to normalize quantitative RT-PCR.

For all PCR reactions, two replicates were used for each biological sample.

Example 2: Cell Penetration of miPEPs

The entry of miPEPs into mesenchymal stem cells (MSCs) was analyzed by fluorescence microscopy using fluorescein (FAM)-labeled miPEP//15a-16-1, fused or not to a peptide promoting cell penetration (TAT peptide).

2.1—Results

In a first experiment, undifferentiated MSCs were incubated for 7 h with 5 µM, 10 µM, 50 µM or 100 µM of miPEP//15a-16-1-FAM (FIG. 12).

In a second experiment, undifferentiated MSCs were incubated with 100 µM of miPEP//15a-16-1-FAM for 2 h, 4 h, 6 h, 8 h or 24 h (FIG. 13).

In a third experiment, undifferentiated MSCs were incubated for 7 h with 5 µM, 10 µM, 20 µM, 50 µM or 100 µM of miPEP//15a-16-1-FAM-TAT (FIG. 14).

In a fourth experiment, undifferentiated MSCs were incubated for 2 h, with 10 µM of miPEP//15a-16-1-FAM-TAT (FIG. 15).

The above results indicate, on the one hand, that the miPEP//15a-16-1-FAM homogeneously penetrates the MSCs when the MSCs are treated with at least 50 µM of miPEP, and on the other hand, that the miPEP is captured in the core of the MSCs.

The strongest fluorescence is observed from 4 h to 8 h after the treatment with the miPEP.

These results also indicate that the addition of the TAT peptide to the miPEP promotes cell penetration by a factor of 10 relative to the cellular penetration of the miPEP without the TAT peptide.

2.2—Materials

MEMα GIBCO (reference 22561-021)⇒"αMEM",

Fetal bovine serum (FBS),

Penicillin/streptomycin GIBCO (reference 15140-122) ⇒"P/S",

Dulbecco's PBS GIBCO (reference 14190-169)⇒"PBS", 8-well IBIDI blade (15µ slide 8 well IBIDi; Biovalley), DRAQ5 (5 mM) Biostatus, Formaldehyde solution 37%,

TABLE 7

Sequences of the primers.

|  |  | Forward primer (5'-3') | Reverse primer (5'-3') |
|---|---|---|---|
| Reference gene | PPIA | TCT TTG GGA CCT TGT CTG CAA (SEQ ID NO: 11 759) | GCC GAG GAA AAC CGT GTA CTA T (SEQ ID NO: 11 760) |
| Osteoblastic marker genes | iBSP | GGG CAG TAG TGA CTC ATC CGA AG (SEQ ID NO: 11 761) | CTC CAT AGC CCA GTG TTG TAG CAG (SEQ ID NO: 11762) |
|  | OSX | CTC CTG CGA CTG CCC TAA T (SEQ ID NO: 11 763) | GCC TTG CCA TAC ACC TTG C (SEQ ID NO: 11 764) |
|  | PTHR1 | ACA TCT GCG TCC ACA TCA GG (SEQ ID NO: 11 765) | CCG TTC ACG AGT CTC ATT GGT G (SEQ ID NO: 11766) |
|  | STMN2 | GCG GAG GAA AAG CTG ATC CTG A (SEQ ID NO: 11 767) | TCC GCA GCA TGC CTC TCC TT (SEQ ID NO: 11 768) | miPEP//15a-16-1
(MFKHRFFYMH, SEQ ID NO: 11 753), miPEP//15a-16-1-TAT
(MFKHRFFYMH-YGRKKRRQRRR, SEQ ID NO: 11 757).

2.3—Methods

Undifferentiated MSCs are incubated in ° MEM+10% FBS+1% P/S medium in the presence of fluorescein (FAM) labeled miPEP. After incubation from 2 h to 10 h, the wells are washed 3 times with PBS and then the cells are fixed for 5 min with 3.8% formaldehyde. The nuclei are marked with the Draq5 diluted 1/1 000. The cells are then observed under a confocal microscope in fluorescence.

Example 3: miPEP 15a-16-1

A transcriptomic analysis carried out by the inventors has revealed that the miR 15a and miR 16-1 are overexpressed during the differentiation of the cells into osteoblasts (unpublished results).

The miPEP 15a-16-1 sequence was identified from the primary transcript of 15a-16-1.

The effect of miPEP 15a-16-1 on miR16-1 accumulation was analyzed in mesenchymal stem cells (MSCs). The experiments were carried out with a fragment of 10 amino acids respectively corresponding to the N-terminal portion of the miPEP 15a-16-1 (=fragment miPEP//15 a-16-1).

MSCs from three different patients were treated with 10 μM of miPEP//15a-16-1 fused to TAT peptide (miPEP//15a-16-1-TAT) for 3 h, then the amount of miR16-1 was measured by RT-qPCR.

3.1—Results

Treatment with miPEP//15a-16-1-TAT results in an increase in the amount of miR 16-1 (FIG. 16).

3.2—Materials

MEMα GIBCO (reference 22561-021)⇒"αMEM",
Fetal bovine serum (FBS),
Penicillin/streptomycin GIBCO (reference 15140-122) ⇒"P/S",
Dulbecco's PBS GIBCO (reference 14190-169)⇒"PBS", miPEP//15a-16-1-TAT
(MFKHRFFYMH-YGRKKRRQRRR, SEQ ID NO: 11 757), ScmiPEP//21
(RPHLRMELPV).

3.3—Methods a. Resuspension of Micropeptides

Peptides were synthesized by Smartbioscience and dissolved at 2 mM in water.

b. Seeding of the Cells

The MSCs were seeded in wells of 12-well plates at 72,900 cells per well under 1 mL of PROLIF medium. The cells were then incubated for 72 h at 37° C. in a humid atmosphere with 5% $CO_2$.

c. Cell Treatment with miPEPs

After 24 h of incubation, the cells were treated with 10 μM of miPEP//15a-16-1-TAT or 100 μM of ScmiPEP21 diluted in PROLIF medium and then incubated at 37° C. for 1 h, 2 h, 3 h, 4 h and 6 h. In parallel, cells treated with PROLIF±water medium were used as a negative control.

After treatment from 1 h to 6 h, the culture supernatants were removed and then the cell mats were washed twice with PBS, and then the plates were frozen at −80° C. until miRNA extraction.

d. Total RNA Extraction

The miRNAs were extracted according to the supplier's recommendations with the miRNeasy microkit kit (Qiagen).

e. Reverse Transcription Reaction

The RNAs were reverse transcribed with the High Capacity cDNA reverse transcription kit (Applied Biosystem). 400 ng of RNA were added to 2 μL of RT buffer (10×), 2 μL of Random primer (10×), 0.8 μL of dNTPs (25×), 0.5 μL of RNAse OUT (40 U/μL) and 1 μL of multiscribe reverse transcriptase (50 U/μL) in a total volume of 20 μL. The reverse transcription reaction was carried out at 25° C. for 10 min and then 42° C. for 2 h. The activity of the enzyme was stopped by incubating the mixture at 85° C. for 5 min.

f. Quantification of miRNAs Precursors by Quantitative RT-PCR

The amount of miRNAs precursors in cells treated or not treated with miPEP was evaluated by quantitative RT-PCR with the SsoFast EvagGreen kit. For the RT-PCR reaction, 3 μL of reverse transcriptase diluted 1/5 were added to 1× of SsoFast EvaGreen, 10 μM of each primer and RNase free water in a final volume of 10 μL. The reaction was subjected to the following temperatures: 3 min pre-amplification at 95° C., 40 cycles of 10 sec at 95° C. and 30 sec at 60° C. in a thermal cycler (CFX96 Real-time PCR detection system, Biorad). PPIA was used as a reference gene to normalize quantitative RT-PCR.

For all PCR reactions, two replicates were used for each biological sample.

TABLE 8

Sequences of the primers.

| | | Forward primer (5'-3') | Reverse primer (5'-3') |
|---|---|---|---|
| Reference gene | PPIA | TCT TTG GGA CCT TGT CTG CAA (SEQ ID NO: 11 759) | GCC GAG GAA AAC CGT GTA CTA T (SEQ ID NO: 11 760) |
| miRNA | miR15a | ATAAAAACCTTGGAGT AAAGTAGCAG (SEQ ID NO: 11 769) | GCACAATATGGCCTGC ACC (SEQ ID NO: 11 770) |
| | miR16 | CAGCACGTAAATATTG GCGTTA (SEQ ID NO: 11 771) | TCAACCTTACTTCAGC AGCAC (SEQ ID NO: 11 772) |

Example 4: miPEPs Immunolabeling

The production of polyclonal antibodies specifically recognizing miPEP 125a, miPEP145 and miPEP15a-16-1 is made in mice or rabbits. The animals are treated by repeated injections of miPEP triggering the production of anti-miPEP antibodies.

Mesenchymal stem cells from 6 different donors are cultured for 7 days either in proliferation medium (αMEM+ 10% FCS), or in differentiation medium (αMEM+2% FCS+ β-Glycerophosphate+Ascorbic acid+BMP4). The presence of miPEP is then looked for in the cells by immunolabelings with the polyclonal antibodies anti-miPEP125a, anti-miPEP145 and anti-miPEP 15a-16-1. The cells are incubated for 1 h to 12 h with the primary antibodies. They are then washed 3 times with 0.1% PBS BSA and then treated by adding anti-species secondary antibodies (anti-mouse or anti-rabbit) conjugated to a fluorescent probe. The reading is done under an epifluorescence microscope.

Example 5: In Vivo Bone Formation by Subcutaneous Implantation in Nude Mice

All experiments are done on animals in accordance with the directive 2010/63/EU and after validation of the protocols by the animal ethics committee (Toulouse). A total of 6-8 mice was used per group. The cultured cells are osteo-induced using miPEPs, and then suspended for 1 to 2 hours in the culture medium also containing biomaterial granules in the ratio of $2\times10^6$ cells/50 mg of biomaterial. This biomaterial is biphasic inorganic calcium phosphate (BCP) composed of hydroxyapatite (HA) and beta-tricalcium phosphate ($\beta$-TCP) in a ratio of 20/80, ranging in size from 0.5 to 1 mm (sold by Biomatlante, Vigneux de Bretagne, France). The porosity of this biomaterial (% vol) was 75±5% of pores of which 70% from 0 to 10 µm, 20% from 10 to 100 µm and 10% from 100 to 300 µm. The biomaterial is sterilized by autoclaving.

Female Nude mice (RjOrl: NMRI-Foxnnul/Foxnlnu) (Laboratoires Janvier, Saint-Berthevin, France) are generally anesthetized by inhalationn of isoflurane. The biomaterial alone is implanted as a negative control. Two implants (cells+biomaterials) are subcutaneously placed in the back of the mice on each side of the spine (a mouse may contain different types of implants). After 8 weeks, the treated animals are sacrificed. The implants are then removed and fixed in a buffered 4% formalin solution.

Example 6: Pulmonary Fibrosis miR-29 as Therapeutic Target

The therapeutic benefit of increasing the level of miR-29 has been demonstrated for fibrosis in the heart, kidney, liver, lung and in a context of systemic sclerosis. The ability of a miR-29b analog to directly target the expression of Collagen1a1 (Col1a1), whose deregulation is implicated in the mechanism of fibrosis, has been demonstrated. Thus, an increasing amount of this analog results in a dose-dependent decrease in Col1a1 expression in a cell model (Montgomery et al., MicroRNA mimicry blocks pulmonary fibrosis, EMBO Mol. Med. (2014), 6(10); 1347-1356).

Demonstration of the Therapeutic Effect of a miPEP Encoded by the Primary Transcript of miR-29

NIH 3T3 cells (mouse fibroblast cell line) are cultured on DMEM medium, supplemented with 1-Glutamine (4 mM), Sodium Pyruvate (1 mM) and a 10% BCS of BCS solution. The cells are transfected with Dharmafect I according to the reseller's recommendations and then with increasing amounts of a miPEP encoded by the primary miR-29 transcript. The cells are collected 48 hours after transfection and Col1a1 expression is measured by qPCR.

Example 7: Lung Cancer (Non-Small Cell Lung Cancer)

miR let-7 as a Therapeutic Target miR letR-7 is known to act as a tumor suppressor gene in a variety of human tissues, particularly in the lung, by downregulating the post-transcriptional expression of multiple oncogenes, including RAS, MYC and HMGA2, as well as other genes for cell cycle progression. Increasing amounts of miR let-7 in overexpressing KRAS mutant cells showed a dose-dependent reduction in kras expression (Esquela-Kerscher et al., The let-7 microRNA reduces tumor growth in mouse models of lung cancer, Cell Cycle (2008), 7(6), 759-764).

Demonstration of the Therapeutic Effect of a miPEP Encoded by the Primary Transcript of miR let-7

A549 cells (KRAS overexpressing mutant cell line) were cultured on DMEM medium (90%) supplemented with fetal calf serum (10%) and 1× penicillin/streptomycin solution, then transfected with increasing amount of miPEP encoded by the primary transcript of miR let-7. The next day, the cells are rinsed and incubated for 48 hours with a conventional culture medium. The proliferation tests are carried out with the AlamarBlue kit according to the distributor's recommendations.

Example 8: Ischemia—Reperfusion miR-7 as Therapeutic Target miR-7 is implicated in the deleterious effects of ischemia-reperfusion syndrome (I/R) and is overexpressed in simulated I/R cardiomyocites. In addition, miR-7 has been shown to protect myocardial cells against apoptosis by reducing the expression of poly(ADP-ribose) polymerase (PARP). An increase in miR-7 induces a dose-dependent reduction in PARP expression (Li et al., MicroRNA-7a/b Protects against Cardiac Myocyte Injury in Ischemia/Reperfusion by Targeting Poly(ADP-Ribose) Polymerase, PLoS One (2014), 9(3); e90096).

Demonstration of the Therapeutic Effect of a miPEP Encoded by the Primary Transcript of miR-7

H9c2 cells (rat ventricular cell line) are cultured at 37° C. under 5% $CO_2$ on DMEM medium (90%) supplemented with fetal calf serum (10%) and 100 µg/mL penicillin/streptomycin solution. 48 hours after transfection of a miPEP encoded by the primary miR-7 transcript, the cells are subjected to a simulated I/R episode: the medium is replaced by glucose- and serum-deficient DMEM, and the cells are placed in a hypoxic chamber at 37° C. for 10 h and then reoxygenated for 2 h on DMEM medium containing 10% of fetal calf serum. Quantification of PARP expression is conducted in Western Blot with anti-PARP antibodies.

Example 9: Hepatitis C Virus Infection (HCV)

miR-181c as Therapeutic Target

The expression of Homeobox A1 (HOXA1) is increased in hepatocytes infected with HCV. Exogenous expression of a miR-181c analog inhibits HOXA1 and other cascading agents, including STAT5 and STAT5, involved in the regulation of cell growth. The analog also suppresses HCV replication (Mukherjee et al., Transcriptional Suppression of miR-181c by Hepatitis C Virus Enhances Homeobox A1 Expression, J. Virol. (2014), 88(14); 7929-7940).

Demonstration of the Therapeutic Effect of a miPEP Encoded by the Primary Transcript of miR-181c The human hepatoma cells (Huh7.5) are maintained on DMEM medium (90%) supplemented with fetal calf serum (10%) and antibiotics (100 U penicillin G/mL and 100 µg streptomycin/mL). HCV genotype 2a (clone JFH1) is grown in Huh7.5 cells. The supernatant is filtered on a cellulose acetate membrane. For infection, Huh7.5 cells are incubated with the viral solution for 72 h. The cells reflecting the presence of HCV genotype 2a are cultured on DMEM medium (90%) supplemented with fetal calf serum (10%) and 1% penicillin/streptomycin solution. All cells are maintained at 37° C. under 5% $CO_2$ and transfected with increasing doses of a miPEP encoded by the primary miR-181c transcript. The quantification of HOXA1 is carried out by Western Blot using dedicated antibodies.

Example 10: Evaluation of the Effects of miPEP125a on In Vivo Bone Formation by Subcutaneous Implantation in Nude Mice 10.1—Methods All experiments on animals were done in accordance with directive 2010/63/EU and after validation of protocols by the Animal Ethics Committee (Toulouse, N: 86/809 EEC). A total of 6-8 mice was used per group. The cells cultured osteo-induced or not according to the methods described elsewhere (see Example 1), were then suspended for 1 to 2 h in the culture medium also containing granules of biomaterials in the ratio of $2\times10^6$ cells/50 mg of biomaterial. These biomaterials were biphasic inorganic calcium phosphate (BCP), composed of hydroxyapatite (HA) and beta-tricalcium phosphate (β-TCP) in a ratio of 20/80, ranging in size from 0.5 to 1 mm (sold by Biomatlante, Vigneux de Bretagne, France). The porosity of these biomaterials (% vol) was 75±5% of pores of which 70% (0 to 10 µm), 20% (10 to 100 µm) and 10% (100 to 300 µm). They were sterilized by autoclaving.

The biomaterial alone has been implanted as a negative control. Female Nude mice (RjOrl: NMRI-Foxnnul/Foxnlnu) (Laboratoires Janvier, Saint-Berthevin, France) are generally anesthetized by inhalationn of isoflurane. Two implants (cells+biomaterials) are subcutaneously placed in the back of the mice on each side of the spine. After 4 weeks, the treated animals are sacrificed. The implants are then removed and fixed in a buffered 4% formalin solution. Some groups of mice will also receive regular injections (once a week) during the study either of the miPEP//125a-1 (SEQ ID NO: 11 752) or the control miPEP (scramble ScmiPEP//125a, SEQ ID NO: 11 758).

These implants were then decalcified in a solution of 4.13% EDTA/0.2% PFA in PBS for 96 hours at 50° C. using an automatic microwave for demineralization (KOS Histostation, Milestone Med. Corp. USA). The samples were dehydrated in ethanol and then butanol baths in an automatic dehydration apparatus (MicromMicrotech, Lyon, France). The samples were then immersed in paraphine (Histowax, Histolab, Gottenburg, Sweden). Fine sections (3 mm thick) were made using a microtome (Leica RM2255, Leica Biosystems, Nanterre, France). The sections were stained by the Masson trichrome technique and the collagen in light green.

The photos were obtained by a scan of each cut (NanoZoomer, Hamamatsu, Photonics, Hamamatsu City, Shizuoka, Japan) and observed virtually (NDP view, Hamamatsu). The histomorphometry of the images was done using the ImageJ software and the neoformed bone percentage was calculated by explant area. 3 to 4 sections per explant were analyzed and quantified.

10.2—Materials

Female Nude mice (RjOrl: NMRI-Foxnnul/Foxnlnu), from the approved supplier Janvier (Laboratoires Janvier, Saint-Berthevin, France), Biomaterials: Biphasic inorganic calcium phosphate (BCP), composed of hydroxyapatite (HA) and beta-tricalcium phosphate (β-TCP) in a ratio of 20/80, ranging in size from 0.5 to 1 mm (sold by Biomatlante, Vigneux de Bretagne, France), 1.5 mL Eppendorf tubes, Anesthesia table with Isoflurane, Syringes 19 G, An automatic microwave for demineralization (KOS Histostation, Milestone Med. Corp. USA), Demineralization solution of 4.13% EDTA/0.2% PFA in PBS, Ethanol, Butanol, Automatic dehydration device (MicromMicrotech, Lyon, France), Microtome (Leica RM2255, Leica Biosystems, Nanterre, France), Paraphine (Histowax, Histolab, Gottenburg, Sweden), NanoZoomer (Hamamatsu, Photonics, Hamamatsu City, Shizuoka, Japon), NDPview software (NDP view, Hamamatsu).

10.3—Results

The images in FIG. 17 show that there is no bone formation in the biomaterial control alone (FIG. 17A). In contrast, the addition of MSCs to the biomaterial generated bone formation in all cases (FIG. 17B-F). However, qualitatively it appears that this bone formation is greater when the MSCs have been pre-treated with miPEP125a-1 (FIG. 17C-D) than with the scramble miPEP (FIG. 17E-F).

Quantification of neoformed bone confirms this assessment (FIG. 17G). Indeed, there is significantly more bone formation when the MSCs were pre-treated with miPEP//125a in culture (C) than in the associated control (E: MSC pre-treated with the scramble miPEP, p=0.0499). This quantification also shows that the injection of the miPEP//125a-1 in vivo (D) is without consequence, or even decreases (in a non-significant manner) the induction effect compared to its control (C: MSCs only pre-treated). On the other hand, it is clear that the bone formation of MSCs only pre-treated in vitro (C) or MSCs pre-treated in vitro and then in vivo (D) is significantly higher than the untreated MSCs (B) (p=0.0241 and p=0.0203 respectively).

The treatment of human MSCs with miPEP//125a-1 has therefore increased their ability to form bone in vivo when previously treated in vitro.

The listing of sequences of the present invention is identical to that of the priority document, which corresponds to the French application No. FR16/63245 filed on Dec. 22, 2016.

SEQUENCE LISTING (11772 sequences)

SEQ ID NO: 1 - protein, 136 aa, homo sapiens [sequence omitted]

SEQ ID NO: 2 - DNA, 411 bp, homo sapiens
atggcggacgcggcagcgagcgcgggtccgtcgccattttatttcgcggagactcgcggcagcgggtgggcagaatgggagagccgtgcgccggcccgcgcctgtccggctaacgcgggctgggactggtggggcggcctgccccctccagcgggcgggtggccccggggggccggcgggctgctagcggaagtcgcgggcgctcggggcacgggggaggggtgccgcgtggccgccgcggggccggctccaaccccctccgcttcccgcccagctcctcaccgacagggcgggggagggggggtcattcttcacattccttaccccgcccttccccccgcttcaatcaaacttggggcgggcggaaggcccgccttccggccggcgcctgttggccggcgccgcctctga

SEQ ID NO: 3 - protein, 12 aa, homo sapiens
MGEPCAGPRLSG

SEQ ID NO: 4 - DNA, 39 bp, homo sapiens
atgggagagccgtgcgccggcccgcgcctgtccggctaa

SEQ ID NO: 5 - protein, 5 aa, homo sapiens
MKEGR

SEQ ID NO: 6 - DNA, 18 bp, homo sapiens
atgaaggagggaaggtag

SEQ ID NO: 7 - protein, 13 aa, homo sapiens
MPLLPAAKCSLPS

SEQ ID NO: 8 - DNA, 42 bp, homo sapiens
atgcccctgctccccgcggccaagtgcagcctcccttcctga

SEQ ID NO: 9 - protein, 11 aa, homo sapiens
MRETIRKTEKL

SEQ ID NO: 10 - DNA, 36 bp, homo sapiens
atgagagaaacgatcagaaaaactgaaaagctgtag

SEQ ID NO: 11 - protein, 32 aa, homo sapiens
MSPWIQCSSPQPGKTQINFPFCKQLHCEFAFH

SEQ ID NO: 12 - DNA, 99 bp, homo sapiens
atgtcaccatggattcagtgttcaagtccacagccaggcaaaactcaaataaattttcctttttgcaagcagctgcactgtgagttcgccttccattag

SEQ ID NO: 13 - protein, 24 aa, homo sapiens
MDSVFKSTARQNSNKFSFLQAAAL

SEQ ID NO: 14 - DNA, 75 bp, homo sapiens
atggattcagtgttcaagtccacagccaggcaaaactcaaataaattttcctttttgcaagcagctgcactgtga

SEQ ID NO: 15 - protein, 13 aa, homo sapiens
MKGRRTPRPKHGQ

SEQ ID NO: 16 - DNA, 42 bp, homo sapiens
atgaagggaaggcgaaccccgcgtccaaaacatggccaatga

SEQ ID NO: 17 - protein, 36 aa, homo sapiens
MYKYIHILGFLIFFISVAFGVQVVIGYMDELYSGEV

SEQ ID NO: 18 - DNA, 111 bp, homo sapiens
atgtataagtacatacatattttggggtttttaattttttttatttcagtagcttttggggtacaagtggttattggttacatggatgaattgtatagtggtgaagtctga

SEQ ID NO: 19 - protein, 17 aa, homo sapiens
MNCIVVKSEILVHSSPT

SEQ ID NO: 20 - DNA, 54 bp, homo sapiens
atgaattgtatagtggtgaagtctgagattttagtgcactcgtcacctacctga

SEQ ID NO: 21 - protein, 5 aa, homo sapiens
MLSSV

SEQ ID NO: 22 - DNA, 18 bp, homo sapiens
atgctttcaagtgtctaa

SEQ ID NO: 23 - protein, 17 aa, homo sapiens
MKRKFDRFYDNSFFFSS

SEQ ID NO: 24 - DNA, 54 bp, homo sapiens
atgaagagaaaatttgatcgcttttatgataatagtttttttttctcttcctaa

SEQ ID NO: 25 - protein, 136 aa, homo sapiens [sequence omitted]

SEQ ID NO: 26 - DNA, 411 bp, homo sapiens; identical to SEQ ID NO: 2

SEQ ID NO: 27 - protein, 12 aa, homo sapiens
MGEPCAGPRLSG

SEQ ID NO: 28 - DNA, 39 bp, homo sapiens; identical to SEQ ID NO: 4

SEQ ID NO: 29 - protein, 5 aa, homo sapiens
MKEGR

SEQ ID NO: 30 - DNA, 18 bp, homo sapiens
atgaaggagggaaggtag

SEQ ID NO: 31 - protein, 13 aa, homo sapiens
MPLLPAAKCSLPS

SEQ ID NO: 32 - DNA, 42 bp, homo sapiens; identical to SEQ ID NO: 8

SEQ ID NO: 33 - protein, 301 aa, homo sapiens
MGDTDNAPQAEKEDGDRERAKGRTDVQRQKGGQTERDTERQQKQPRMTGAERRRERGRERERERERREGGREGERERESTHRARRRRRREEGGRPARDRTGRRGGGELGKAGEERDWPRRRAGERERRPRRLPASFVPSLLCVRLLWPGLPLPLPPPPRGWMEFFPLDLGQLRGRGEARPDWAGRWGGAGAGGPLGRGLVRRPRSRRGPGRGSPGPQSRGGGDGRRESGRREGGWRGRREEGERPPCGEGGERMESARRRWGPACGPGAAEKTPSLRRGSRGSRESAEREGGGLGPALLGP

SEQ ID NO: 34 - DNA, 906 bp, homo sapiens
atgggagacacagataatgccccacaggcagagaaagaggatggagatagggagagggcgaaaggaaggacagatgtgcagagacagaagggaggacagacggaaagagacacagagaggcagcaaaagcaaccaagaatgacaggagcagagaggaggagggaaagagggagagagagagagagagaacgagagagaagggagggagggagagagggagagagagagcgagagagcacgcacagagcgaggaggaggcgcaggagagaagagggagggaggccagcgagggacaggacggggcggagaggcggaggggagctagggaaagccggggaggagcgagactggccgaggaggagggcgggcgagcgggagcgccggccccgccgcctcccggcctcttttgtcccttccctcctctgcgtcaggcttctctggcccggcctccccctcccgctccctcctcctccccggggctggatggaattttttcccctggacctgggccagctccggggcaggggggaagccaggccggactgggctgggcggtggggaggggccggggcggggggccccctggggagggggctggtccgacggccgcgcagccggcggggtccagggagggggagccccggaccgcagagccggggaggaggtgacggccggagggagtcggggagaagggaaggaggatggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccgtgagtctgcggaaagggagggtggggggctggggcccgcactcctgggtccctga

SEQ ID NO: 35 - protein, 41 aa, homo sapiens
MPHRQRKRMEIGRGRKEGQMCRDRREDRRKETQRGSKSNQE

SEQ ID NO: 36 - DNA, 126 bp, homo sapiens
atgccccacaggcagagaaagaggatggagatagggagagggcgaaaggaaggacagatgtgcagagacagaagggaggacagacggaaagagacacagagaggcagcaaaagcaaccaagaatga

SEQ ID NO: 37 - protein, 50 aa, homo sapiens [sequence omitted]

SEQ ID NO: 38 - DNA, 153 bp, homo sapiens
atggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccgtga

SEQ ID NO: 39 - protein, 13 aa, homo sapiens
MGAGAGRIVAGRD

SEQ ID NO: 40 - DNA, 42 bp, homo sapiens
atgggggctggggctggtaggatcgtggctggaagagactag

SEQ ID NO: 41 - protein, 136 aa, homo sapiens [sequence omitted]

SEQ ID NO: 42 - DNA, 411 bp, homo sapiens; identical to SEQ ID NO: 2

SEQ ID NO: 43 - protein, 12 aa, homo sapiens
MGEPCAGPRLSG

SEQ ID NO: 44 - DNA, 39 bp, homo sapiens; identical to SEQ ID NO: 4

SEQ ID NO: 45 - protein, 5 aa, homo sapiens
MKEGR

SEQ ID NO: 46 - DNA, 18 bp, homo sapiens
atgaaggagggaaggtag

SEQ ID NO: 47 - protein, 13 aa, homo sapiens
MPLLPAAKCSLPS

SEQ ID NO: 48 - DNA, 42 bp, homo sapiens; identical to SEQ ID NO: 8

SEQ ID NO: 49 - protein, 36 aa, homo sapiens; identical to SEQ ID NO: 17

SEQ ID NO: 50 - DNA, 111 bp, homo sapiens; identical to SEQ ID NO: 18

SEQ ID NO: 51 - protein, 17 aa, homo sapiens
MNCIVVKSEILVHSSPT

SEQ ID NO: 52 - DNA, 54 bp, homo sapiens; identical to SEQ ID NO: 20

SEQ ID NO: 53 - protein, 5 aa, homo sapiens
MLSSV

SEQ ID NO: 54 - DNA, 18 bp, homo sapiens
atgctttcaagtgtctaa

SEQ ID NO: 55 - protein, 17 aa, homo sapiens
MKRKFDRFYDNSFFFSS

SEQ ID NO: 56 - DNA, 54 bp, homo sapiens; identical to SEQ ID NO: 24

SEQ ID NO: 57 - protein, 11 aa, homo sapiens
MRETIRKTEKL

SEQ ID NO: 58 - DNA, 36 bp, homo sapiens; identical to SEQ ID NO: 10

SEQ ID NO: 59 - protein, 32 aa, homo sapiens; identical to SEQ ID NO: 11

SEQ ID NO: 60 - DNA, 99 bp, homo sapiens; identical to SEQ ID NO: 12

SEQ ID NO: 61 - protein, 24 aa, homo sapiens
MDSVFKSTARQNSNKFSFLQAAAL

SEQ ID NO: 62 - DNA, 75 bp, homo sapiens; identical to SEQ ID NO: 14

SEQ ID NO: 63 - protein, 13 aa, homo sapiens
MKGRRTPRPKHGQ

SEQ ID NO: 64 - DNA, 42 bp, homo sapiens; identical to SEQ ID NO: 16

SEQ ID NO: 65 - protein, 7 aa, homo sapiens
MRVCFFY

SEQ ID NO: 66 - DNA, 24 bp, homo sapiens
atgagagtctgtttcttttattag

SEQ ID NO: 67 - protein, 33 aa, homo sapiens
MSVPSPPFPRQVVICRCFGIFSSLWTCPPPTSK

SEQ ID NO: 68 - DNA, 102 bp, homo sapiens
atgtctgtccccagcccccctttcccccggcaagttgtgatctgcagatgttttgggattttctcttccctctggacctgtcccccaccaaccagcaaatag

SEQ ID NO: 69 - protein, 29 aa, homo sapiens
MFWDFLFPLDLSPTNQQIAPGPRLREREK

SEQ ID NO: 70 - DNA, 90 bp, homo sapiens
atgttttgggattttctcttccctctggacctgtcccccaccaaccagcaaatagctcctgggcctaggttgagggagagagagaagtga

SEQ ID NO: 71 - protein, 7 aa, homo sapiens
MESAVPP

SEQ ID NO: 72 - DNA, 24 bp, homo sapiens
atggaatctgctgtccctccgtag

SEQ ID NO: 73 - protein, 334 aa, homo sapiens
MKSAASSRGGGGGGRGGGGWGSWGGGRGGGGGAGKGGGGDGGGQGGKGGFGARARGFGGGGRGRGRGGGDGKDRGGGGQRRGGVAKSKSRRRKGAMVVSVEPHRHEGVFIYRGAEDALVTLNMVPGQSVYGERRVTVTEGGVKQEYRTWNPFRSKLAAAILGGVDQIHIKPKSKVLYLGAASGTTVSHVSDIIGPDGLVYAVEFSHRAGRDLVNVAKKRTNIIPVLEDARHPLKYRMLIGMVDVIFADVAQPDQSRIVALNAHTFLRNGGHFLISIKANCIDSTASAEAVFASEVRKLQQENLKPQEQLTLEPYERDHAVVVGVYRPLPKSSSK

SEQ ID NO: 74 - DNA, 1005 bp, homo sapiens
atgaagtcggccgcgagctcgcgcgggggcggtgggggcggccgcgggggcggcggctggggcagctggggcgggggccgaggcggcggcggcggcgcgggcaagggcggcgggggcgacggcggcggccaggggggcaagggcggcttcggggcgcgggcgcgcggcttcggcgggggcggccggggccgggggcgcggcggcggcgacggcaaggatcgcggcggcggtggacagcggcggggcggcgtggccaagagcaagagccgccgcaggaagggcgccatggtggtgtcggtggagccgcaccggcacgagggcgtcttcatctaccgcggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggccgcggccatcctgggcggggtggaccagatccacatcaagcccaagtccaaggtgctgtacctgggcgccgcgtcgggcaccaccgtctcccatgtctccgacatcattggcccagacggcctggtctacgccgtcgagttctcccaccgcgccggccgcgatctggtcaacgtggccaagaagcgcaccaacatcattccggtcctggaggacgcgcggcacccgctcaagtaccgcatgctcatcgggatggtggacgtgatcttcgccgacgtggcccagccggaccagtcccgcatcgtggccctgaacgcccacaccttcctgcgcaatgggggccactttctcatctccatcaaggccaactgcatcgactccaccgcatccgccgaggctgtgtttgcttctgaggtgaggaagttgcagcaggagaacttgaagcctcaagagcagctgaccctggagccctatgagcgggaccacgctgtggtggtcggggtctaccgacctcttcccaagagcagcagcaaatag

SEQ ID NO: 75 - protein, 56 aa, homo sapiens
MSPTSLAQTAWSTPSSSPTAPAAIWSTWPRSAPTSFRSWRTRGTRSSTACSSGWWT

SEQ ID NO: 76 - DNA, 171 bp, homo sapiens
atgtctccgacatcattggcccagacggcctggtctacgccgtcgagttctcccaccgcgccggccgcgatctggtcaacgtggccaagaagcgcaccaacatcattccggtcctggaggacgcgcggcacccgctcaagtaccgcatgctcatcgggatggtggacgtga

SEQ ID NO: 77 - protein, 27 aa, homo sapiens
MGATFSSPSRPTASTPPHPPRLCLLLR

SEQ ID NO: 78 - DNA, 84 bp, homo sapiens
atgggggccactttctcatctccatcaaggccaactgcatcgactccaccgcatccgccgaggctgtgtttgcttctgaggtga

SEQ ID NO: 79 - protein, 56 aa, homo sapiens
MSGTTLWWSGSTDLFPRAAANSTQLRLACHLPKAALCLLLFSVCFLCECFVLLFFY

SEQ ID NO: 80 - DNA, 171 bp, homo sapiens
atgagcgggaccacgctgtggtggtcggggtctaccgacctcttcccaagagcagcagcaaatagcacccagctcaggctcgcctgccatctccccaaggctgcgttgtgtttgctattattttctgtgtgttttctttgtgagtgttttgttttgttgtttttctattaa

SEQ ID NO: 81 - protein, 13 aa, homo sapiens
MATSGGQTERDSC

SEQ ID NO: 82 - DNA, 42 bp, homo sapiens
atggccactagtggagggcagactgaaagggacagctgctaa

SEQ ID NO: 83 - protein, 47 aa, homo sapiens [sequence omitted]

SEQ ID NO: 84 - DNA, 144 bp, homo sapiens
atggtaacagcagagtttatgggcacctcacaacctgaaggtggtgagacggcagtaagctgggatgaggatgtgggcactgctgcacagagatcaacaaatgcagagagaaggcagtgtctcggggctggagctcagaggtaa

SEQ ID NO: 85 - protein, 57 aa, homo sapiens
MRMWALLHRDQQMQREGSVSGLELRGKGWLKCSLEISQGDANDCLGRPRTEAEDSHS

SEQ ID NO: 86 - DNA, 174 bp, homo sapiens
atgaggatgtgggcactgctgcacagagatcaacaaatgcagagagaaggcagtgtctcggggctggagctcagaggtaaggggtggttgaagtgttccctggaaatcagtcaaggtgatgctaatgactgcttggggagacccaggactgaggctgaggacagccacagctaa

SEQ ID NO: 87 - protein, 44 aa, homo sapiens
MLMTAWGDPGLRLRTATANCQQRMNQNISSLGGRTGKRALLSEN

SEQ ID NO: 88 - DNA, 135 bp, homo sapiens
atgctaatgactgcttggggagacccaggactgaggctgaggacagccacagctaactgtcagcagagaatgaaccagaacattagtagcctgggtggcaggacaggcaagagggctctgctgagtgagaactga

SEQ ID NO: 89 - protein, 26 aa, homo sapiens
MKKGRKPTCASDSRWRNDCGFRCIHR

SEQ ID NO: 90 - DNA, 81 bp, homo sapiens
atgaaaaaggggaggaagcccacctgtgcgagtgactcgcgttggagaaatgattgtggttttcgttgcatccaccgctga

SEQ ID NO: 91 - protein, 12 aa, homo sapiens
MIVVFVASTADS

SEQ ID NO: 92 - DNA, 39 bp, homo sapiens
atgattgtggttttcgttgcatccaccgctgactcctga

SEQ ID NO: 93 - protein, 57 aa, homo sapiens
MAPLSSSGLWAATITLVTMVEREGSGFILHPFPPSLPPACLPGLSSSDPACSLVSDL

SEQ ID NO: 94 - DNA, 174 bp, homo sapiens
atggcgcccttgtcctcttctgggctttgggctgccacaatcaccctggtaacaatggtggaaagggaggggtccggcttcattttgcaccccttccctccttccttgccccccgcttgccttccagggctttcctcctccgacccagcgtgctcactggtctctgatttgtaa

SEQ ID NO: 95 - protein, 26 aa, homo sapiens
MLNSILIVRLKLRHHFILQSAVGLWP

SEQ ID NO: 96 - DNA, 81 bp, homo sapiens
atgcttaattccattttgattgtgcgtcttaaactaagacatcattttattctacagagcgctgtcgggctttggccttga

SEQ ID NO: 97 - protein, 5 aa, homo sapiens
MTGGC

SEQ ID NO: 98 - DNA, 18 bp, homo sapiens
atgacgggaggctgctga

SEQ ID NO: 99 - protein, 5 aa, homo sapiens
MPPSA

SEQ ID NO: 100 - DNA, 18 bp, homo sapiens
atgccacccagcgcctga

SEQ ID NO: 101 - protein, 9 aa, homo sapiens
MIILFPQKA

SEQ ID NO: 102 - DNA, 30 bp, homo sapiens
atgattattctgtttcctcagaaagcttga

SEQ ID NO: 103 - protein, 4 aa, homo sapiens
MVSV

SEQ ID NO: 104 - DNA, 15 bp, homo sapiens
atggtttccgtttaa

SEQ ID NO: 105 - protein, 15 aa, homo sapiens
MAIHWGIRFSFMLFP

SEQ ID NO: 106 - DNA, 48 bp, homo sapiens
atggctattcactggggcatcaggttttctttcatgctatttccctga

SEQ ID NO: 107 - protein, 23 aa, homo sapiens
MVHMYGTYIFTEQQYLQSCECNN

SEQ ID NO: 108 - DNA, 72 bp, homo sapiens
atggtacacatgtatggcacttacattttcactgagcagcaatacttgcaaagctgtgagtgcaataactaa

SEQ ID NO: 109 - protein, 45 aa, homo sapiens
MALTFSLSSNTCKAVSAITKQIMVFSSGKGSEITYSTPLFHRRGF

SEQ ID NO: 110 - DNA, 138 bp, homo sapiens
atggcacttacattttcactgagcagcaatacttgcaaagctgtgagtgcaataactaaacagatcatggtgttttcaagcgggaaggggtcagaaatcacgtattcaacccccttgtttcacagaagaggattctga

SEQ ID NO: 111 - protein, 4 aa, homo sapiens
MGEQ

SEQ ID NO: 112 - DNA, 15 bp, homo sapiens
atgggtgagcagtga

SEQ ID NO: 113 - protein, 27 aa, homo sapiens
MKIFIPLPHSTRLQDSCFRSFSPVEDV

SEQ ID NO: 114 - DNA, 84 bp, homo sapiens
atgaaaatcttcatccccctcccccattctactaggctacaagattcttgttttcgttccttctcaccggtggaagatgtgtaa

SEQ ID NO: 115 - protein, 41 aa, homo sapiens
MCKIKDVEVCSDFFKSQLTTARTATRITRAHAGCKYHPFLR

SEQ ID NO: 116 - DNA, 126 bp, homo sapiens
atgtgtaaaatcaaagatgtagaggtgtgtagtgatttttttaaaagccaactaaccaccgcacggactgcgacgcggattacccgagcgcacgccggctgtaagtaccatcctttcctgcggtag

SEQ ID NO: 117 - protein, 11 aa, homo sapiens
MLESRRLSSGL

SEQ ID NO: 118 - DNA, 36 bp, homo sapiens
atgcttgagagccgccggctcagctccgggctgtaa

SEQ ID NO: 119 - protein, 43 aa, homo sapiens [sequence omitted]

SEQ ID NO: 120 - DNA, 132 bp, homo sapiens
atggatggaaatcaggtcacagagatccctaagcttgccaggctctcagacacgcttgggagacagaatggaattggaaggagggatctgaagaggagggaggggatccgtgttcccccaccccgggcctag

SEQ ID NO: 121 - protein, 266 aa, homo sapiens
MSIQLRHAVNAKRGASAAPFSWKWPASPSGPAPLPREEGEPGPRRPFAPRTNPANNAPAQSAAQLPGRGSGRGTQRGPHASGVAGRVGAAEGGRGGSLRPGPGCGQPAPGHVCPQRGAPRRPQRAAGPGRQREGPRGAAGGCVGRRARVRRCPRCWRRGGPRGTGGRPSAALAPTAGALDSCHGNVGGGGAGSEVTAKSALPRAAAPRGGAEAALAVAPEQPPQPRTRLAWGRGSASASRVQTRAVDTPDRIPPPKPALGCAGPGT

SEQ ID NO: 122 - DNA, 801 bp, homo sapiens
atgtctatacaattaaggcacgcggtgaatgccaagagaggcgcctccgccgctcctttctcatggaaatggcccgcgagcccgtccggcccagcgcccctcccgcgggaggaaggcgagcccggcccccggcggccattcgcgccgcggacaaatccggcgaacaatgcgcccgcccagagtgcggcccagctgccgggccggggatctggccgcgggacacaaaggggcccgcacgcctctggcgtcgcggggcgggtgggggcggccgagggcggccgaggggggagcctgcggccggggccaggctgcggccagccggcccccggccacgtgtgtccgcagcgcggagcgcccaggcgcccgcagagggcggcggggcccgggagacaaagggagggtccacggggagcggcgggcgggtgcgtggggcggcgggctagggtgcggcgctgtccgcggtgctggcggcggggcggcccccgcgggacgggagggcggccaagtgcggccctcgcccccacagcgggcgccctggacagttgccacggcaacgtgggaggaggtggggcagggtctgaggtcaccgctaagtctgcccttcctcgggccgctgcgccgcggggcggggcggaggcggcgctcgctgtggccccagagcagcccccgcagcccaggaccaggcttgcatggggacgggggtctgcgtccgcgtccagggtccaaacgagggcggtggacacgccggaccgcatcccgcccccaaagccggctctgggctgtgcaggaccaggcacgtga

SEQ ID NO: 123 - protein, 323 aa, homo sapiens [sequence omitted]

SEQ ID NO: 124 - DNA, 972 bp, homo sapiens
atgccaagagaggcgcctccgccgctcctttctcatggaaatggcccgcgagcccgtccggcccagcgcccctcccgcgggaggaaggcgagcccggcccccggcggccattcgcgccgcggacaaatccggcgaacaatgcgcccgcccagagtgcggcccagctgccgggccggggatctggccgcgggacacaaaggggcccgcacgcctctggcgtcgcggggcgggtgggggcggccgagggcggccgaggggggagcctgcggccggggccaggctgcggccagccggcccccggccacgtgtgtccgcagcgcggagcgcccaggcgcccgcagagggcggcggggcccgggagacaaagggagggtccacggggagcggcgggcgggtgcgtggggcggcgggctagggtgcggcgctgtccgcggtgctggcggcggggcggcccccgcgggacgggagggcggccaagtgcggccctcgcccccacagcgggcgccctggacagttgccacggcaacgtgggaggaggtggggcagggtctgaggtcaccgctaagtctgcccttcctcgggccgctgcgccgcggggcggggcggaggcggcgctcgctgtggccccagagcagcccccgcagcccaggaccaggcttgcatggggacgggggtctgcgtccgcgtccagggtccaaacgagggcggtggacacgccggaccgcatcccgcccccaaagccggctctgggctgtgcaggaccaggcacgtgagactccgcagcccagggagaaaatgacaaatccctcccccgccgccatctgcagccgcagtgacacccactcgggtttgctgcaggggttttttttctgtccccggaagccagcgccacctgctgacgcccggcaccgcctctgcgccgcctcccccgcgcccatcccaggccccggctgggctgtgatgccccggtaa

SEQ ID NO: 125 - protein, 126 aa, homo sapiens
MEMAREPVRPSAPPAGGRRARPPAAIRAADKSGEQCARPECGPAAGPGIWPRDTKGPARLWRRGAGGGGRGRPRGEPAAGARLRPAGPRPRVSAARSAQAPAEGGGARETKGGSTGSGGRVRGAAG

SEQ ID NO: 126 - DNA, 381 bp, homo sapiens
atggaaatggcccgcgagcccgtccggcccagcgcccctcccgcgggaggaaggcgagcccggcccccggcggccattcgcgccgcggacaaatccggcgaacaatgcgcccgcccagagtgcggcccagctgccgggccggggatctggccgcgggacacaaaggggcccgcacgcctctggcgtcgcggggcgggtgggggcggccgagggcggccgaggggggagcctgcggccggggccaggctgcggccagccggcccccggccacgtgtgtccgcagcgcggagcgcccaggcgcccgcagagggcggcggggcccgggagacaaagggagggtccacggggagcggcgggcgggtgcgtggggcggcgggctag

SEQ ID NO: 127 - protein, 45 aa, homo sapiens
MGTGVCVRVQGPNEGGGHAGPHPAPKAGSGLCRTRHVRLRSPGRK

SEQ ID NO: 128 - DNA, 138 bp, homo sapiens
atggggacgggggtctgcgtccgcgtccagggtccaaacgagggcggtggacacgccggaccgcatcccgcccccaaagccggctctgggctgtgcaggaccaggcacgtgagactccgcagcccagggagaaaatga

SEQ ID NO: 129 - protein, 301 aa, homo sapiens; identical to SEQ ID NO: 33

SEQ ID NO: 130 - DNA, 906 bp, homo sapiens; identical to SEQ ID NO: 34

SEQ ID NO: 131 - protein, 41 aa, homo sapiens; identical to SEQ ID NO: 35

SEQ ID NO: 132 - DNA, 126 bp, homo sapiens; identical to SEQ ID NO: 36

SEQ ID NO: 133 - protein, 50 aa, homo sapiens [sequence omitted]

SEQ ID NO: 134 - DNA, 153 bp, homo sapiens; identical to SEQ ID NO: 38

SEQ ID NO: 135 - protein, 13 aa, homo sapiens
MGAGAGRIVAGRD

SEQ ID NO: 136 - DNA, 42 bp, homo sapiens; identical to SEQ ID NO: 40

SEQ ID NO: 137 - protein, 11 aa, homo sapiens
MRETIRKTEKL

SEQ ID NO: 138 - DNA, 36 bp, homo sapiens; identical to SEQ ID NO: 10

SEQ ID NO: 139 - protein, 32 aa, homo sapiens; identical to SEQ ID NO: 11

SEQ ID NO: 140 - DNA, 99 bp, homo sapiens; identical to SEQ ID NO: 12

SEQ ID NO: 141 - protein, 24 aa, homo sapiens
MDSVFKSTARQNSNKFSFLQAAAL

SEQ ID NO: 142 - DNA, 75 bp, homo sapiens; identical to SEQ ID NO: 14

SEQ ID NO: 143 - protein, 13 aa, homo sapiens
MKGRRTPRPKHGQ

SEQ ID NO: 144 - DNA, 42 bp, homo sapiens; identical to SEQ ID NO: 16

SEQ ID NO: 145 - protein, 5 aa, homo sapiens
MRRAL

SEQ ID NO: 146 - DNA, 18 bp, homo sapiens
atgaggagggcattgtag

SEQ ID NO: 147 - protein, 13 aa, homo sapiens
MRVIDPGCRSPKE

SEQ ID NO: 148 - DNA, 42 bp, homo sapiens
atgagggtcattgatcctgggtgcagatctccaaaagaatga

SEQ ID NO: 149 - protein, 24 aa, homo sapiens
MTERKREWWKETIGWEKMKIEKRK

SEQ ID NO: 150 - DNA, 75 bp, homo sapiens
atgacagaaagaaagagggagtggtggaaagaaacaataggatgggaaaaaatgaaaatagaaaaaaggaagtga

SEQ ID NO: 151 - protein, 17 aa, homo sapiens
MGKNENRKKEVKEIINN

SEQ ID NO: 152 - DNA, 54 bp, homo sapiens
atgggaaaaaatgaaaatagaaaaaaggaagtgaaagagataataaataattag

SEQ ID NO: 153 - protein, 51 aa, homo sapiens
MLGVWARHEGPSLAGPDGSSTPSGKARDKPLHAELCRELEADTIHSANLQW

SEQ ID NO: 154 - DNA, 156 bp, homo sapiens
atgttgggagtctgggcaaggcacgagggcccctctctagcaggtcccgatggctcctccacaccttcaggaaaagcaagagataaaccattgcatgctgagctctgcagggaactggaggcggacaccatccattctgcaaacctgcaatggtga

SEQ ID NO: 155 - protein, 78 aa, homo sapiens
MAPPHLQEKQEINHCMLSSAGNWRRTPSILQTCNGDTSGISLPLPGLQPLRQVRPRPGWLRDLCVALLTSCYGSRRPL

SEQ ID NO: 156 - DNA, 237 bp, homo sapiens
atggctcctccacaccttcaggaaaagcaagagataaaccattgcatgctgagctctgcagggaactggaggcggacaccatccattctgcaaacctgcaatggtgacacttctggaatctccttgcctcttccagggctgcagcctctaaggcaggtaagacccaggccaggttggctcagggacctctgtgtagcattgctgacctcatgttatggaagcaggaggccactgtga

SEQ ID NO: 157 - protein, 16 aa, homo sapiens
MVTLLESPCLFQGCSL

SEQ ID NO: 158 - DNA, 51 bp, homo sapiens
atggtgacacttctggaatctccttgcctcttccagggctgcagcctctaa

SEQ ID NO: 159 - protein, 13 aa, homo sapiens
MLWKQEATVRCGA

SEQ ID NO: 160 - DNA, 42 bp, homo sapiens
atgttatggaagcaggaggccactgtgagatgcggggcttag

SEQ ID NO: 161 - protein, 69 aa, homo sapiens
MKTAARGAFELRRLLSRCPLSAPRTSLPLPAGARSGAPARSPAKRRVFNKLEEGRNAGVKLGKPQLPRS

SEQ ID NO: 162 - DNA, 210 bp, homo sapiens
atgaaaaccgctgccaggggggcatttgaactccgtcgcttgctgtctcgctgtcccctctctgccccgcgcacctcgctccccctcccggccggcgctcgcagtggcgcgcctgctcgctctcccgctaagcgacgagtcttcaacaagttggaggaaggcaggaacgcaggggttaagctcggaaagccgcaattaccaagatcgtga

SEQ ID NO: 163 - protein, 103 aa, homo sapiens
MPWEGEWVAELQEGDGWAKGVGRQGLEDSASTVERRFLRACWARVGVCVRARAPARTSIPGCQRTNMATFPPSSCNVCSNPSWVRFPPLGDYTAREGDSQDVP

SEQ ID NO: 164 - DNA, 312 bp, homo sapiens
atgccgtgggagggtgagtgggtcgcggagctgcaggagggtgatggatgggcgaagggggtgggtcgacagggacttgaagacagtgcctccaccgtcgagagacgttttctccgggcgtgctgggcgagggtgggagtgtgtgtgcgcgcgcgcgcgcccgcccgcacgtcgattccagggtgccaaagaacaaatatggcaactttccccccaagttcttgcaatgtttgcagtaacccatcctgggtgaggtttcccccactgggggactatactgctagggagggagatagtcaggacgtcccttag

SEQ ID NO: 165 - protein, 69 aa, homo sapiens
MDGRRGWVDRDLKTVPPPSRDVFSGRAGRGWECVCARARPPARRFQGAKEQIWQLSPQVLAMFAVTHPG

SEQ ID NO: 166 - DNA, 210 bp, homo sapiens
atggatgggcgaagggggtgggtcgacagggacttgaagacagtgcctccaccgtcgagagacgttttctccgggcgtgctgggcgagggtgggagtgtgtgtgcgcgcgcgcgcgcccgcccgcacgtcgattccagggtgccaaagaacaaatatggcaactttccccccaagttcttgcaatgtttgcagtaacccatcctgggtga

SEQ ID NO: 167 - protein, 10 aa, homo sapiens
MGEGGGSTGT

SEQ ID NO: 168 - DNA, 33 bp, homo sapiens
atgggcgaagggggtgggtcgacagggacttga

SEQ ID NO: 169 - protein, 10 aa, homo sapiens
MCRYRELPEG

SEQ ID NO: 170 - DNA, 33 bp, homo sapiens
atgtgtaggtatcgagagcttcccgaagggtaa

SEQ ID NO: 171 - protein, 48 aa, homo sapiens
MGGSAGHGRAGPSVSTWVVCEGVECSEGDRGPKGWSRAGSSAPPEVVG

SEQ ID NO: 172 - DNA, 147 bp, homo sapiens
atggggggctccgctgggcacggccgagctgggccatctgtctccacctgggttgtgtgcgagggcgtggagtgttccgagggggaccgggggccgaagggctggagcagggcagggagttctgcacctccagaagttgtagggtga

SEQ ID NO: 173 - protein, 29 aa, homo sapiens
MCVCGGRALTLQFLLFGCVMRAELCSKYG

SEQ ID NO: 174 - DNA, 90 bp, homo sapiens
atgtgtgtgtgtggggggcgtgcgctcacactccagttcttgttgtttgggtgtgtaatgagggctgagttgtgcagcaagtatggctga

SEQ ID NO: 175 - protein, 120 aa, homo sapiens
MAESLCVCVCVCVVCTCACVVQPRGVCVRGEHSWVLKESAPHPPLPSCLSHPIHRTWLSGPSWSPPPVAMAARRGWEETVGASPLPLLLQLTPHLPFLSLSQAGPHPLLLWGQGPEDGGQ

SEQ ID NO: 176 - DNA, 363 bp, homo sapiens
atggctgagagtttgtgtgtgtgtgtgtgtgtgtgtgtggtgtgtacgtgcgcctgtgtggtccagcctcgaggtgtgtgtgttcggggggagcacagttgggtgttgaaggagagcgcccctcaccccccacttcccagctgcctctctcatcccattcacagaacatggctttcaggaccctcctggtctcctcctcccgtcgccatggctgcgaggagggggtgggaggagacagttggggccagccccctgcccctgctgctccagctaaccccccacctgccctttctctccctttcacaggctgggccccatcccctgctgctctgggggcaggggccggaagatggtggccaatga

SEQ ID NO: 177 - protein, 106 aa, homo sapiens
MITSHKKPLVRWLLSCSSSCLEWPGASIVSSIVCPAHSPAGTHTGRVRAVRRPGRLAPARHFSPPLPLPSAERGHQPCGLGTGEGPAALWSGSPGRPARTRRRSRR

SEQ ID NO: 178 - DNA, 321 bp, homo sapiens
atgatcacgtcgcacaagaagcccttggtgcgctggttgttgagctgcagcagcagctgcctggagtggccgggcgcctccatcgtgtccagcatcgtctgcccagcacactctcctgcggggacacacaccggccgggtgagagccgtgcggcgccctggccgcctggccccagcccggcacttctcccctccacttccccttccctcagctgagcgggggcatcagccctgcggcctgggcaccggcgaaggaccggctgccctctggagtgggagcccaggccggcccgcccggaccaggagaaggagcaggaggtga

SEQ ID NO: 179 - protein, 38 aa, homo sapiens
MSASGKVIQGGELYPSREKGSRGTSASRLGRSCPSWGK

SEQ ID NO: 180 - DNA, 117 bp, homo sapiens
atgtccgcttcaggaaaagtcattcagggcggagaactttacccaagtagggagaaagggagccgaggaaccagcgcctcccgcctcgggagaagttgccccagttgggggaagtga

SEQ ID NO: 181 - protein, 45 aa, homo sapiens
MPHPPLPGPELCQGSAPASPARQLPFPSLPLASPAHVRAEPAPGR

SEQ ID NO: 182 - DNA, 138 bp, homo sapiens
atgccccacccgccgctgccaggccccgagctgtgccagggcagcgcccctgccagccccgcccgccagctccccttcccttcccttcccctcgcctctccagcccatgtgcgggcagagccggccccgggccgctga

SEQ ID NO: 183 - protein, 244 aa, homo sapiens [sequence omitted]

SEQ ID NO: 184 - DNA, 735 bp, homo sapiens
atgtgcgggcagagccggccccgggccgctgaccccgccgtgaacccggcgcggagccgcggcccggtggtcctgagtccgaaagggacgacacccggagccctgaacgccagccgccagccgcgatggggcacccgcgccagaagatgcacccgaggcggccgacgcacgaggaccgggctgtcccgggtcccccgtccctcccggtccccggctcgaggacccacctggggggcatgtcgaaagccccgggcccggctgacggcggatccaggggggacgtggctgcgctgccctccgcccgccgggcccccggtcggtctgtcctgctggtccgtcctccccgcgtcctggtcgcgtctcagccccgccgcgctttccgcacactcttatctggagcggcccgggccggcgggcgctgctgcggctatggcgccacctcgcgggcgcgcagggctctgcgcggcaggccgctgccttcctcccgcgcacctgagctggaggcgcacagatgctgagcccgcggggaggggcccaccctacccgcaggttcgccctcccacctgtacccacctgggaccccgaccccggacacgcgagtcccagaaaccctggggctttgagctgagcgctcccatgtacgtatttctaggcacacagccccagttcggaaaagtcctgcccgcgagcacgggactcgggtggtgggggagaggttatcctgcgcaggagtag

SEQ ID NO: 185 - protein, 41 aa, homo sapiens [sequence omitted]

SEQ ID NO: 186 - DNA, 126 bp, homo sapiens
atgctattgacattatgggaaagatttatcaatgagagaaatgtgtctctttttcaggtatgtgcttttgatatagtttacattggaaagggtcataatgctgttttagtttgtgaaaataagtaa

SEQ ID NO: 187 - protein, 6 aa, homo sapiens
MGKIYQ

SEQ ID NO: 188 - DNA, 21 bp, homo sapiens
atgggaaagatttatcaatga

SEQ ID NO: 189 - protein, 14 aa, homo sapiens
MREMCLFFRYVLLI

SEQ ID NO: 190 - DNA, 45 bp, homo sapiens
atgagagaaatgtgtctctttttcaggtatgtgcttttgatatag

SEQ ID NO: 191 - protein, 4 aa, homo sapiens
MLFP

SEQ ID NO: 192 - DNA, 15 bp, homo sapiens
atgcttttcccatga

SEQ ID NO: 193 - protein, 61 aa, homo sapiens [sequence omitted]

SEQ ID NO: 194 - DNA, 186 bp, homo sapiens
atggaactaaagaatgaaggagaaatgggtggacagggcacaaattggggaatgacagcctattcagtgaggataggaaatgcacataaaggacagatgaagatgatttctctgtgtgtgattagaaggatagcaattacaaagataagagtgaaaggagagggaggaaaggggaaaagggaataa

SEQ ID NO: 195 - protein, 13 aa, homo sapiens
MKEKWVDRAQIGE

SEQ ID NO: 196 - DNA, 42 bp, homo sapiens
atgaaggagaaatgggtggacagggcacaaattggggaatga

SEQ ID NO: 197 - protein, 6 aa, homo sapiens
MHIKDR

SEQ ID NO: 198 - DNA, 21 bp, homo sapiens
atgcacataaaggacagatga

SEQ ID NO: 199 - protein, 8 aa, homo sapiens
MLRKSPGC

SEQ ID NO: 200 - DNA, 27 bp, homo sapiens
atgcttagaaaatcaccaggctgttag

SEQ ID NO: 201 - protein, 13 aa, homo sapiens
MPNPGSMMTTGGV

SEQ ID NO: 202 - DNA, 42 bp, homo sapiens
atgcccaatcctggatcgatgatgaccactggtggcgtatga

SEQ ID NO: 203 - protein, 4 aa, homo sapiens
MSHT

SEQ ID NO: 204 - DNA, 15 bp, homo sapiens
atgagtcatacatga

SEQ ID NO: 205 - protein, 8 aa, homo sapiens
MMNMCLEL

SEQ ID NO: 206 - DNA, 27 bp, homo sapiens
atgatgaatatgtgtctggaactctga

SEQ ID NO: 207 - protein, 14 aa, homo sapiens
MHSYVIIMIGSMKE

SEQ ID NO: 208 - DNA, 45 bp, homo sapiens
atgcattcttatgttattattatgattgggtcaatgaaagaatga

SEQ ID NO: 209 - protein, 23 aa, homo sapiens
MMKMEYKAIFSLLSLTNLYQFSE

SEQ ID NO: 210 - DNA, 72 bp, homo sapiens
atgatgaaaatggaatataaagcaatattttctctgttgagtctaactaatctttatcagttttcagaataa

SEQ ID NO: 211 - protein, 16 aa, homo sapiens
MGHLYCVALDLFCSTM

SEQ ID NO: 212 - DNA, 51 bp, homo sapiens
atgggacatttatattgtgtagcgttggatttattttgctcaacaatgtaa

SEQ ID NO: 213 - protein, 8 aa, homo sapiens
MLKGKLRS

SEQ ID NO: 214 - DNA, 27 bp, homo sapiens
atgctcaaaggaaagctaaggtcttga

SEQ ID NO: 215 - protein, 10 aa, homo sapiens
MFYFPGPVWS

SEQ ID NO: 216 - DNA, 33 bp, homo sapiens
atgttctattttccagggccagtctggtcatag

SEQ ID NO: 217 - protein, 5 aa, homo sapiens
MRRAL

SEQ ID NO: 218 - DNA, 18 bp, homo sapiens
atgaggagggcattgtag

SEQ ID NO: 219 - protein, 13 aa, homo sapiens
MRVIDPGCRSPKE

SEQ ID NO: 220 - DNA, 42 bp, homo sapiens; identical to SEQ ID NO: 148

SEQ ID NO: 221 - protein, 24 aa, homo sapiens
MTERKREWWKETIGWEKMKIEKRK

SEQ ID NO: 222 - DNA, 75 bp, homo sapiens; identical to SEQ ID NO: 150

SEQ ID NO: 223 - protein, 17 aa, homo sapiens
MGKNENRKKEVKEIINN

SEQ ID NO: 224 - DNA, 54 bp, homo sapiens; identical to SEQ ID NO: 152

SEQ ID NO: 225 - protein, 14 aa, homo sapiens
MLLLCALSGVSGPQ

SEQ ID NO: 226 - DNA, 45 bp, homo sapiens
atgcttctcctgtgtgccctctctggggtatctggcccacagtag

SEQ ID NO: 227 - protein, 24 aa, homo sapiens
MSRCFALSSCARLLPTSSGSAPRA

SEQ ID NO: 228 - DNA, 75 bp, homo sapiens
atgagcagatgctttgctttgtcctcctgtgccaggctcctccccacatcctctggatcagctccacgtgcctag

SEQ ID NO: 229 - protein, 33 aa, homo sapiens
MLCFVLLCQAPPHILWISSTCLDSDSVIHRGGP

SEQ ID NO: 230 - DNA, 102 bp, homo sapiens
atgctttgctttgtcctcctgtgccaggctcctccccacatcctctggatcagctccacgtgcctagattcagactccgtgattcaccgtgggggcccttaa

SEQ ID NO: 231 - protein, 6 aa, homo sapiens
MSPRIK

SEQ ID NO: 232 - DNA, 21 bp, homo sapiens
atgtctcccaggatcaaatga

SEQ ID NO: 233 - protein, 19 aa, homo sapiens
MGAALRGGRGRRRRRRGGD

SEQ ID NO: 234 - DNA, 60 bp, homo sapiens
atgggggccgccctccgggggggtcggggccgccgccgccgtcgtcgcggcggcgactga

SEQ ID NO: 235 - protein, 46 aa, homo sapiens
MDRRDGSEVGHEASRKKLQRTRTRVPEPGVGGFRNRREVGNGKGVW

SEQ ID NO: 236 - DNA, 141 bp, homo sapiens
atggataggagagatggcagcgaggtggggcatgaagcctccaggaaaaagctccaaaggaccagaacacgggttccggagcctggggttgggggctttaggaatagacgggaagtgggaaacgggaaaggggtgtggtag

SEQ ID NO: 237 - protein, 174 aa, homo sapiens [sequence omitted]

SEQ ID NO: 238 - DNA, 525 bp, homo sapiens
atggcagcgaggtggggcatgaagcctccaggaaaaagctccaaaggaccagaacacgggttccggagcctggggttgggggctttaggaatagacgggaagtgggaaacgggaaaggggtgtggtaggtggaaagagggattgtggctgatgaacctgggggagacggaggcttgggcaaagagaggtccatttttgagaagagccggaggttttccagcgtggaagagggaaggccatgtctttgtgacggttttcattcccctactgcaggtcacctctgaccctgttttccctatcccagacatagttatttcttggagagggcactggggcccagtagtgtgggttatcccaaaactagtgaggaggaaaacaggaacacagaagggggagttgggaagaaaggggttctgggaggatggaaatggagaattgagcaaccttacaggcactccaggcaagttgcgacctccaccctccaccctccaatttccggagcgtccgctgcccctggagctgtga

SEQ ID NO: 239 - protein, 5 aa, homo sapiens
MEMEN

SEQ ID NO: 240 - DNA, 18 bp, homo sapiens
atggaaatggagaattga

SEQ ID NO: 241 - protein, 9 aa, homo sapiens
MREAQGKAP

SEQ ID NO: 242 - DNA, 30 bp, homo sapiens
atgcgggaagctcagggcaaagcgccttga

SEQ ID NO: 243 - protein, 29 aa, homo sapiens
MAPGPQAGKEVSKEEGWRVRRGWQRVRRG

SEQ ID NO: 244 - DNA, 90 bp, homo sapiens
atggctccgggaccccaggcggggaaagaggtgtccaaggaggagggctggagagtaaggcggggatggcagagggtacgcagaggctga

SEQ ID NO: 245 - protein, 32 aa, homo sapiens
MAEGTQRLRSGTSVSRGASLFLRPTWPPFLLG

SEQ ID NO: 246 - DNA, 99 bp, homo sapiens
atggcagagggtacgcagaggctgagaagtgggaccagtgtctcaaggggcgccagcctcttcctccgcccaacatggccaccatttttgttgggatag

SEQ ID NO: 247 - protein, 65 aa, homo sapiens
MATIFVGIALGSCQGNSRAVRESGLWAGGEAENQGSGESGLWGWWSGWGLRPWGVRTLGCYGGWD

SEQ ID NO: 248 - DNA, 198 bp, homo sapiens
atggccaccatttttgttgggatagccttgggctcctgccaggggaacagcagggcagtgagggagtcaggactttgggctggtggggaggccgagaatcaaggctctggggagtcaggactttggggctggtggagtggctggggactgaggccctggggggtcaggaccttgggctgctatggaggctgggactga

SEQ ID NO: 249 - protein, 14 aa, homo sapiens
MPLWQRGAPEAGSN

SEQ ID NO: 250 - DNA, 45 bp, homo sapiens
atgcccctgtggcagcgaggggcaccagaggctgggtctaattag

SEQ ID NO: 251 - protein, 10 aa, homo sapiens
MLHLGVLLSC

SEQ ID NO: 252 - DNA, 33 bp, homo sapiens
atgctgcatctgggggtcttgctgtcttgctaa

SEQ ID NO: 253 - protein, 8 aa, homo sapiens
MISKHPSS

SEQ ID NO: 254 - DNA, 27 bp, homo sapiens
atgatctctaagcatccatccagctga

SEQ ID NO: 255 - protein, 117 aa, homo sapiens
MVLLASRIPCCCSQLGEEGAEGVHRVNILSAQASPRHPSLRQSPWLLHRQCFFLIVWGFDFVIPRAWGSWQGKWFSNNGFEKQSWGRGNVSSGSGRQAEILGRLGADCTWSNGKGCW

SEQ ID NO: 256 - DNA, 354 bp, homo sapiens
atggtcctgttggcttctaggattccttgttgttgtagtcaattgggggaagaaggtgcagagggagtgcacagagttaacatcctatcagcccaagcttcacctcggcacccgagtctcaggcagtctccctggcttctacataggcagtgcttcttcctcattgtgtggggctttgattttgtaattccaagagcctggggctcctggcaaggaaaatggttttcaaataatggtttcgagaaacaaagctggggaagaggcaatgtaagctcaggctctggcaggcaggcagagatcctgggaaggctgggtgctgactgcacatggagcaatgggaagggatgctggtga

SEQ ID NO: 257 - protein, 79 aa, homo sapiens
MGGGSRSPGGQVPVWGGALKQRSFLGTVRPVNSKQAGACWGLPALPAQETRMRPLQVGKPGSGQCSLGLQNAASSRISI

SEQ ID NO: 258 - DNA, 240 bp, homo sapiens
atggggggcgggtcgcgcagccctggagggcaggtgcctgtatggggaggggccctgaaacagaggtcgtttctcggcacagtcagacccgttaattccaagcaggctggggcttgttggggattaccggcactgcccgcccaggagacgcggatgcggcctctacaggttgggaaacccggttctgggcagtgcagtttgggattgcaaaatgctgcaagttccagaatttctatctag

SEQ ID NO: 259 - protein, 17 aa, homo sapiens
MGRGPETEVVSRHSQTR

SEQ ID NO: 260 - DNA, 54 bp, homo sapiens
atggggaggggccctgaaacagaggtcgtttctcggcacagtcagacccgttaa

SEQ ID NO: 261 - protein, 24 aa, homo sapiens
MLQVPEFLSRWGMGTAVLGKRNCY

SEQ ID NO: 262 - DNA, 75 bp, homo sapiens
atgctgcaagttccagaatttctatctaggtggggcatggggactgcggtactggggaaaaggaactgctattga

SEQ ID NO: 263 - protein, 45 aa, homo sapiens
MASGSLWISKSISPLGHPQCVGDKYPTPLKTRNSLEDRRETPREH

SEQ ID NO: 264 - DNA, 138 bp, homo sapiens
atggcttcaggctcactttggatctcaaaatcaatctctccactgggacatccccagtgtgtgggagataagtaccctacccccctgaagaccagaaatagccttgaggacagaagggagactcccagagaacactaa

SEQ ID NO: 265 - protein, 14 aa, homo sapiens
MPLWQRGAPEAGSN

SEQ ID NO: 266 - DNA, 45 bp, homo sapiens; identical to SEQ ID NO: 250

SEQ ID NO: 267 - protein, 10 aa, homo sapiens
MLHLGVLLSC

SEQ ID NO: 268 - DNA, 33 bp, homo sapiens; identical to SEQ ID NO: 252

SEQ ID NO: 269 - protein, 8 aa, homo sapiens
MISKHPSS

SEQ ID NO: 270 - DNA, 27 bp, homo sapiens
atgatctctaagcatccatccagctga

SEQ ID NO: 271 - protein, 117 aa, homo sapiens; identical to SEQ ID NO: 255

SEQ ID NO: 272 - DNA, 354 bp, homo sapiens; identical to SEQ ID NO: 256

SEQ ID NO: 273 - protein, 7 aa, homo sapiens
MLFLQDA

SEQ ID NO: 274 - DNA, 24 bp, homo sapiens
atgctctttctccaagacgcttga

SEQ ID NO: 275 - protein, 41 aa, homo sapiens
MAPAGPIGVVNPGPEGMPKGGQDGQETVAQRGGGEQRLNWK

SEQ ID NO: 276 - DNA, 126 bp, homo sapiens
atggcaccagcagggccgattggagtggtaaaccctgggccggaaggcatgccaaagggtggacaggatggacaggagacagtagcacaacgaggagggggagaacagcggctgaattggaaatga

SEQ ID NO: 277 - protein, 5 aa, homo sapiens
MDRRQ

SEQ ID NO: 278 - DNA, 18 bp, homo sapiens
atggacaggagacagtag

SEQ ID NO: 279 - protein, 10 aa, homo sapiens
MSWEKIIIAS

SEQ ID NO: 280 - DNA, 33 bp, homo sapiens
atgagctgggaaaaaataatcattgcaagctga

SEQ ID NO: 281 - protein, 26 aa, homo sapiens
MSGFSIPVWLDSGQGASSPGPRFPHL

SEQ ID NO: 282 - DNA, 81 bp, homo sapiens
atgtctgggttctctattcccgtctggcttgattctggacaaggggcttcctctccagggcctcggtttccccatctttaa

SEQ ID NO: 283 - protein, 101 aa, homo sapiens [sequence omitted]

SEQ ID NO: 284 - DNA, 306 bp, homo sapiens
atgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggtgagaggcagccctgaagctgagtccagaggtctggggcgtcattgtcccagggcggacccagccccagaccctacaactaaacccaaggccagccgagaagcactaccactggcgggctga

SEQ ID NO: 285 - protein, 54 aa, homo sapiens
MSQLKRLHRSARPSAVQWLSRPSHPPTPIPWMMGEGTTPGVPRSGSWDWDLGTR

SEQ ID NO: 286 - DNA, 165 bp, homo sapiens
atgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggtga

SEQ ID NO: 287 - protein, 8 aa, homo sapiens
MKGTQLEI

SEQ ID NO: 288 - DNA, 27 bp, homo sapiens
atgaaagggacccagttggaaatatag

SEQ ID NO: 289 - protein, 50 aa, homo sapiens
MHRKPKTVYLIVFLSDTFFSAPLFFSILLRPHRSHDHMVISWSSTLTTPS

SEQ ID NO: 290 - DNA, 153 bp, homo sapiens
atgcacagaaaaccaaagaccgtgtatctcattgtatttctttctgacactttcttttcagcccccctctttttttccatccttttgagaccccacagatcacatgatcatatggtcatttcatggtcttcaactcttacgaccccttcatag

SEQ ID NO: 291 - protein, 24 aa, homo sapiens
MIIWSFHGLQLLRPLHSTDFTISF

SEQ ID NO: 292 - DNA, 75 bp, homo sapiens
atgatcatatggtcatttcatggtcttcaactcttacgaccccttcatagtacggacttcaccatttccttttaa

SEQ ID NO: 293 - protein, 23 aa, homo sapiens
MVFNSYDPFIVRTSPFPFNFLVS

SEQ ID NO: 294 - DNA, 72 bp, homo sapiens
atggtcttcaactcttacgaccccttcatagtacggacttcaccatttccttttaatttcctagtgagttaa

SEQ ID NO: 295 - protein, 6 aa, homo sapiens
MKWSLF

SEQ ID NO: 296 - DNA, 21 bp, homo sapiens
atgaaatggagccttttctga

SEQ ID NO: 297 - protein, 77 aa, homo sapiens [sequence omitted]

SEQ ID NO: 298 - DNA, 234 bp, homo sapiens
atggaacggtggcgaggggtttgggggaagatgggaaagcactttccagacctgttgcacgcgcgcaacagctgttcaggtgcggtatgtggggggagggggtctgctaggatgggggacagagtggtcgcttatgctgcagggaaaagggggtgccgggagggggagaagagcagtcttggggactgtgtgcaaggttgtgcgcgaacggggtccgcgggaagcactgcctaa

SEQ ID NO: 299 - protein, 7 aa, homo sapiens
MWGEGVC

SEQ ID NO: 300 - DNA, 24 bp, homo sapiens
atgtggggggagggggtctgctag

SEQ ID NO: 301 - protein, 130 aa, homo sapiens
MLQGKGGAGRGRRAVLGTVCKVVRERGPREALPNGAGRIPKSGWVERRGWDDFDPSSRGWARAAGRPGIEYWEWLGKGVSGEAPQSGSFLGRPILGAFPGPVFVPHRLTLSAPNIRPRAAPPPPAFQMGR

SEQ ID NO: 302 - DNA, 393 bp, homo sapiens
atgctgcagggaaaagggggtgccgggagggggagaagagcagtcttggggactgtgtgcaaggttgtgcgcgaacggggtccgcgggaagcactgcctaatggggcagggagaatcccaaagagtgggtgggtggaacggaggggatgggacgacttcgacccgagttcccggggctgggcgcgggcggctggaagaccgggaatagagtactgggaatggctggggaagggggtctcaggggaggccccgcaaagcgggtctttcttgggtcgtcccatcttaggggcttttcccgggcctgtatttgttccccaccgtttaactctttcagctccgaatattcgtcctcgtgcagcgcccccgcccccagctttccagatgggaaggtaa

SEQ ID NO: 303 - protein, 35 aa, homo sapiens
MGQGESQRVGGWNGGDGTTSTRVPGAGRGRLEDRE

SEQ ID NO: 304 - DNA, 108 bp, homo sapiens
atggggcagggagaatcccaaagagtgggtgggtggaacggaggggatgggacgacttcgacccgagttcccggggctgggcgcgggcggctggaagaccgggaatag

SEQ ID NO: 305 - protein, 29 aa, homo sapiens
MKFFTWGRTGLSEMSFNGGNAKQVKTKTK

SEQ ID NO: 306 - DNA, 90 bp, homo sapiens
atgaaattcttcacctggggaaggacaggtctcagtgagatgagctttaatggaggaaacgccaagcaggttaaaacaaagacaaagtaa

SEQ ID NO: 307 - protein, 30 aa, homo sapiens
MEETPSRLKQRQSKSYWGTKISVELISIYQ

SEQ ID NO: 308 - DNA, 93 bp, homo sapiens
atggaggaaacgccaagcaggttaaaacaaagacaaagtaaatcctactggggtacaaagatttctgtggagttaataagtatatatcagtag

SEQ ID NO: 309 - protein, 72 aa, homo sapiens
MQWLTPVIAALWEAEAGRSLEVRSLRPAWPTWRNPISTKKILSRAWWGTPVIPATRESEAQESIEPRKRRLP

SEQ ID NO: 310 - DNA, 219 bp, homo sapiens
atgcagtggctcacgcctgtaatagcagcactttgggaggctgaagctggcagatcacttgaggtcaggagtttgagaccagcctggccaacatggcgaaaccccatctctaccaaaaaaatacttagccgggcatggtggggcacgcctgtaatcccagctactcgggagtctgaggcacaagagtcgattgaacccaggaagcggaggttgccgtga

SEQ ID NO: 311 - protein, 11 aa, homo sapiens
MAKPHLYQKNT

SEQ ID NO: 312 - DNA, 36 bp, homo sapiens
atggcgaaaccccatctctaccaaaaaaatacttag

SEQ ID NO: 313 - protein, 13 aa, homo sapiens
MPNPGSMMTTGGV

SEQ ID NO: 314 - DNA, 42 bp, homo sapiens; identical to SEQ ID NO: 202

SEQ ID NO: 315 - protein, 4 aa, homo sapiens
MSHT

SEQ ID NO: 316 - DNA, 15 bp, homo sapiens
atgagtcatacatga

SEQ ID NO: 317 - protein, 8 aa, homo sapiens
MMNMCLEL

SEQ ID NO: 318 - DNA, 27 bp, homo sapiens
atgatgaatatgtgtctggaactctga

SEQ ID NO: 319 - protein, 14 aa, homo sapiens
MHSYVIIMIGSMKE

SEQ ID NO: 320 - DNA, 45 bp, homo sapiens; identical to SEQ ID NO: 208

SEQ ID NO: 321 - protein, 64 aa, homo sapiens
MPSRGGDARWGAWGQRRPDRPTPDRARGGHGPGRRRALFLGARGGWGARKSNARREYGPARARS

SEQ ID NO: 322 - DNA, 195 bp, homo sapiens
atgccctcgcggggcggggacgcgcgatggggggcgtggggacagcggcgccccgaccgcccgacacctgaccgcgcgcggggaggccacgggccggggcggcggcgagctttgttcttgggggcgcggggcgggtggggcgctcggaaatcgaatgccagaagagagtacggcccggcgcgcgcgcgttcgtga

SEQ ID NO: 323 - protein, 14 aa, homo sapiens
MGGVGTAAPRPPDT

SEQ ID NO: 324 - DNA, 45 bp, homo sapiens
atggggggcgtggggacagcggcgccccgaccgcccgacacctga

SEQ ID NO: 325 - protein, 135 aa, homo sapiens
MPEESTARRARVREGCSGQVHGRSGLRRPILAGAPLRPGRGLGVLQPRHLRKPWRPARAAPPACHYRQQLQGIYWGQGLRTGTRPPKLAIKRENGPESHCRGALLKLQGAFHGDLPWRAGWGWGGGKDTSLADRD

SEQ ID NO: 326 - DNA, 408 bp, homo sapiens
atgccagaagagagtacggcccggcgcgcgcgcgttcgtgaaggctgctccggccaagttcatgggcgctcgggcctgcggagaccgatcctggcgggggccccgctcaggcctggccgcgggctgggggtgctgcagccgcgccacctccggaagccctggcgccctgcgcgggccgcccctccggcctgtcattaccggcagcagctgcagggtatttactggggccaaggtttgcgaacaggaacccgccctccaaaactggccataaaaagggaaaatggccccgaatcccactgccggggagcccttttaaagctacagggcgcctttcacggcgacctgccctggagggcaggctgggggtgggggggtggaaaagacacctcattggctgatagggactga

SEQ ID NO: 327 - protein, 69 aa, homo sapiens
MGARACGDRSWRGPRSGLAAGWGCCSRATSGSPGALRGPPLRPVITGSSCRVFTGAKVCEQEPALQNWP

SEQ ID NO: 328 - DNA, 210 bp, homo sapiens
atgggcgctcgggcctgcggagaccgatcctggcgggggccccgctcaggcctggccgcgggctgggggtgctgcagccgcgccacctccggaagccctggcgccctgcgcgggccgcccctccggcctgtcattaccggcagcagctgcagggtatttactggggccaaggtttgcgaacaggaacccgccctccaaaactggccataa

SEQ ID NO: 329 - protein, 64 aa, homo sapiens; identical to SEQ ID NO: 321

SEQ ID NO: 330 - DNA, 195 bp, homo sapiens; identical to SEQ ID NO: 322

SEQ ID NO: 331 - protein, 14 aa, homo sapiens
MGGVGTAAPRPPDT

SEQ ID NO: 332 - DNA, 45 bp, homo sapiens; identical to SEQ ID NO: 324

SEQ ID NO: 333 - protein, 135 aa, homo sapiens; identical to SEQ ID NO: 325

SEQ ID NO: 334 - DNA, 408 bp, homo sapiens; identical to SEQ ID NO: 326

SEQ ID NO: 335 - protein, 69 aa, homo sapiens; identical to SEQ ID NO: 327

SEQ ID NO: 336 - DNA, 210 bp, homo sapiens; identical to SEQ ID NO: 328

SEQ ID NO: 337 - protein, 54 aa, homo sapiens
MRLFPNRGRFCLASLVWTPRGAERRLCAQPGAGAGECLGPGAGGRAGRSQSGAQ

SEQ ID NO: 338 - DNA, 165 bp, homo sapiens
atgcggctctttccaaaccggggccgtttttgcctggcttctctggtgtggactccgcgcggagctgagaggcggctgtgcgcccagcctggagccggcgcaggtgagtgtctggggccgggagcgggggggcgggccgggcggagccagagcggggctcagtag

SEQ ID NO: 339 - protein, 146 aa, homo sapiens
MTRQCLLALPRLQAEAPTGRLGPGSASGVCPAPSAVPGRGRGRERLRSECGRCLRGAYPRGVWLGSGCVSPPWWAQAEAPGWEGAAESAGAPELAPPASCQGCAAGSRLLPWPGAAPPSLWGKAALRPPVCLHFAATHPGNPGARE

SEQ ID NO: 340 - DNA, 441 bp, homo sapiens
atgacgcggcagtgcctactcgctcttccgcgccttcaggcggaggcgcccacggggcgcctgggtcccgggtccgccagtggcgtctgcccagcgcccagcgctgttcccgggcgggggcgggggcgggagcggctgcggtccgagtgcggccggtgcttgcgaggtgcctacccgcgaggagtttggctggggtcgggctgcgtttcgccgccctggtgggctcaggcggaagcgccaggctgggagggggctgcggagagcgccggggccccggagctggcccctccagcgtcttgtcagggctgcgcggctggttcgaggctgcttccgtggcccggagccgccccgcccagtctctgggggaaagcggctctcagacctcccgtgtgcctccacttcgcggccactcatcccgggaaccccggcgcacgcgaatga

SEQ ID NO: 341 - protein, 83 aa, homo sapiens
MRHRSPPSTAPFLLIALVAPRFPALPQDRRLDGLPLAPHRSAHPRTMGSEGVTRGQGSPDSTVSSRLSHSFALPTRAPGHRVQ

SEQ ID NO: 342 - DNA, 252 bp, homo sapiens
atgagacaccgttccccgccctcaactgccccattcctgttaatagcgctagtggcacccaggttcccagcccttccccaagatcggcggctggacggcttgcctctggcgcctcaccggtcagcgcatcccaggactatgggcagtgagggtgtcacccggggtcaggggtcgcccgattccacggtgtcctccaggctgagccattcgtttgctcttccaacccgggctcccggacaccgtgtacagtaa

SEQ ID NO: 343 - protein, 8 aa, homo sapiens
MGTESADL

SEQ ID NO: 344 - DNA, 27 bp, homo sapiens
atgggcaccgagtcggcggatctctga

SEQ ID NO: 345 - protein, 54 aa, homo sapiens; identical to SEQ ID NO: 337

SEQ ID NO: 346 - DNA, 165 bp, homo sapiens; identical to SEQ ID NO: 338

SEQ ID NO: 347 - protein, 146 aa, homo sapiens; identical to SEQ ID NO: 339

SEQ ID NO: 348 - DNA, 441 bp, homo sapiens; identical to SEQ ID NO: 340

SEQ ID NO: 349 - protein, 83 aa, homo sapiens; identical to SEQ ID NO: 341

SEQ ID NO: 350 - DNA, 252 bp, homo sapiens; identical to SEQ ID NO: 342

SEQ ID NO: 351 - protein, 8 aa, homo sapiens
MGTESADL

SEQ ID NO: 352 - DNA, 27 bp, homo sapiens
atgggcaccgagtcggcggatctctga

SEQ ID NO: 353 - protein, 11 aa, homo sapiens
MVGLQRCLILV

SEQ ID NO: 354 - DNA, 36 bp, homo sapiens
atggtgggattacaaaggtgcttaattttggtttga

SEQ ID NO: 355 - protein, 9 aa, homo sapiens
MNAAQHILC

SEQ ID NO: 356 - DNA, 30 bp, homo sapiens
atgaatgctgctcagcatattttatgttaa

SEQ ID NO: 357 - protein, 22 aa, homo sapiens
MLLSIFYVKNLFLCLKIFRKGK

SEQ ID NO: 358 - DNA, 69 bp, homo sapiens
atgctgctcagcatattttatgttaaaaatttgtttttatgtttaaaaatttttagaaaaggtaaataa

SEQ ID NO: 359 - protein, 8 aa, homo sapiens
MLKICFYV

SEQ ID NO: 360 - DNA, 27 bp, homo sapiens
atgttaaaaatttgtttttatgtttaa

SEQ ID NO: 361 - protein, 26 aa, homo sapiens
MKKGRKPTCASDSRWRNDCGFRCIHR

SEQ ID NO: 362 - DNA, 81 bp, homo sapiens; identical to SEQ ID NO: 90

SEQ ID NO: 363 - protein, 12 aa, homo sapiens
MIVVFVASTADS

SEQ ID NO: 364 - DNA, 39 bp, homo sapiens; identical to SEQ ID NO: 92

SEQ ID NO: 365 - protein, 57 aa, homo sapiens; identical to SEQ ID NO: 93

SEQ ID NO: 366 - DNA, 174 bp, homo sapiens; identical to SEQ ID NO: 94

SEQ ID NO: 367 - protein, 26 aa, homo sapiens
MLNSILIVRLKLRHHFILQSAVGLWP

SEQ ID NO: 368 - DNA, 81 bp, homo sapiens; identical to SEQ ID NO: 96

SEQ ID NO: 369 - protein, 24 aa, homo sapiens
MAPFYNPVCHLLFLTYHSTQNFMV

SEQ ID NO: 370 - DNA, 75 bp, homo sapiens
atggccccattctataatcctgtgtgtcatctactttttctcacttatcactctacccaaaatttcatggtataa

SEQ ID NO: 371 - protein, 9 aa, homo sapiens
MIQVVKVYP

SEQ ID NO: 372 - DNA, 30 bp, homo sapiens
atgatccaggtggtaaaggtttatccctaa

SEQ ID NO: 373 - protein, 20 aa, homo sapiens
MSPKSPYLSDQSRNHSDHFG

SEQ ID NO: 374 - DNA, 63 bp, homo sapiens
atgagccctaagtccccatatctttctgaccagtctagaaatcattctgatcattttggttaa

SEQ ID NO: 375 - protein, 23 aa, homo sapiens
MKLTPFLEQKTFLLAYQSHLKKE

SEQ ID NO: 376 - DNA, 72 bp, homo sapiens
atgaaacttaccccattccttgagcagaaaaccttcctcctcgcctaccagagccacctaaagaaagaatga

SEQ ID NO: 377 - protein, 10 aa, homo sapiens
MCPDLLTPRS

SEQ ID NO: 378 - DNA, 33 bp, homo sapiens
atgtgccctgacctcttgaccccacggtcctga

SEQ ID NO: 379 - protein, 14 aa, homo sapiens
MCMSTTASVRQYQC

SEQ ID NO: 380 - DNA, 45 bp, homo sapiens
atgtgtatgtcaacaaccgcgtcagtacgtcagtaccagtgttga

SEQ ID NO: 381 - protein, 6 aa, homo sapiens
MGQVGV

SEQ ID NO: 382 - DNA, 21 bp, homo sapiens
atgggccaagtgggtgtctag

SEQ ID NO: 383 - protein, 64 aa, homo sapiens
MAPTYISHRPPRLSVPAWREALEERWGDLASSREEAKGDAREAKRCKVRGLRLGTVRSPDSQLS

SEQ ID NO: 384 - DNA, 195 bp, homo sapiens
atggcccccacctacatctcccaccgacccccccggctcagtgtccctgcctggagggaggccctggaggaaaggtggggagatctggcttcaagccgggaggaggccaagggagatgctagggaggccaagaggtgtaaggtcagaggcttgaggctgggaacggtgaggagccctgactcacagctcagctga

SEQ ID NO: 385 - protein, 75 aa, homo sapiens
MGTLRSRWPAGTRVPPDLRVLWRGNFPERVPEFPERWFLDCSLEGELCRPCALPVFLSTKQTRLFNWWVLLFQSW

SEQ ID NO: 386 - DNA, 228 bp, homo sapiens
atggggacactaaggtccaggtggcccgcggggactcgggtcccgcccgatttgcgagtgttatggcggggcaactttccagagagggtgcctgagtttcccgaacggtggtttctggattgttctttggaaggtgaattatgcaggccatgcgcactgcctgtcttcctgtctacaaagcaaaccagattgttcaactggtgggtgcttcttttccagtcctggtga

SEQ ID NO: 387 - protein, 10 aa, homo sapiens
MAGQLSREGA

SEQ ID NO: 388 - DNA, 33 bp, homo sapiens
atggcggggcaactttccagagagggtgcctga

SEQ ID NO: 389 - protein, 30 aa, homo sapiens
MQAMRTACLPVYKANQIVQLVGASFPVLVN

SEQ ID NO: 390 - DNA, 93 bp, homo sapiens
atgcaggccatgcgcactgcctgtcttcctgtctacaaagcaaaccagattgttcaactggtgggtgcttcttttccagtcctggtgaactga

SEQ ID NO: 391 - protein, 9 aa, homo sapiens
MTLPTSSLG

SEQ ID NO: 392 - DNA, 30 bp, homo sapiens
atgacactccccacatcatctctaggataa

SEQ ID NO: 393 - protein, 49 aa, homo sapiens
MGTGEGRWRRGSARFSRDSARDACLGCDCRRCRHPGSPSDPSPAPQRGV

SEQ ID NO: 394 - DNA, 150 bp, homo sapiens
atgggaacgggagaggggaggtggcggcgggggagcgcgcggttctctcgggactcggcgcgagacgcttgtctgggctgcgattgccgccgctgccgccaccccggctccccctcggacccctcccccgctccccagaggggcgtgtga

SEQ ID NO: 395 - protein, 77 aa, homo sapiens
MPRAEQAGRARRSTCARAPLAWAAAPAGAGPRGSRTSREPPSPESYRRPLKLSAPSPREAGSPGALALASAGRGQKN

SEQ ID NO: 396 - DNA, 234 bp, homo sapiens
atgccgcgcgcggagcaggccggccgcgcccgccgctccacgtgcgcccgagccccgctggcatgggcggcggcgcctgcgggggccgggccccggggatcccggactagccgggaaccaccgtccccagagagttaccgccgccccctaaagttgtcagctccctccccccgagaagcaggcagccctggcgcgttggctttagcttctgcaggacgggggcaaaaaaactag

SEQ ID NO: 397 - protein, 15 aa, homo sapiens
MGGGACGGRAPGIPD

SEQ ID NO: 398 - DNA, 48 bp, homo sapiens
atgggcggcggcgcctgcgggggccgggccccggggatcccggactag

SEQ ID NO: 399 - protein, 13 aa, homo sapiens
MRRLCPLRTHPYL

SEQ ID NO: 400 - DNA, 42 bp, homo sapiens
atgcgccgcttatgtcctctgaggacacatccatatttataa

SEQ ID NO: 401 - protein, 30 aa, homo sapiens
MPGLDGVGTGHLECCKFSVSSFNFFFSIFF

SEQ ID NO: 402 - DNA, 93 bp, homo sapiens
atgcctggcttggatggcgttggaacagggcatttggaatgttgtaagttttctgtttcctcttttaattttttcttttccatttttttctag

SEQ ID NO: 403 - protein, 27 aa, homo sapiens
MALEQGIWNVVSFLFPLLIFSFPFFSS

SEQ ID NO: 404 - DNA, 84 bp, homo sapiens
atggcgttggaacagggcatttggaatgttgtaagttttctgtttcctcttttaattttttcttttccatttttttctagttaa

SEQ ID NO: 405 - protein, 30 aa, homo sapiens
MSGWEISVCVARGFLLKGNVALVGFHCNFG

SEQ ID NO: 406 - DNA, 93 bp, homo sapiens
atgagtggttgggaaatttctgtgtgcgtggcaagaggttttctcctgaaagggaatgtggctttggttggatttcactgtaattttggttga

SEQ ID NO: 407 - protein, 66 aa, homo sapiens
MWLWLDFTVILVERKPSQSSSSGFKIHFCCRSWGPSGSFSDTWGKNVEETGAGEEKLRGTTFPEKL

SEQ ID NO: 408 - DNA, 201 bp, homo sapiens
atgtggctttggttggatttcactgtaattttggttgagagaaagcccagccagagttcaagctcagggttcaagattcatttctgctgtaggagctgggggccttcgggatctttctctgatacttggggaaagaatgtggaggaaacgggagcaggggaggaaaagctgaggggaacgacttttcctgaaaagttgtag

SEQ ID NO: 409 - protein, 8 aa, homo sapiens
MGDLAPQN

SEQ ID NO: 410 - DNA, 27 bp, homo sapiens
atgggagacttggcaccacaaaattag

SEQ ID NO: 411 - protein, 38 aa, homo sapiens
MAFYYKQVKEERHLLWLGSESVPTHKFPLCKGLALIAS

SEQ ID NO: 412 - DNA, 117 bp, homo sapiens
atggcattttattataagcaagtgaaggaggagagacatctgttgtggctgggttctgaatctgttccaactcataagttccctctgtgtaagggcttggcactgatagccagctag

SEQ ID NO: 413 - protein, 32 aa, homo sapiens
MQPALCVWAALWTSLVTLLPDHSSRLCIEREG

SEQ ID NO: 414 - DNA, 99 bp, homo sapiens
atgcagccagctctctgtgtctgggccgcactatggacttcactagtaacccttttgccagatcacagtagtagactttgtatagaaagagaaggttga

SEQ ID NO: 415 - protein, 12 aa, homo sapiens
MDFTSNPFARSQ

SEQ ID NO: 416 - DNA, 39 bp, homo sapiens
atggacttcactagtaacccttttgccagatcacagtag

SEQ ID NO: 417 - protein, 25 aa, homo sapiens
MPQARACSMRHHQPRGLLNAGRCCI

SEQ ID NO: 418 - DNA, 78 bp, homo sapiens
atgccccaggccagagcgtgtagcatgcgccaccaccagccccgggggcttctcaatgctggtcgctgctgtatatga

SEQ ID NO: 419 - protein, 48 aa, homo sapiens
MLVAAVYEPICRPFPVRHSVPATLPSMMLPEYPTWVPTPGPSDDRATA

SEQ ID NO: 420 - DNA, 147 bp, homo sapiens
atgctggtcgctgctgtatatgagcccatctgccggcccttccccgtccgtcactctgtcccagccacgctgccctccatgatgctccctgagtatcccacctgggttcctaccccagggccttcggacgaccgggctactgcctga

SEQ ID NO: 421 - protein, 20 aa, homo sapiens
MSPSAGPSPSVTLSQPRCPP

SEQ ID NO: 422 - DNA, 63 bp, homo sapiens
atgagcccatctgccggcccttccccgtccgtcactctgtcccagccacgctgccctccatga

SEQ ID NO: 423 - protein, 30 aa, homo sapiens
MAPSCPNSTRTLPTSILLFPHTTRHVSCAC

SEQ ID NO: 424 - DNA, 93 bp, homo sapiens
atggctccctcctgccctaactctacccgcaccctccccacctccatcctccttttccctcacacaacacgtcacgtatcctgcgcttgttga

SEQ ID NO: 425 - protein, 56 aa, homo sapiens
MWPQPRLPPRPAMSEETRQSKLAAAKKKVKCTGSRPPDPAPAPLRWQDHGQSLCHS

SEQ ID NO: 426 - DNA, 171 bp, homo sapiens
atgtggccccaaccccgcctccctccccgccccgcgatgtcggaagaaacccgacagagcaaattggccgcagcgaagaaaaaggtaaagtgcaccgggtcgcggccccccgacccagccccagccccactccgatggcaggaccatggccagagtctctgccactcctga

SEQ ID NO: 427 - protein, 50 aa, homo sapiens
MAGPWPESLPLLRHTGLGSPRRVRAPSTKVLSASPAPSAAQPPPSPVAPG

SEQ ID NO: 428 - DNA, 153 bp, homo sapiens
atggcaggaccatggccagagtctctgccactcctgaggcacaccgggctgggctccccacggcgcgtccgggctccctccaccaaagtcttgtcagccagccccgccccctcagccgcccagcccccgccctcgccagtcgcccccgggtga

SEQ ID NO: 429 - protein, 99 aa, homo sapiens
MARVSATPEAHRAGLPTARPGSLHQSLVSQPRPLSRPAPALASRPRVTLGWCSRGSPLQTRPSPPAPRSPTSLGSLGWRLQGPRTPAIQPLPSPVTLGP

SEQ ID NO: 430 - DNA, 300 bp, homo sapiens
atggccagagtctctgccactcctgaggcacaccgggctgggctccccacggcgcgtccgggctccctccaccaaagtcttgtcagccagccccgccccctcagccgcccagcccccgccctcgccagtcgcccccgggtgactttgggctggtgctcccggggctccccgctccagactcggccctcacctcctgccccccgaagtccgacctccctgggctctttgggctggcgtctccaaggacctaggaccccagcaattcagcccctgccctcgccagtgactttgggcccgtga

SEQ ID NO: 431 - protein, 143 aa, homo sapiens [sequence omitted]

SEQ ID NO: 432 - DNA, 432 bp, homo sapiens
atgttccccctaggagtggaatgtagtgacgtcacaatccccctcggaaccgtaattagttgcgcgagaccagtctttgatcttaggacccagtcccctaagtgttctcatcccgcttctggttcctctggtcacagcataaatttccagctggaaggggattggggactatgggacctaggagggagaggtttcaggctgccttacacccttaacatagacattgacagtgtgaaaagcctacacttcacccgtgaactgaaaacattggcagtatctctgggtggcaatgtgagaacgggattggtttggttttcccccaggcttctactctccagagagactttaacatttttttctgacttctccacctcatattcgaattctccatggttctgggaccagagtgcccttcagtggtctctggaatga

SEQ ID NO: 433 - protein, 26 aa, homo sapiens
MKKGRKPTCASDSRWRNDCGFRCIHR

SEQ ID NO: 434 - DNA, 81 bp, homo sapiens; identical to SEQ ID NO: 90

SEQ ID NO: 435 - protein, 12 aa, homo sapiens
MIVVFVASTADS

SEQ ID NO: 436 - DNA, 39 bp, homo sapiens; identical to SEQ ID NO: 92

SEQ ID NO: 437 - protein, 57 aa, homo sapiens; identical to SEQ ID NO: 93

SEQ ID NO: 438 - DNA, 174 bp, homo sapiens; identical to SEQ ID NO: 94

SEQ ID NO: 439 - protein, 26 aa, homo sapiens
MLNSILIVRLKLRHHFILQSAVGLWP

SEQ ID NO: 440 - DNA, 81 bp, homo sapiens; identical to SEQ ID NO: 96

SEQ ID NO: 441 - protein, 87 aa, homo sapiens
MGCRQPGQRPGELRSLQTQAGAGPSPPQGKVGPCADAAGFRVWSHLGPTGCVFRARAQCVGSRHGVPSGQGLGRGQAPRGVTFLPPT

SEQ ID NO: 442 - DNA, 264 bp, homo sapiens
atgggctgtcgccagcctggccagcgtccaggggagctccggtcactgcagacacaggctggagcgggtccttcccccccccagggaaaggtgggcccctgcgcagatgcggctgggtttcgggtgtggagccatcttggacccacgggctgcgtcttccgggcacgggcacagtgtgtgggctccaggcatggggtgccctcagggcagggcctgggcagagggcaggctccgagaggggtcacgttcttgccgcctacctga

SEQ ID NO: 443 - protein, 85 aa, homo sapiens [sequence omitted]

SEQ ID NO: 444 - DNA, 258 bp, homo sapiens
atgcggctgggtttcgggtgtggagccatcttggacccacgggctgcgtcttccgggcacgggcacagtgtgtgggctccaggcatggggtgccctcagggcagggcctgggcagagggcaggctccgagaggggtcacgttcttgccgcctacctgacagcaggccttctagaaagttctctccagaagcagccaccgccgtcctgaggcactttgtgcggagacgggaagctgtcgcctcagaggtgggtgcgtag

SEQ ID NO: 445 - protein, 96 aa, homo sapiens
MTASPLGSGVCGGKGLVSAPSGQRPAEPMGGEVGAWGRGWSGTGGAQPGEAGAGSQAPRYDWGGGNVSREVFYLNVKRLSTVAAAGNKVRPTEAQP

SEQ ID NO: 446 - DNA, 291 bp, homo sapiens
atgaccgcgtctcccttgggctctggagtctgcggtgggaagggcttggtttcagcaccctctggtcagaggccggccgagcccatgggcggtgaggttggtgcctggggtcgtggctggtctggtacaggtggggctcagcccggagaagctggagccggttcccaggccccgcgctatgactggggtgggggcaacgtctctcgtgaggttttttacttaaatgtgaaacggctcagtacggtggccgcagccgggaacaaggtccgacccaccgaggcccagccttga

SEQ ID NO: 447 - protein, 14 aa, homo sapiens
MTGVGATSLVRFFT

SEQ ID NO: 448 - DNA, 45 bp, homo sapiens
atgactggggtgggggcaacgtctctcgtgaggttttttacttaa

SEQ ID NO: 449 - protein, 87 aa, homo sapiens; identical to SEQ ID NO: 441

SEQ ID NO: 450 - DNA, 264 bp, homo sapiens; identical to SEQ ID NO: 442

SEQ ID NO: 451 - protein, 85 aa, homo sapiens [sequence omitted]

SEQ ID NO: 452 - DNA, 258 bp, homo sapiens; identical to SEQ ID NO: 444

SEQ ID NO: 453 - protein, 96 aa, homo sapiens; identical to SEQ ID NO: 445

SEQ ID NO: 454 - DNA, 291 bp, homo sapiens; identical to SEQ ID NO: 446

SEQ ID NO: 455 - protein, 14 aa, homo sapiens
MTGVGATSLVRFFT

SEQ ID NO: 456 - DNA, 45 bp, homo sapiens; identical to SEQ ID NO: 448

SEQ ID NO: 457 - protein, 19 aa, homo sapiens
MGAALRGGRGRRRRRRGGD

SEQ ID NO: 458 - DNA, 60 bp, homo sapiens; identical to SEQ ID NO: 234

SEQ ID NO: 459 - protein, 46 aa, homo sapiens; identical to SEQ ID NO: 235

SEQ ID NO: 460 - DNA, 141 bp, homo sapiens; identical to SEQ ID NO: 236

SEQ ID NO: 461 - protein, 174 aa, homo sapiens [sequence omitted]

SEQ ID NO: 462 - DNA, 525 bp, homo sapiens; identical to SEQ ID NO: 238

SEQ ID NO: 463 - protein, 5 aa, homo sapiens
MEMEN

SEQ ID NO: 464 - DNA, 18 bp, homo sapiens
atggaaatggagaattga

SEQ ID NO: 465 - protein, 90 aa, homo sapiens
MRARGCGGMGVGAAEPQRCLCPQARCPWPRRSRPWWRTCCTCWWAWTGGTSVLSPWLGGRAGPSSWTPTWTCPSGSWCTGSSQWPPATPL

SEQ ID NO: 466 - DNA, 273 bp, homo sapiens
atgagggcacgtggctgtgggggcatgggagtgggggctgcagagccacagcgctgtctgtgcccgcaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtga

SEQ ID NO: 467 - protein, 61 aa, homo sapiens
MTMGTSASLLKRAPALVTTPCPTQFWRVCESPSRVLTHLLLGQKFPSGMWGSSESFASCLG

SEQ ID NO: 468 - DNA, 186 bp, homo sapiens
atgaccatggggacgtctgcatcgcttctaaagagagcgcccgccttggtgacaactccgtgcccaactcagttttggagggtctgtgagtcaccatccagggtcctgactcatctcctcctggggcaaaagttcccctctgggatgtggggttcaagtgagtcatttgcttcctgtttgggatga

SEQ ID NO: 469 - protein, 16 aa, homo sapiens
MRLRISDIVCACSLPF

SEQ ID NO: 470 - DNA, 51 bp, homo sapiens
atgagactcagaatatcggacattgtatgtgcctgcagcttgcctttttga

SEQ ID NO: 471 - protein, 99 aa, homo sapiens [sequence omitted]

SEQ ID NO: 472 - DNA, 300 bp, homo sapiens
atgtgcctgcagcttgcctttttgaggaagtctgacagcttttcttccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcggtgcgtgcccgcccggggggcatggggcagtggtgggtggcaggtgttga

SEQ ID NO: 473 - protein, 149 aa, homo sapiens
MARAVGPERRLLAVYTGGTIGMRSELGGESETLGGVGLWTWPRPGASDPPAPTGVVGESNPRLDGGCGLRSLSSGSGHRRPHAWSPDLDRGDCGGFSPSRCSRERPATLGPGPLCCRCAPEGQRPEVLEYGAGGPQGIGLPLLLWTQKA

SEQ ID NO: 474 - DNA, 450 bp, homo sapiens
atggcgcgcgcggtggggcccgagcggaggctgctggccgtctacaccggcggcaccattggcatgcggagtgagctcggcggtgagtccgagaccctgggcggggtaggcctctggacctggccgcgaccgggagcctcggaccctcctgcacccacgggggtcgttggggagtcaaatccgcgcctggatggggggtgcgggctgaggtcgctctcctccggttccggccaccggcgtccccacgcatggagccccgacctggacagaggagattgcggtgggttctcgccgtcgcggtgctcccgggagcgccctgcgaccctggggccaggccccctgtgctgccgctgcgcccctgagggccagcgtcctgaagtcctggaatatggggcgggagggccccagggcattggcctgccgctcctgctctggacacagaaggcttag

SEQ ID NO: 475 - protein, 5 aa, homo sapiens
MGGAG

SEQ ID NO: 476 - DNA, 18 bp, homo sapiens
atggggggtgcgggctga

SEQ ID NO: 477 - protein, 37 aa, homo sapiens
MEPRPGQRRLRWVLAVAVLPGAPCDPGARPPVLPLRP

SEQ ID NO: 478 - DNA, 114 bp, homo sapiens
atggagccccgacctggacagaggagattgcggtgggttctcgccgtcgcggtgctcccgggagcgccctgcgaccctggggccaggccccctgtgctgccgctgcgcccctga

SEQ ID NO: 479 - protein, 88 aa, homo sapiens
MGREGPRALACRSCSGHRRLRRLPWRRLRRLRGPLNCDTQEGVPVPWGPGQAAVVGTILGLPGICGDARVHTRGGLRALLPLPLCGPG

SEQ ID NO: 480 - DNA, 267 bp, homo sapiens
atggggcgggagggccccagggcattggcctgccgctcctgctctggacacagaaggcttaggaggctgccctggagaaggcttaggaggctgcgaggacccctcaactgcgacacccaggagggtgtccccgtcccctggggtcctggtcaggcagcagtggttggcacgatactggggctacctggcatctgcggggacgcacgtgttcacacccgaggtggcctcagagccctgcttcctctgcccctgtgtggacctggttga

SEQ ID NO: 481 - protein, 61 aa, homo sapiens [sequence omitted]

SEQ ID NO: 482 - DNA, 186 bp, homo sapiens; identical to SEQ ID NO: 194

SEQ ID NO: 483 - protein, 13 aa, homo sapiens
MKEKWVDRAQIGE

SEQ ID NO: 484 - DNA, 42 bp, homo sapiens; identical to SEQ ID NO: 196

SEQ ID NO: 485 - protein, 6 aa, homo sapiens
MHIKDR

SEQ ID NO: 486 - DNA, 21 bp, homo sapiens
atgcacataaaggacagatga

SEQ ID NO: 487 - protein, 8 aa, homo sapiens
MLRKSPGC

SEQ ID NO: 488 - DNA, 27 bp, homo sapiens
atgcttagaaaatcaccaggctgttag

SEQ ID NO: 489 - protein, 26 aa, homo sapiens
MKKGRKPTCASDSRWRNDCGFRCIHR

SEQ ID NO: 490 - DNA, 81 bp, homo sapiens; identical to SEQ ID NO: 90

SEQ ID NO: 491 - protein, 12 aa, homo sapiens
MIVVFVASTADS

SEQ ID NO: 492 - DNA, 39 bp, homo sapiens; identical to SEQ ID NO: 92

SEQ ID NO: 493 - protein, 57 aa, homo sapiens; identical to SEQ ID NO: 93

SEQ ID NO: 494 - DNA, 174 bp, homo sapiens; identical to SEQ ID NO: 94

SEQ ID NO: 495 - protein, 26 aa, homo sapiens
MLNSILIVRLKLRHHFILQSAVGLWP

SEQ ID NO: 496 - DNA, 81 bp, homo sapiens; identical to SEQ ID NO: 96

SEQ ID NO: 497 - protein, 25 aa, homo sapiens
MLVGEILVFKGLLDGVNFLFFFFFF

SEQ ID NO: 498 - DNA, 78 bp, homo sapiens
atgttggtgggagagattttggtttttaaggggttgttagatggagtaaattttctttttttttttttttttttttaa

SEQ ID NO: 499 - protein, 89 aa, homo sapiens
MCLFLWATVPCFQCCPRHRSISAEAISGVPGGSTAEASPQKRNGHTTGKTLIRFLLPSGKFRAEITFTALTHIFRQISEVGLPVFLDRS

SEQ ID NO: 500 - DNA, 270 bp, homo sapiens
atgtgtctttttctttgggctactgtaccctgcttccagtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttga

SEQ ID NO: 501 - protein, 8 aa, homo sapiens
MGTPQVRL

SEQ ID NO: 502 - DNA, 27 bp, homo sapiens
atgggcacaccacaggtaagactttaa

SEQ ID NO: 503 - protein, 36 aa, homo sapiens
MLYWEICLCLRLESVTSVHLLLKTRVEPMESNGSVT

SEQ ID NO: 504 - DNA, 111 bp, homo sapiens
atgctctactgggaaatttgtctttgtcttagactagaaagtgtaacttctgtacatcttctcctaaaaacaagggtagagccaatggaaagtaatggttctgttacatag

SEQ ID NO: 505 - protein, 41 aa, homo sapiens [sequence omitted]

SEQ ID NO: 506 - DNA, 126 bp, homo sapiens
atgagggtcgggcggggagggaggcggaggcggaggcggggttccgcggagctgagaaccggacggggtgggatcgaggagggtgcgaagcgccactgtttaggtttcgctttcccgggagcctga

SEQ ID NO: 507 - protein, 12 aa, homo sapiens
MCARRPHLQSHL

SEQ ID NO: 508 - DNA, 39 bp, homo sapiens
atgtgtgcgcgccggccacacctgcagtcacacctgtag

SEQ ID NO: 509 - protein, 7 aa, homo sapiens
MALAPER

SEQ ID NO: 510 - DNA, 24 bp, homo sapiens
atggccttggctcctgagaggtaa

SEQ ID NO: 511 - protein, 148 aa, homo sapiens [sequence omitted]

SEQ ID NO: 512 - DNA, 447 bp, homo sapiens
atgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtga

SEQ ID NO: 513 - protein, 106 aa, homo sapiens; identical to SEQ ID NO: 177

SEQ ID NO: 514 - DNA, 321 bp, homo sapiens; identical to SEQ ID NO: 178

SEQ ID NO: 515 - protein, 38 aa, homo sapiens; identical to SEQ ID NO: 179

SEQ ID NO: 516 - DNA, 117 bp, homo sapiens; identical to SEQ ID NO: 180

SEQ ID NO: 517 - protein, 45 aa, homo sapiens; identical to SEQ ID NO: 181

SEQ ID NO: 518 - DNA, 138 bp, homo sapiens; identical to SEQ ID NO: 182

SEQ ID NO: 519 - protein, 244 aa, homo sapiens [sequence omitted]

SEQ ID NO: 520 - DNA, 735 bp, homo sapiens; identical to SEQ ID NO: 184

SEQ ID NO: 521 - protein, 42 aa, homo sapiens
MSNYTILGQYCVFLVLCFLRSPTYWNFDYLDIFVFKRGGEFA

SEQ ID NO: 522 - DNA, 129 bp, homo sapiens
atgtctaattatacaatccttggacaatactgtgtttttttggtgctgtgttttttaagaagtcctacttactggaattttgactatttggatatttttgtttttaaaaggggaggggaatttgcttaa

SEQ ID NO: 523 - protein, 18 aa, homo sapiens
MNLPFLPFLKYYFVTILH

SEQ ID NO: 524 - DNA, 57 bp, homo sapiens
atgaatttgccttttctgccttttcttaagtactattttgtaactatattgcactaa

SEQ ID NO: 525 - protein, 12 aa, homo sapiens
MRHLNRFLLFHI

SEQ ID NO: 526 - DNA, 39 bp, homo sapiens
atgagacatttaaataggttcctgttgtttcacatataa

SEQ ID NO: 527 - protein, 15 aa, homo sapiens
MIIFFFMDKVMVLIY

SEQ ID NO: 528 - DNA, 48 bp, homo sapiens
atgataattttctttttcatggacaaggttatggtacttatctactaa

SEQ ID NO: 529 - protein, 89 aa, homo sapiens [sequence omitted]

SEQ ID NO: 530 - DNA, 270 bp, homo sapiens
atgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtga

SEQ ID NO: 531 - protein, 41 aa, homo sapiens
MVTLALGPSRAGSLTEAGAVRMRGQRDHSVGHCLTMLHLEG

SEQ ID NO: 532 - DNA, 126 bp, homo sapiens
atggttactttggcattagggccttcaagggctggcagtcttacagaggctggagcggtgagaatgagaggccagagggaccatagtgttgggcactgtctgaccatgttgcatttggaaggctaa

SEQ ID NO: 533 - protein, 9 aa, homo sapiens
MKKAGRDRG

SEQ ID NO: 534 - DNA, 30 bp, homo sapiens
atgaagaaggctggaagggacagggggtga

SEQ ID NO: 535 - protein, 157 aa, homo sapiens [sequence omitted]

SEQ ID NO: 536 - DNA, 474 bp, homo sapiens
atggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccacatgcagtctttgtctttttggggggaatggggccccttgtcttctccacacccggggcccctaagcagcagtgtcgggccacgccccctcggtgggaggtcggcctgcgctggtggccgcagatggcctaa

SEQ ID NO: 537 - protein, 48 aa, homo sapiens
MPARSQAPCLPKAPHSPPSSPHSGPEQWDFYYLHFPDEETEAENKEVI

SEQ ID NO: 538 - DNA, 147 bp, homo sapiens
atgcctgcccggagccaggcaccttgcctgcccaaagcacctcactccccgccatctagtcctcacagcggccctgagcagtgggacttctactacctccattttccagatgaggaaacagaggctgagaacaaggaagtcatttga

SEQ ID NO: 539 - protein, 13 aa, homo sapiens
MRKQRLRTRKSFD

SEQ ID NO: 540 - DNA, 42 bp, homo sapiens
atgaggaaacagaggctgagaacaaggaagtcatttgattaa

SEQ ID NO: 541 - protein, 23 aa, homo sapiens
MQPSAVAHAYNPSTLGSRDGRIT

SEQ ID NO: 542 - DNA, 72 bp, homo sapiens
atgcagccgagcgcagtggctcatgcctataatcccagcactttgggaagccgagacgggcggatcacctga

SEQ ID NO: 543 - protein, 24 aa, homo sapiens
MPIIPALWEAETGGSPEVGSSRLA

SEQ ID NO: 544 - DNA, 75 bp, homo sapiens
atgcctataatcccagcactttgggaagccgagacgggcggatcacctgaagtcgggagttcaagactagcctga

SEQ ID NO: 545 - protein, 13 aa, homo sapiens
MLFFPPFPKVVFP

SEQ ID NO: 546 - DNA, 42 bp, homo sapiens
atgctgttctttccgccattcccaaaagttgttttcccttaa

SEQ ID NO: 547 - protein, 22 aa, homo sapiens
MKTFHQGECSLTTFSLNDRNIK

SEQ ID NO: 548 - DNA, 69 bp, homo sapiens
atgaagactttccatcaaggtgagtgttctctcaccaccttttcacttaatgatagaaacataaaatga

SEQ ID NO: 549 - protein, 4 aa, homo sapiens
MIET

SEQ ID NO: 550 - DNA, 15 bp, homo sapiens
atgatagaaacataa

SEQ ID NO: 551 - protein, 22 aa, homo sapiens
MSSDNVEKLDAFYKLQLLVFFT

SEQ ID NO: 552 - DNA, 69 bp, homo sapiens
atgagttctgataatgttgaaaaactagatgcattttacaagctacaactacttgtttttttcacctaa

SEQ ID NO: 553 - protein, 113 aa, homo sapiens [sequence omitted]

SEQ ID NO: 554 - DNA, 342 bp, homo sapiens
atgggtgccctggcgccagttgtctctcctgtgggcctgcgccggggtccccaccccgatcccaacgcctgggcctctccttctcctgtccccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaagtaggtaccagctgagagcgctgggggggaggggtctggattcctggatctctgctggggacgtggcttag

SEQ ID NO: 555 - protein, 5 aa, homo sapiens
MKGRV

SEQ ID NO: 556 - DNA, 18 bp, homo sapiens
atgaaaggcagagtttga

SEQ ID NO: 557 - protein, 33 aa, homo sapiens
MPKAGADGRGWERKMETELFSAFTLHSTDHFCK

SEQ ID NO: 558 - DNA, 102 bp, homo sapiens
atgcccaaagcaggtgcagatgggcggggatgggagagaaagatggagactgagttattctctgccttcaccctccacagtacagaccacttctgcaaatga

SEQ ID NO: 559 - protein, 60 aa, homo sapiens
MGGDGRERWRLSYSLPSPSTVQTTSANENSTVLPSSTSSSSDGNLVSWRYMWEDGSKDVI

SEQ ID NO: 560 - DNA, 183 bp, homo sapiens
atgggcggggatgggagagaaagatggagactgagttattctctgccttcaccctccacagtacagaccacttctgcaaatgagaatagcactgttttgccttcatccaccagctccagctccgatggcaacctggtgagttggaggtatatgtgggaagatggcagcaaggatgttatctag

SEQ ID NO: 561 - protein, 37 aa, homo sapiens
MIEGDHNVPGVAAHVDHLCADGEERGEGVRHRQDPSP

SEQ ID NO: 562 - DNA, 114 bp, homo sapiens
atgatagagggagaccacaacgtcccgggggttgcggcccatgtagatcacctgtgtgcggatggtgaggagaggggagaaggcgtcagacacaggcaagaccccagcccctga

SEQ ID NO: 563 - protein, 78 aa, homo sapiens
MVRRGEKASDTGKTPAPEASCPGDPSLLTLKQEGLRADSFFFAMESDSVSPRLECSGAISAHCNLCLLGSGDSPVSAS

SEQ ID NO: 564 - DNA, 237 bp, homo sapiens
atggtgaggagaggggagaaggcgtcagacacaggcaagaccccagcccctgaggcctcctgccctggagacccctctcttctgaccctgaagcaggaaggactcagggcagactcttttttttttgcgatggagtctgactctgtttcgcccaggctggagtgcagtggcgccatctcagctcattgcaacctctgcctcctgggttcaggcgattctcctgtgtcagcctcctga

SEQ ID NO: 565 - protein, 15 aa, homo sapiens
MFSRDGVLPCWLLTD

SEQ ID NO: 566 - DNA, 48 bp, homo sapiens
atgtttagtagagatggggttttaccatgttggttactcacagattga

SEQ ID NO: 567 - protein, 24 aa, homo sapiens
MGFYHVGYSQIEEPLEDRQGLTRS

SEQ ID NO: 568 - DNA, 75 bp, homo sapiens
atggggttttaccatgttggttactcacagattgaggaaccccttgaggacaggcaaggtcttacacgttcctag

SEQ ID NO: 569 - protein, 15 aa, homo sapiens
MQSKHLHFMNYLQFK

SEQ ID NO: 570 - DNA, 48 bp, homo sapiens
atgcaaagtaaacacttgcattttatgaactaccttcaatttaaatag

SEQ ID NO: 571 - protein, 9 aa, homo sapiens
MTCFGSKTC

SEQ ID NO: 572 - DNA, 30 bp, homo sapiens
atgacatgttttgggagtaagacctgttaa

SEQ ID NO: 573 - protein, 4 aa, homo sapiens
MFWE

SEQ ID NO: 574 - DNA, 15 bp, homo sapiens
atgttttgggagtaa

SEQ ID NO: 575 - protein, 16 aa, homo sapiens
MWLCKCIILVDLFSLA

SEQ ID NO: 576 - DNA, 51 bp, homo sapiens
atgtggttatgtaaatgcatcattttagttgatcttttttctttagcctag

SEQ ID NO: 577 - protein, 15 aa, homo sapiens
MQSKHLHFMNYLQFK

SEQ ID NO: 578 - DNA, 48 bp, homo sapiens; identical to SEQ ID NO: 570

SEQ ID NO: 579 - protein, 9 aa, homo sapiens
MTCFGSKTC

SEQ ID NO: 580 - DNA, 30 bp, homo sapiens; identical to SEQ ID NO: 572

SEQ ID NO: 581 - protein, 4 aa, homo sapiens
MFWE

SEQ ID NO: 582 - DNA, 15 bp, homo sapiens
atgttttgggagtaa

SEQ ID NO: 583 - protein, 16 aa, homo sapiens
MWLCKCIILVDLFSLA

SEQ ID NO: 584 - DNA, 51 bp, homo sapiens; identical to SEQ ID NO: 576

SEQ ID NO: 585 - protein, 7 aa, homo sapiens
MTKAPLH

SEQ ID NO: 586 - DNA, 24 bp, homo sapiens
atgaccaaggcaccactccactga

SEQ ID NO: 587 - protein, 72 aa, homo sapiens [sequence omitted]

SEQ ID NO: 588 - DNA, 219 bp, homo sapiens
atggtatccatttgccctctcttcttggattctcaagctggggcagagtccatggcagccaagggtggcttggatctgcccatcccattctcttcagaccctcctcagggattaaggtcaaaggtgggaggaagaaggcttccattggccttttatcctagaggttctaatggaggggaaaaggggataggatattttctatccaatcaggatgtttag

SEQ ID NO: 589 - protein, 6 aa, homo sapiens
MEGKRG

SEQ ID NO: 590 - DNA, 21 bp, homo sapiens
atggaggggaaaaggggatag

SEQ ID NO: 591 - protein, 4 aa, homo sapiens
MFRR

SEQ ID NO: 592 - DNA, 15 bp, homo sapiens
atgtttaggagatag

SEQ ID NO: 593 - protein, 13 aa, homo sapiens
MSHRAQPEIIFFF

SEQ ID NO: 594 - DNA, 42 bp, homo sapiens
atgagccaccgcgctcagcctgaaattattttctttttttaa

SEQ ID NO: 595 - protein, 21 aa, homo sapiens
MVIDHGSLKLLGSSSPPTSAA

SEQ ID NO: 596 - DNA, 66 bp, homo sapiens
atggtcatagatcacggcagcctcaaactcctgggctcaagcagtcctcccacctcagccgcctga

SEQ ID NO: 597 - protein, 7 aa, homo sapiens
MCTTTPG

SEQ ID NO: 598 - DNA, 24 bp, homo sapiens
atgtgtaccaccactcctggctga

SEQ ID NO: 599 - protein, 9 aa, homo sapiens
MAKPHLYKN

SEQ ID NO: 600 - DNA, 30 bp, homo sapiens
atggcaaaaccccatctctacaaaaattag

SEQ ID NO: 601 - protein, 13 aa, homo sapiens
MSHRAQPEIIFFF

SEQ ID NO: 602 - DNA, 42 bp, homo sapiens; identical to SEQ ID NO: 594

SEQ ID NO: 603 - protein, 21 aa, homo sapiens
MVIDHGSLKLLGSSSPPTSAA

SEQ ID NO: 604 - DNA, 66 bp, homo sapiens; identical to SEQ ID NO: 596

SEQ ID NO: 605 - protein, 7 aa, homo sapiens
MCTTTPG

SEQ ID NO: 606 - DNA, 24 bp, homo sapiens
atgtgtaccaccactcctggctga

SEQ ID NO: 607 - protein, 9 aa, homo sapiens
MAKPHLYKN

SEQ ID NO: 608 - DNA, 30 bp, homo sapiens; identical to SEQ ID NO: 600

SEQ ID NO: 609 - protein, 10 aa, homo sapiens
MNLGTVISPS

SEQ ID NO: 610 - DNA, 33 bp, homo sapiens
atgaatctgggcactgtaatcagtccatcctga

SEQ ID NO: 611 - protein, 28 aa, homo sapiens
MRSCLVLVLGCVDPLGLSQVCVGLIWTS

SEQ ID NO: 612 - DNA, 87 bp, homo sapiens
atgaggtcctgcctcgtgctggtgttaggatgtgtggaccccttaggtctcagtcaggtgtgtgtggggttgatctggacgagttga

SEQ ID NO: 613 - protein, 25 aa, homo sapiens
MCGPLRSQSGVCGVDLDELIIRSVP

SEQ ID NO: 614 - DNA, 78 bp, homo sapiens
atgtgtggaccccttaggtctcagtcaggtgtgtgtggggttgatctggacgagttgataatcagatcagtgccctag

SEQ ID NO: 615 - protein, 19 aa, homo sapiens
MRTLRCWMGWSTRSPPLLG

SEQ ID NO: 616 - DNA, 60 bp, homo sapiens
atgagaaccctgaggtgttggatgggttggtctacaaggtcacctccactgctaggatga

SEQ ID NO: 617 - protein, 10 aa, homo sapiens
MNLGTVISPS

SEQ ID NO: 618 - DNA, 33 bp, homo sapiens; identical to SEQ ID NO: 610

SEQ ID NO: 619 - protein, 28 aa, homo sapiens
MRSCLVLVLGCVDPLGLSQVCVGLIWTS

SEQ ID NO: 620 - DNA, 87 bp, homo sapiens; identical to SEQ ID NO: 612

SEQ ID NO: 621 - protein, 25 aa, homo sapiens
MCGPLRSQSGVCGVDLDELIIRSVP

SEQ ID NO: 622 - DNA, 78 bp, homo sapiens; identical to SEQ ID NO: 614

SEQ ID NO: 623 - protein, 19 aa, homo sapiens
MRTLRCWMGWSTRSPPLLG

SEQ ID NO: 624 - DNA, 60 bp, homo sapiens; identical to SEQ ID NO: 616

SEQ ID NO: 625 - protein, 13 aa, homo sapiens
MPNPGSMMTTGGV

SEQ ID NO: 626 - DNA, 42 bp, homo sapiens; identical to SEQ ID NO: 202

SEQ ID NO: 627 - protein, 4 aa, homo sapiens
MSHT

SEQ ID NO: 628 - DNA, 15 bp, homo sapiens
atgagtcatacatga

SEQ ID NO: 629 - protein, 8 aa, homo sapiens
MMNMCLEL

SEQ ID NO: 630 - DNA, 27 bp, homo sapiens
atgatgaatatgtgtctggaactctga

SEQ ID NO: 631 - protein, 14 aa, homo sapiens
MHSYVIIMIGSMKE

SEQ ID NO: 632 - DNA, 45 bp, homo sapiens; identical to SEQ ID NO: 208

SEQ ID NO: 633 - protein, 18 aa, homo sapiens
MSWGKGAPAFGVSTCLFS

SEQ ID NO: 634 - DNA, 57 bp, homo sapiens
atgagctggggaaagggagcaccagcatttggtgtttctacttgcctcttttcctga

SEQ ID NO: 635 - protein, 23 aa, homo sapiens
MESNPLLPGQVLRLGILCTPVHW

SEQ ID NO: 636 - DNA, 72 bp, homo sapiens
atggaatccaatcctctgcttccaggacaagtcctgcgcttggggatcctctgtacgcccgttcactggtga

SEQ ID NO: 637 - protein, 6 aa, homo sapiens
MYDSNF

SEQ ID NO: 638 - DNA, 21 bp, homo sapiens
atgtatgacagcaatttctga

SEQ ID NO: 639 - protein, 12 aa, homo sapiens
MTAISDFTSSCF

SEQ ID NO: 640 - DNA, 39 bp, homo sapiens
atgacagcaatttctgatttcactagttcttgcttctaa

SEQ ID NO: 641 - protein, 18 aa, homo sapiens
MSWGKGAPAFGVSTCLFS

SEQ ID NO: 642 - DNA, 57 bp, homo sapiens; identical to SEQ ID NO: 634

SEQ ID NO: 643 - protein, 23 aa, homo sapiens
MESNPLLPGQVLRLGILCTPVHW

SEQ ID NO: 644 - DNA, 72 bp, homo sapiens; identical to SEQ ID NO: 636

SEQ ID NO: 645 - protein, 6 aa, homo sapiens
MYDSNF

SEQ ID NO: 646 - DNA, 21 bp, homo sapiens
atgtatgacagcaatttctga

SEQ ID NO: 647 - protein, 12 aa, homo sapiens
MTAISDFTSSCF

SEQ ID NO: 648 - DNA, 39 bp, homo sapiens; identical to SEQ ID NO: 640

SEQ ID NO: 649 - protein, 37 aa, homo sapiens
MGPNSGTFGTAAPYGGTKIWVCAGGDGWSDGLQDLMA

SEQ ID NO: 650 - DNA, 114 bp, homo sapiens
atgggaccaaattctggaacattcgggactgcggcaccttacggcgggaccaagatttgggtctgcgcaggcggcgatgggtggtccgacgggcttcaggacttgatggcgtaa

SEQ ID NO: 651 - protein, 9 aa, homo sapiens
MGGPTGFRT

SEQ ID NO: 652 - DNA, 30 bp, homo sapiens
atgggtggtccgacgggcttcaggacttga

SEQ ID NO: 653 - protein, 38 aa, homo sapiens
MYLLGSGALSLCMWVLCLSHLLSRFLLFISLREGFFPL

SEQ ID NO: 654 - DNA, 117 bp, homo sapiens
atgtatttgctgggatcaggggcgctgtctctgtgtatgtgggtgctctgtctttctcaccttctttctcgatttttgctatttatttctctgagggagggttttttcccactttaa

SEQ ID NO: 655 - protein, 6 aa, homo sapiens
MWKVRE

SEQ ID NO: 656 - DNA, 21 bp, homo sapiens
atgtggaaggtaagggagtga

SEQ ID NO: 657 - protein, 37 aa, homo sapiens; identical to SEQ ID NO: 649

SEQ ID NO: 658 - DNA, 114 bp, homo sapiens; identical to SEQ ID NO: 650

SEQ ID NO: 659 - protein, 9 aa, homo sapiens
MGGPTGFRT

SEQ ID NO: 660 - DNA, 30 bp, homo sapiens; identical to SEQ ID NO: 652

SEQ ID NO: 661 - protein, 38 aa, homo sapiens; identical to SEQ ID NO: 653

SEQ ID NO: 662 - DNA, 117 bp, homo sapiens; identical to SEQ ID NO: 654

SEQ ID NO: 663 - protein, 6 aa, homo sapiens
MWKVRE

SEQ ID NO: 664 - DNA, 21 bp, homo sapiens
atgtggaaggtaagggagtga

SEQ ID NO: 665 - protein, 13 aa, homo sapiens
MPNPGSMMTTGGV

SEQ ID NO: 666 - DNA, 42 bp, homo sapiens; identical to SEQ ID NO: 202

SEQ ID NO: 667 - protein, 4 aa, homo sapiens
MSHT

SEQ ID NO: 668 - DNA, 15 bp, homo sapiens
atgagtcatacatga

SEQ ID NO: 669 - protein, 8 aa, homo sapiens
MMNMCLEL

SEQ ID NO: 670 - DNA, 27 bp, homo sapiens
atgatgaatatgtgtctggaactctga

SEQ ID NO: 671 - protein, 14 aa, homo sapiens
MHSYVIIMIGSMKE

SEQ ID NO: 672 - DNA, 45 bp, homo sapiens; identical to SEQ ID NO: 208

SEQ ID NO: 673 - protein, 80 aa, homo sapiens
MTDAAEAAFSVRTPPIPSSRRAPCPPPLARPSPWRWRVPAPSPPAAPGAPRARGAGRWEREGGGRGGPAASSPDPRPRAR

SEQ ID NO: 674 - DNA, 243 bp, homo sapiens
atgacggacgcggcggaggctgctttctcagtgcggacgccgccgatccccagctctcgccgcgccccctgccccccgcccctcgcgcgcccctcaccctggcgctggcgcgtccccgcgccctctcccccggccgctccaggcgcgcctcgggctcggggcgcggggcgctgggagcgggagggtgggggccgcggcgggccggcggcctcctcgcccgacccccgaccccgggccaggtga

SEQ ID NO: 675 - protein, 15 aa, homo sapiens
MGRAAGGRWAPPRGS

SEQ ID NO: 676 - DNA, 48 bp, homo sapiens
atggggcgggcggcgggaggcaggtgggcccctccccggggctcgtga

SEQ ID NO: 677 - protein, 42 aa, homo sapiens
MFIRQLQETLPSGRGALLFAGASESGGFHSKTRVKPGWTGRE

SEQ ID NO: 678 - DNA, 129 bp, homo sapiens
atgtttatccggcagttgcaagaaactctgccctcgggacgaggcgccttgctttttgccggggccagcgaaagtggcggatttcacagcaaaactcgggtgaagccaggctggaccggccgggagtga

SEQ ID NO: 679 - protein, 37 aa, homo sapiens
MGTRDERIRLCVAPGHDVCTLLCQCLMFVAYGYFRTK

SEQ ID NO: 680 - DNA, 114 bp, homo sapiens
atggggaccagagatgaacgaatccgcctgtgtgtagcaccagggcatgatgtgtgcacgttgctatgccagtgtttaatgtttgttgcttatggttattttaggactaaatga

SEQ ID NO: 681 - protein, 80 aa, homo sapiens; identical to SEQ ID NO: 673

SEQ ID NO: 682 - DNA, 243 bp, homo sapiens; identical to SEQ ID NO: 674

SEQ ID NO: 683 - protein, 15 aa, homo sapiens
MGRAAGGRWAPPRGS

SEQ ID NO: 684 - DNA, 48 bp, homo sapiens; identical to SEQ ID NO: 676

SEQ ID NO: 685 - protein, 42 aa, homo sapiens; identical to SEQ ID NO: 677

SEQ ID NO: 686 - DNA, 129 bp, homo sapiens; identical to SEQ ID NO: 678

SEQ ID NO: 687 - protein, 37 aa, homo sapiens; identical to SEQ ID NO: 679

SEQ ID NO: 688 - DNA, 114 bp, homo sapiens; identical to SEQ ID NO: 680

SEQ ID NO: 689 - protein, 13 aa, homo sapiens
MSHRAQPEIIFFF

SEQ ID NO: 690 - DNA, 42 bp, homo sapiens; identical to SEQ ID NO: 594

SEQ ID NO: 691 - protein, 21 aa, homo sapiens
MVIDHGSLKLLGSSSPPTSAA

SEQ ID NO: 692 - DNA, 66 bp, homo sapiens; identical to SEQ ID NO: 596

SEQ ID NO: 693 - protein, 7 aa, homo sapiens
MCTTTPG

SEQ ID NO: 694 - DNA, 24 bp, homo sapiens
atgtgtaccaccactcctggctga

SEQ ID NO: 695 - protein, 9 aa, homo sapiens
MAKPHLYKN

SEQ ID NO: 696 - DNA, 30 bp, homo sapiens; identical to SEQ ID NO: 600

SEQ ID NO: 697 - protein, 55 aa, homo sapiens
MLPGREGATRSPEGTDTRTLAEPHPLAFRSPSRCVPPVASQLLPSHVARLPGPPR

SEQ ID NO: 698 - DNA, 168 bp, homo sapiens
atgttgcctgggagagaaggggcgacgagatcaccagaggggactgacacgcggaccctggcggaaccccacccccttgctttccggtcccccagtcggtgcgtccctccagtggcctctcagctcctcccctcccacgtggcgagactcccgggaccacccaggtga

SEQ ID NO: 699 - protein, 31 aa, homo sapiens
MLRRSGVLASGRWRGGAKIRVPGFVGHHAAM

SEQ ID NO: 700 - DNA, 96 bp, homo sapiens
atgctgcggcgctcgggggtcttggcctccgggcggtggcgtggaggcgccaagatcagggtcccgggttttgtcggccaccacgccgcaatgtga

SEQ ID NO: 701 - protein, 15 aa, homo sapiens
MGRGARRGAESETWT

SEQ ID NO: 702 - DNA, 48 bp, homo sapiens
atggggcgaggggcgcggcgcggcgcagagagtgagacctggacttaa

SEQ ID NO: 703 - protein, 30 aa, homo sapiens
MVTLEWSLPPGSDLAHFRGPLPCAPGGVLG

SEQ ID NO: 704 - DNA, 93 bp, homo sapiens
atggtgaccttggagtggtcattacctccgggcagcgacctcgcccactttcggggaccccttccctgtgctcctggtggagtcctggggtga

SEQ ID NO: 705 - protein, 27 aa, homo sapiens
MESRSVAQAEVQWHNLSSLQPPPPWFK

SEQ ID NO: 706 - DNA, 84 bp, homo sapiens
atggagtctcgctctgtcgcccaggctgaagtgcagtggcacaatctcagctcactgcaacctccgcctccttggttcaagtga

SEQ ID NO: 707 - protein, 16 aa, homo sapiens
MRFHHVGQAGLKLLTS

SEQ ID NO: 708 - DNA, 51 bp, homo sapiens
atgaggtttcaccatgttggtcaggctggtctcaaactcctgacctcgtga

SEQ ID NO: 709 - protein, 9 aa, homo sapiens
MLVRLVSNS

SEQ ID NO: 710 - DNA, 30 bp, homo sapiens
atgttggtcaggctggtctcaaactcctga

SEQ ID NO: 711 - protein, 18 aa, homo sapiens
MNGLIHSLRQRPHYPITS

SEQ ID NO: 712 - DNA, 57 bp, homo sapiens
atgaatggattaatccattcattgaggcagagacctcattacccaatcacttcttaa

SEQ ID NO: 713 - protein, 13 aa, homo sapiens
MPNPGSMMTTGGV

SEQ ID NO: 714 - DNA, 42 bp, homo sapiens; identical to SEQ ID NO: 202

SEQ ID NO: 715 - protein, 4 aa, homo sapiens
MSHT

SEQ ID NO: 716 - DNA, 15 bp, homo sapiens
atgagtcatacatga

SEQ ID NO: 717 - protein, 8 aa, homo sapiens
MMNMCLEL

SEQ ID NO: 718 - DNA, 27 bp, homo sapiens
atgatgaatatgtgtctggaactctga

SEQ ID NO: 719 - protein, 14 aa, homo sapiens
MHSYVIIMIGSMKE

SEQ ID NO: 720 - DNA, 45 bp, homo sapiens; identical to SEQ ID NO: 208

SEQ ID NO: 721 - protein, 27 aa, homo sapiens
MPFLNCVALHVIHISFLSATRETAENN

SEQ ID NO: 722 - DNA, 84 bp, homo sapiens
atgccattcttaaactgtgtggctttgcatgtgatccatatctccttcctttcagccaccagagaaacggcggagaacaattga

SEQ ID NO: 723 - protein, 10 aa, homo sapiens
MLVTFPLAKR

SEQ ID NO: 724 - DNA, 33 bp, homo sapiens
atgctggttacattccccctagcaaagaggtag

SEQ ID NO: 725 - protein, 9 aa, homo sapiens
MRGVDGRDS

SEQ ID NO: 726 - DNA, 30 bp, homo sapiens
atgcggggagtggatggccgggatagctag

SEQ ID NO: 727 - protein, 20 aa, homo sapiens
MAGIASLNSSEKEGGFGVAG

SEQ ID NO: 728 - DNA, 63 bp, homo sapiens
atggccgggatagctagcttgaacagcagtgaaaaggaagggggatttggagtcgctggttga

SEQ ID NO: 729 - protein, 10 aa, homo sapiens
MRWRSRCPWR

SEQ ID NO: 730 - DNA, 33 bp, homo sapiens
atgcgatggcggagtcgctgcccctggaggtga

SEQ ID NO: 731 - protein, 16 aa, homo sapiens
MAESLPLEVRGSRPQA

SEQ ID NO: 732 - DNA, 51 bp, homo sapiens
atggcggagtcgctgcccctggaggtgagaggaagccgccctcaggcctag

SEQ ID NO: 733 - protein, 10 aa, homo sapiens
MSAPSHRPEG

SEQ ID NO: 734 - DNA, 33 bp, homo sapiens
atgtccgctccatctcatcgtcccgaagggtaa

SEQ ID NO: 735 - protein, 30 aa, homo sapiens
MISPFPTETAAPSPWQWETDCSLPINCNDL

SEQ ID NO: 736 - DNA, 93 bp, homo sapiens
atgatctctccatttcctacagagacggccgccccttctccctggcagtgggaaacagactgctccctccccatcaactgcaatgatctctga

SEQ ID NO: 737 - protein, 13 aa, homo sapiens
MPNPGSMMTTGGV

SEQ ID NO: 738 - DNA, 42 bp, homo sapiens; identical to SEQ ID NO: 202

SEQ ID NO: 739 - protein, 4 aa, homo sapiens
MSHT

SEQ ID NO: 740 - DNA, 15 bp, homo sapiens
atgagtcatacatga

SEQ ID NO: 741 - protein, 8 aa, homo sapiens
MMNMCLEL

SEQ ID NO: 742 - DNA, 27 bp, homo sapiens
atgatgaatatgtgtctggaactctga

SEQ ID NO: 743 - protein, 14 aa, homo sapiens
MHSYVIIMIGSMKE

SEQ ID NO: 744 - DNA, 45 bp, homo sapiens; identical to SEQ ID NO: 208

SEQ ID NO: 745 - protein, 13 aa, homo sapiens
MPNPGSMMTTGGV

SEQ ID NO: 746 - DNA, 42 bp, homo sapiens; identical to SEQ ID NO: 202

SEQ ID NO: 747 - protein, 4 aa, homo sapiens
MSHT

SEQ ID NO: 748 - DNA, 15 bp, homo sapiens
atgagtcatacatga

SEQ ID NO: 749 - protein, 8 aa, homo sapiens
MMNMCLEL

SEQ ID NO: 750 - DNA, 27 bp, homo sapiens
atgatgaatatgtgtctggaactctga

SEQ ID NO: 751 - protein, 14 aa, homo sapiens
MHSYVIIMIGSMKE

SEQ ID NO: 752 - DNA, 45 bp, homo sapiens; identical to SEQ ID NO: 208

SEQ ID NO: 753 - protein, 41 aa, homo sapiens [sequence omitted]

SEQ ID NO: 754 - DNA, 126 bp, homo sapiens; identical to SEQ ID NO: 186

SEQ ID NO: 755 - protein, 6 aa, homo sapiens
MGKIYQ

SEQ ID NO: 756 - DNA, 21 bp, homo sapiens
atgggaaagatttatcaatga

SEQ ID NO: 757 - protein, 14 aa, homo sapiens
MREMCLFFRYVLLI

SEQ ID NO: 758 - DNA, 45 bp, homo sapiens; identical to SEQ ID NO: 190

SEQ ID NO: 759 - protein, 4 aa, homo sapiens
MLFP

SEQ ID NO: 760 - DNA, 15 bp, homo sapiens
atgcttttcccatga

SEQ ID NO: 761 - protein, 10 aa, homo sapiens
MRLTEKSSIT

SEQ ID NO: 762 - DNA, 33 bp, homo sapiens
atgagactaacagaaaaatcaagtatcacatag

SEQ ID NO: 763 - protein, 41 aa, homo sapiens
MLKMNNRSRLHLVSRSLPCNDCALASPSCSLSAFLMWRFEM

SEQ ID NO: 764 - DNA, 126 bp, homo sapiens
atgttaaaaatgaacaatcggagcaggctacatttagtttcacggtctcttccctgtaatgactgtgcactagcaagtccttcctgttctttgtcagcgttcttgatgtggcgatttgaaatgtaa

SEQ ID NO: 765 - protein, 4 aa, homo sapiens
MTVH

SEQ ID NO: 766 - DNA, 15 bp, homo sapiens
atgactgtgcactag

SEQ ID NO: 767 - protein, 4 aa, homo sapiens
MPSL

SEQ ID NO: 768 - DNA, 15 bp, homo sapiens
atgccatccctttag

SEQ ID NO: 769 - protein, 35 aa, homo sapiens
MRRPCTTAPGGARVPTATSWRLRAAGAEIQTDARC

SEQ ID NO: 770 - DNA, 108 bp, homo sapiens
atgcggagaccctgcaccactgctccgggcggcgctcgcgtcccgacggccacctcctggcggctgcgcgcagccggcgccgagatccagacggacgcacggtgctga

SEQ ID NO: 771 - protein, 8 aa, homo sapiens
MTNGECCF

SEQ ID NO: 772 - DNA, 27 bp, homo sapiens
atgacaaatggggagtgctgcttctag

SEQ ID NO: 773 - protein, 51 aa, homo sapiens [sequence omitted]

SEQ ID NO: 774 - DNA, 156 bp, homo sapiens
atggggagtgctgcttctaggtgctcgtaccaactggcttcgtgcgtcctgggatgggcggtgttcacaggcgcttcggggctgagcgcccaccaagtgtggcgcgcgcttttgggaaactccgtggaagaccaggacggacccctggagggttag

SEQ ID NO: 775 - protein, 37 aa, homo sapiens
MGGVHRRFGAERPPSVARAFGKLRGRPGRTPGGLGRL

SEQ ID NO: 776 - DNA, 114 bp, homo sapiens
atgggcggtgttcacaggcgcttcggggctgagcgcccaccaagtgtggcgcgcgcttttgggaaactccgtggaagaccaggacggacccctggagggttaggaagactttga

SEQ ID NO: 777 - protein, 52 aa, homo sapiens
MGVGARLPAWEGAGPPRQRRPLAQLRVLCAARPAGVPLGPGVSSGAACAQPW

SEQ ID NO: 778 - DNA, 159 bp, homo sapiens
atgggggtcggggcgcggctcccggcctgggagggcgcgggtcctccccggcagcgccgcccgctggcccagctacgcgtgttgtgcgctgcgaggccggcgggggtcccgctgggcccgggggtgtcctcgggggccgcttgcgcccagccatggtag

SEQ ID NO: 779 - protein, 36 aa, homo sapiens
MVGRPPVKWGPRRAPTPRRRCGPSGSCSRGCPVLGL

SEQ ID NO: 780 - DNA, 111 bp, homo sapiens
atggtagggcgtcccccggtgaaatggggtccgaggcgggccccgaccccgcgtcggcgctgcggaccgtccgggagctgcagccgcgggtgcccggtgctcggtttgtag

SEQ ID NO: 781 - protein, 34 aa, homo sapiens
MGSEAGPDPASALRTVRELQPRVPGARFVGSVIS

SEQ ID NO: 782 - DNA, 105 bp, homo sapiens
atggggtccgaggcgggccccgaccccgcgtcggcgctgcggaccgtccgggagctgcagccgcgggtgcccggtgctcggtttgtaggcagtgtcattagctga

SEQ ID NO: 783 - protein, 44 aa, homo sapiens
MPEKRGVGVGPAQPAPRAPAASARKPAVSPDTVKLLALSRSHRR

SEQ ID NO: 784 - DNA, 135 bp, homo sapiens
atgcctgagaagcgcggcgtcggcgtgggtcctgcgcagcctgccccgcgagcgcccgctgcaagtgcgaggaaacccgcggtttctccagatacagttaaactgttagctctctctaggagtcacagaagatga

SEQ ID NO: 785 - protein, 52 aa, homo sapiens; identical to SEQ ID NO: 777

SEQ ID NO: 786 - DNA, 159 bp, homo sapiens; identical to SEQ ID NO: 778

SEQ ID NO: 787 - protein, 36 aa, homo sapiens; identical to SEQ ID NO: 779

SEQ ID NO: 788 - DNA, 111 bp, homo sapiens; identical to SEQ ID NO: 780

SEQ ID NO: 789 - protein, 34 aa, homo sapiens; identical to SEQ ID NO: 781

SEQ ID NO: 790 - DNA, 105 bp, homo sapiens; identical to SEQ ID NO: 782

SEQ ID NO: 791 - protein, 44 aa, homo sapiens; identical to SEQ ID NO: 783

SEQ ID NO: 792 - DNA, 135 bp, homo sapiens; identical to SEQ ID NO: 784

SEQ ID NO: 793 - protein, 26 aa, homo sapiens
MKKGRKPTCASDSRWRNDCGFRCIHR

SEQ ID NO: 794 - DNA, 81 bp, homo sapiens; identical to SEQ ID NO: 90

SEQ ID NO: 795 - protein, 12 aa, homo sapiens
MIVVFVASTADS

SEQ ID NO: 796 - DNA, 39 bp, homo sapiens; identical to SEQ ID NO: 92

SEQ ID NO: 797 - protein, 57 aa, homo sapiens; identical to SEQ ID NO: 93

SEQ ID NO: 798 - DNA, 174 bp, homo sapiens; identical to SEQ ID NO: 94

SEQ ID NO: 799 - protein, 26 aa, homo sapiens
MLNSILIVRLKLRHHFILQSAVGLWP

SEQ ID NO: 800 - DNA, 81 bp, homo sapiens; identical to SEQ ID NO: 96

SEQ ID NO: 801 - protein, 49 aa, homo sapiens; identical to SEQ ID NO: 393

SEQ ID NO: 802 - DNA, 150 bp, homo sapiens; identical to SEQ ID NO: 394

SEQ ID NO: 803 - protein, 77 aa, homo sapiens; identical to SEQ ID NO: 395

SEQ ID NO: 804 - DNA, 234 bp, homo sapiens; identical to SEQ ID NO: 396

SEQ ID NO: 805 - protein, 15 aa, homo sapiens
MGGGACGGRAPGIPD

SEQ ID NO: 806 - DNA, 48 bp, homo sapiens; identical to SEQ ID NO: 398

SEQ ID NO: 807 - protein, 13 aa, homo sapiens
MRRLCPLRTHPYL

SEQ ID NO: 808 - DNA, 42 bp, homo sapiens; identical to SEQ ID NO: 400

SEQ ID NO: 809 - protein, 13 aa, homo sapiens
MPNPGSMMTTGGV

SEQ ID NO: 810 - DNA, 42 bp, homo sapiens; identical to SEQ ID NO: 202

SEQ ID NO: 811 - protein, 4 aa, homo sapiens
MSHT

SEQ ID NO: 812 - DNA, 15 bp, homo sapiens
atgagtcatacatga

SEQ ID NO: 813 - protein, 8 aa, homo sapiens
MMNMCLEL

SEQ ID NO: 814 - DNA, 27 bp, homo sapiens
atgatgaatatgtgtctggaactctga

SEQ ID NO: 815 - protein, 14 aa, homo sapiens
MHSYVIIMIGSMKE

SEQ ID NO: 816 - DNA, 45 bp, homo sapiens; identical to SEQ ID NO: 208

SEQ ID NO: 817 - protein, 5 aa, homo sapiens
MRRAL

SEQ ID NO: 818 - DNA, 18 bp, homo sapiens
atgaggagggcattgtag

SEQ ID NO: 819 - protein, 13 aa, homo sapiens
MRVIDPGCRSPKE

SEQ ID NO: 820 - DNA, 42 bp, homo sapiens; identical to SEQ ID NO: 148

SEQ ID NO: 821 - protein, 24 aa, homo sapiens
MTERKREWWKETIGWEKMKIEKRK

SEQ ID NO: 822 - DNA, 75 bp, homo sapiens; identical to SEQ ID NO: 150

SEQ ID NO: 823 - protein, 17 aa, homo sapiens
MGKNENRKKEVKEIINN

SEQ ID NO: 824 - DNA, 54 bp, homo sapiens; identical to SEQ ID NO: 152

SEQ ID NO: 825 - protein, 116 aa, homo sapiens [sequence omitted]

SEQ ID NO: 826 - DNA, 351 bp, homo sapiens
atggagactttgtaccgtgtcccgttcttagcgcttgaatgtcccaacctgaagctgaagaagccgccctggctgcacatgccgttggccatgactatgtatgctctggtggtggtgtcttacttcctcatcaccagaggaatcgtttatgatgttacggttgaaccgccaggtgttggctctatgactgatgaacaagggcatcagaggccagtagctttcttggcctacagagtaagtggacaatattattatggaaggacttggatccagcttcctgtttacaatgggaggtttaggtttcataatcctggaccgatcgaatgcaccaaatatcccaaaactcaatag

SEQ ID NO: 827 - protein, 37 aa, homo sapiens
MSQPEAEEAALAAHAVGHDYVCSGGGVLLPHHQRNRL

SEQ ID NO: 828 - DNA, 114 bp, homo sapiens
atgtcccaacctgaagctgaagaagccgccctggctgcacatgccgttggccatgactatgtatgctctggtggtggtgtcttacttcctcatcaccagaggaatcgtttatga

SEQ ID NO: 829 - protein, 28 aa, homo sapiens
MLWWWCLTSSSPEESFMMLRLNRQVLAL

SEQ ID NO: 830 - DNA, 87 bp, homo sapiens
atgctctggtggtggtgtcttacttcctcatcaccagaggaatcgtttatgatgttacggttgaaccgccaggtgttggctctatga

SEQ ID NO: 831 - protein, 8 aa, homo sapiens
MNKGIRGQ

SEQ ID NO: 832 - DNA, 27 bp, homo sapiens
atgaacaagggcatcagaggccagtag

SEQ ID NO: 833 - protein, 116 aa, homo sapiens [sequence omitted]

SEQ ID NO: 834 - DNA, 351 bp, homo sapiens; identical to SEQ ID NO: 826

SEQ ID NO: 835 - protein, 37 aa, homo sapiens; identical to SEQ ID NO: 827

SEQ ID NO: 836 - DNA, 114 bp, homo sapiens; identical to SEQ ID NO: 828

SEQ ID NO: 837 - protein, 28 aa, homo sapiens
MLWWWCLTSSSPEESFMMLRLNRQVLAL

SEQ ID NO: 838 - DNA, 87 bp, homo sapiens; identical to SEQ ID NO: 830

SEQ ID NO: 839 - protein, 8 aa, homo sapiens
MNKGIRGQ

SEQ ID NO: 840 - DNA, 27 bp, homo sapiens
atgaacaagggcatcagaggccagtag

SEQ ID NO: 841 - protein, 41 aa, homo sapiens
MHEGTTNCTLSTREGINTFFCVLGVWVGFVDTFLWFTISMI

SEQ ID NO: 842 - DNA, 126 bp, homo sapiens
atgcatgagggaactacaaactgcacactttccacaagggagggaataaatacttttttctgtgtccttggagtgtgggtgggattcgtggatacatttctctggttcactatttcaatgatatga

SEQ ID NO: 843 - protein, 14 aa, homo sapiens
MRELQTAHFPQGRE

SEQ ID NO: 844 - DNA, 45 bp, homo sapiens
atgagggaactacaaactgcacactttccacaagggagggaataa

SEQ ID NO: 845 - protein, 23 aa, homo sapiens
MKEPHVAAQKIFHRWKLRLVHLH

SEQ ID NO: 846 - DNA, 72 bp, homo sapiens
atgaaggagcctcatgttgcagcacagaagatttttcatcgttggaagttaaggttagttcaccttcattga

SEQ ID NO: 847 - protein, 12 aa, homo sapiens
MLQHRRFFIVGS

SEQ ID NO: 848 - DNA, 39 bp, homo sapiens
atgttgcagcacagaagatttttcatcgttggaagttaa

SEQ ID NO: 849 - protein, 8 aa, homo sapiens
MRSGEGGG

SEQ ID NO: 850 - DNA, 27 bp, homo sapiens
atgcgttcaggtgagggcggaggctag

SEQ ID NO: 851 - protein, 17 aa, homo sapiens
MALGKSFPGLLVFPFAQ

SEQ ID NO: 852 - DNA, 54 bp, homo sapiens
atggccttgggcaagtcatttcccggcctcttggttttcccatttgctcagtga

SEQ ID NO: 853 - protein, 62 aa, homo sapiens
MLGKMQALTELEPRLRCGKSGRGKLRATMEPQIHSSDLCGAADILRCHSLTLPWSLFQSKNV

SEQ ID NO: 854 - DNA, 189 bp, homo sapiens
atgctggggaagatgcaggccctcacggagttggagccaaggctgaggtgtggaaaatctgggcgggggaagctgagggccaccatggagcctcaaatccactcctcggatctctgtggtgctgctgacatcctgagatgtcactccctgacactcccttggtccctctttcagtctaaaaacgtctga

SEQ ID NO: 855 - protein, 13 aa, homo sapiens
MSLPDTPLVPLSV

SEQ ID NO: 856 - DNA, 42 bp, homo sapiens
atgtcactccctgacactcccttggtccctctttcagtctaa

SEQ ID NO: 857 - protein, 13 aa, homo sapiens
MPNPGSMMTTGGV

SEQ ID NO: 858 - DNA, 42 bp, homo sapiens; identical to SEQ ID NO: 202

SEQ ID NO: 859 - protein, 4 aa, homo sapiens
MSHT

SEQ ID NO: 860 - DNA, 15 bp, homo sapiens
atgagtcatacatga

SEQ ID NO: 861 - protein, 8 aa, homo sapiens
MMNMCLEL

SEQ ID NO: 862 - DNA, 27 bp, homo sapiens
atgatgaatatgtgtctggaactctga

SEQ ID NO: 863 - protein, 14 aa, homo sapiens
MHSYVIIMIGSMKE

SEQ ID NO: 864 - DNA, 45 bp, homo sapiens; identical to SEQ ID NO: 208

SEQ ID NO: 865 - protein, 13 aa, homo sapiens
MPNPGSMMTTGGV

SEQ ID NO: 866 - DNA, 42 bp, homo sapiens; identical to SEQ ID NO: 202

SEQ ID NO: 867 - protein, 4 aa, homo sapiens
MSHT

SEQ ID NO: 868 - DNA, 15 bp, homo sapiens
atgagtcatacatga

SEQ ID NO: 869 - protein, 8 aa, homo sapiens
MMNMCLEL

SEQ ID NO: 870 - DNA, 27 bp, homo sapiens
atgatgaatatgtgtctggaactctga

SEQ ID NO: 871 - protein, 14 aa, homo sapiens
MHSYVIIMIGSMKE

SEQ ID NO: 872 - DNA, 45 bp, homo sapiens; identical to SEQ ID NO: 208

SEQ ID NO: 873 - protein, 13 aa, homo sapiens
MPNPGSMMTTGGV

SEQ ID NO: 874 - DNA, 42 bp, homo sapiens; identical to SEQ ID NO: 202

SEQ ID NO: 875 - protein, 4 aa, homo sapiens
MSHT

SEQ ID NO: 876 - DNA, 15 bp, homo sapiens
atgagtcatacatga

SEQ ID NO: 877 - protein, 8 aa, homo sapiens
MMNMCLEL

SEQ ID NO: 878 - DNA, 27 bp, homo sapiens
atgatgaatatgtgtctggaactctga

SEQ ID NO: 879 - protein, 14 aa, homo sapiens
MHSYVIIMIGSMKE

SEQ ID NO: 880 - DNA, 45 bp, homo sapiens; identical to SEQ ID NO: 208

SEQ ID NO: 881 - protein, 13 aa, homo sapiens
MPNPGSMMTTGGV

SEQ ID NO: 882 - DNA, 42 bp, homo sapiens; identical to SEQ ID NO: 202

SEQ ID NO: 883 - protein, 4 aa, homo sapiens
MSHT

SEQ ID NO: 884 - DNA, 15 bp, homo sapiens
atgagtcatacatga

SEQ ID NO: 885 - protein, 8 aa, homo sapiens
MMNMCLEL

SEQ ID NO: 886 - DNA, 27 bp, homo sapiens
atgatgaatatgtgtctggaactctga

SEQ ID NO: 887 - protein, 14 aa, homo sapiens
MHSYVIIMIGSMKE

SEQ ID NO: 888 - DNA, 45 bp, homo sapiens; identical to SEQ ID NO: 208

SEQ ID NO: 889 - protein, 13 aa, homo sapiens
MPNPGSMMTTGGV

SEQ ID NO: 890 - DNA, 42 bp, homo sapiens; identical to SEQ ID NO: 202

SEQ ID NO: 891 - protein, 4 aa, homo sapiens
MSHT

SEQ ID NO: 892 - DNA, 15 bp, homo sapiens
atgagtcatacatga

SEQ ID NO: 893 - protein, 8 aa, homo sapiens
MMNMCLEL

SEQ ID NO: 894 - DNA, 27 bp, homo sapiens
atgatgaatatgtgtctggaactctga

SEQ ID NO: 895 - protein, 14 aa, homo sapiens
MHSYVIIMIGSMKE

SEQ ID NO: 896 - DNA, 45 bp, homo sapiens; identical to SEQ ID NO: 208

SEQ ID NO: 897 - protein, 4 aa, homo sapiens
MPLH

SEQ ID NO: 898 - DNA, 15 bp, homo sapiens
atgccactgcactaa

SEQ ID NO: 899 - protein, 19 aa, homo sapiens
MGEFCDKELRRFCKINLSL

SEQ ID NO: 900 - DNA, 60 bp, homo sapiens
atgggagaattttgtgataaagagcttagaaggttttgtaaaataaacttatctttataa

SEQ ID NO: 901 - protein, 5 aa, homo sapiens
MFLIA

SEQ ID NO: 902 - DNA, 18 bp, homo sapiens
atgtttttaatagcatga

SEQ ID NO: 903 - protein, 7 aa, homo sapiens
MNFQISE

SEQ ID NO: 904 - DNA, 24 bp, homo sapiens
atgaactttcaaatttcagaataa

SEQ ID NO: 905 - protein, 13 aa, homo sapiens
MPNPGSMMTTGGV

SEQ ID NO: 906 - DNA, 42 bp, homo sapiens; identical to SEQ ID NO: 202

SEQ ID NO: 907 - protein, 4 aa, homo sapiens
MSHT

SEQ ID NO: 908 - DNA, 15 bp, homo sapiens
atgagtcatacatga

SEQ ID NO: 909 - protein, 8 aa, homo sapiens
MMNMCLEL

SEQ ID NO: 910 - DNA, 27 bp, homo sapiens
atgatgaatatgtgtctggaactctga

SEQ ID NO: 911 - protein, 14 aa, homo sapiens
MHSYVIIMIGSMKE

SEQ ID NO: 912 - DNA, 45 bp, homo sapiens; identical to SEQ ID NO: 208

SEQ ID NO: 913 - protein, 13 aa, homo sapiens
MPNPGSMMTTGGV

SEQ ID NO: 914 - DNA, 42 bp, homo sapiens; identical to SEQ ID NO: 202

SEQ ID NO: 915 - protein, 4 aa, homo sapiens
MSHT

SEQ ID NO: 916 - DNA, 15 bp, homo sapiens
atgagtcatacatga

SEQ ID NO: 917 - protein, 8 aa, homo sapiens
MMNMCLEL

SEQ ID NO: 918 - DNA, 27 bp, homo sapiens
atgatgaatatgtgtctggaactctga

SEQ ID NO: 919 - protein, 14 aa, homo sapiens
MHSYVIIMIGSMKE

SEQ ID NO: 920 - DNA, 45 bp, homo sapiens; identical to SEQ ID NO: 208

SEQ ID NO: 921 - protein, 13 aa, homo sapiens
MPNPGSMMTTGGV

SEQ ID NO: 922 - DNA, 42 bp, homo sapiens; identical to SEQ ID NO: 202

SEQ ID NO: 923 - protein, 4 aa, homo sapiens
MSHT

SEQ ID NO: 924 - DNA, 15 bp, homo sapiens
atgagtcatacatga

SEQ ID NO: 925 - protein, 8 aa, homo sapiens
MMNMCLEL

SEQ ID NO: 926 - DNA, 27 bp, homo sapiens
atgatgaatatgtgtctggaactctga

SEQ ID NO: 927 - protein, 14 aa, homo sapiens
MHSYVIIMIGSMKE

SEQ ID NO: 928 - DNA, 45 bp, homo sapiens; identical to SEQ ID NO: 208

SEQ ID NO: 929 - protein, 13 aa, homo sapiens
MPNPGSMMTTGGV

SEQ ID NO: 930 - DNA, 42 bp, homo sapiens; identical to SEQ ID NO: 202

SEQ ID NO: 931 - protein, 4 aa, homo sapiens
MSHT

SEQ ID NO: 932 - DNA, 15 bp, homo sapiens
atgagtcatacatga

SEQ ID NO: 933 - protein, 8 aa, homo sapiens
MMNMCLEL

SEQ ID NO: 934 - DNA, 27 bp, homo sapiens
atgatgaatatgtgtctggaactctga

SEQ ID NO: 935 - protein, 14 aa, homo sapiens
MHSYVIIMIGSMKE

SEQ ID NO: 936 - DNA, 45 bp, homo sapiens; identical to SEQ ID NO: 208

SEQ ID NO: 937 - protein, 13 aa, homo sapiens
MPNPGSMMTTGGV

SEQ ID NO: 938 - DNA, 42 bp, homo sapiens; identical to SEQ ID NO: 202

SEQ ID NO: 939 - protein, 4 aa, homo sapiens
MSHT

SEQ ID NO: 940 - DNA, 15 bp, homo sapiens
atgagtcatacatga

SEQ ID NO: 941 - protein, 8 aa, homo sapiens
MMNMCLEL

SEQ ID NO: 942 - DNA, 27 bp, homo sapiens
atgatgaatatgtgtctggaactctga

SEQ ID NO: 943 - protein, 14 aa, homo sapiens
MHSYVIIMIGSMKE

SEQ ID NO: 944 - DNA, 45 bp, homo sapiens; identical to SEQ ID NO: 208

SEQ ID NO: 945 - protein, 13 aa, homo sapiens
MPNPGSMMTTGGV

SEQ ID NO: 946 - DNA, 42 bp, homo sapiens; identical to SEQ ID NO: 202

SEQ ID NO: 947 - protein, 4 aa, homo sapiens
MSHT

SEQ ID NO: 948 - DNA, 15 bp, homo sapiens
atgagtcatacatga

SEQ ID NO: 949 - protein, 8 aa, homo sapiens
MMNMCLEL

SEQ ID NO: 950 - DNA, 27 bp, homo sapiens
atgatgaatatgtgtctggaactctga

SEQ ID NO: 951 - protein, 14 aa, homo sapiens
MHSYVIIMIGSMKE

SEQ ID NO: 952 - DNA, 45 bp, homo sapiens; identical to SEQ ID NO: 208

SEQ ID NO: 953 - protein, 13 aa, homo sapiens
MPNPGSMMTTGGV

SEQ ID NO: 954 - DNA, 42 bp, homo sapiens; identical to SEQ ID NO: 202

SEQ ID NO: 955 - protein, 4 aa, homo sapiens
MSHT

SEQ ID NO: 956 - DNA, 15 bp, homo sapiens
atgagtcatacatga

SEQ ID NO: 957 - protein, 8 aa, homo sapiens
MMNMCLEL

SEQ ID NO: 958 - DNA, 27 bp, homo sapiens
atgatgaatatgtgtctggaactctga

SEQ ID NO: 959 - protein, 14 aa, homo sapiens
MHSYVIIMIGSMKE

SEQ ID NO: 960 - DNA, 45 bp, homo sapiens; identical to SEQ ID NO: 208

SEQ ID NO: 961 - protein, 13 aa, homo sapiens
MPNPGSMMTTGGV

SEQ ID NO: 962 - DNA, 42 bp, homo sapiens; identical to SEQ ID NO: 202

SEQ ID NO: 963 - protein, 4 aa, homo sapiens
MSHT

SEQ ID NO: 964 - DNA, 15 bp, homo sapiens
atgagtcatacatga

SEQ ID NO: 965 - protein, 8 aa, homo sapiens
MMNMCLEL

SEQ ID NO: 966 - DNA, 27 bp, homo sapiens
atgatgaatatgtgtctggaactctga

SEQ ID NO: 967 - protein, 14 aa, homo sapiens
MHSYVIIMIGSMKE

SEQ ID NO: 968 - DNA, 45 bp, homo sapiens; identical to SEQ ID NO: 208

SEQ ID NO: 969 - protein, 55 aa, homo sapiens
MLFCVLDLNFKMCKLVIYLYYYINFIVYIFISSVSMLCLKLKISQIILFLTAFNM

SEQ ID NO: 970 - DNA, 168 bp, homo sapiens
atgttattttgtgtgctggatctaaattttaagatgtgtaagctagttatatatttatattattatataaattttattgtatatatattcataagctctgtcagtatgttatgcttaaagcttaaaataagccaaatcattcttttcctgactgcttttaacatgtag

SEQ ID NO: 971 - protein, 4 aa, homo sapiens
MLKA

SEQ ID NO: 972 - DNA, 15 bp, homo sapiens
atgcttaaagcttaa

SEQ ID NO: 973 - protein, 36 aa, homo sapiens
MLGFEPVSAKKAFRALKTKYNKHRIQSKDRYFNIEY

SEQ ID NO: 974 - DNA, 111 bp, homo sapiens
atgttgggatttgaaccagtaagtgcaaagaaagctttcagggccctaaaaactaagtacaataagcaccgcatacagtcaaaggacagatacttcaatatagagtactga

SEQ ID NO: 975 - protein, 39 aa, homo sapiens
MFVGITELFWLHVPQAKGTTTIRLIPPPSESTGILCCLH

SEQ ID NO: 976 - DNA, 120 bp, homo sapiens
atgtttgttggcatcacagagctcttttggctacatgtaccacaagcaaaaggcactactaccatcaggctcattcctcctcccagtgaaagcacaggtattctttgttgtcttcactga

SEQ ID NO: 977 - protein, 102 aa, homo sapiens
MAGAESLSPRLLGWNGFHRFFPNIRWGGVRRAFARWSTPGRAPLVREGFQQDIDGKRTSGNEHLSIYMHPAWGRHWRIFCRRIFLFLRSPSWERTCGYSACP

SEQ ID NO: 978 - DNA, 309 bp, homo sapiens
atggcaggggcagaaagcctcagtcccaggcttcttggttggaatgggtttcacaggttctttcctaatatcagatggggaggggtgaggagggcatttgcccgctggagcacacctgggagagcaccacttgtgagggaagggttccagcaggacatcgatgggaaacgcacatcaggaaatgaacatctgagcatttacatgcacccagcatggggaaggcactggagaatattctgcaggaggatattcctgttcctaaggagcccgagctgggagcgcacctgtggatattcagcttgcccatag

SEQ ID NO: 979 - protein, 14 aa, homo sapiens
MGFTGSFLISDGEG

SEQ ID NO: 980 - DNA, 45 bp, homo sapiens
atgggtttcacaggttctttcctaatatcagatggggaggggtga

SEQ ID NO: 981 - protein, 36 aa, homo sapiens
MGRGEEGICPLEHTWESTTCEGRVPAGHRWETHIRK

SEQ ID NO: 982 - DNA, 111 bp, homo sapiens
atggggaggggtgaggagggcatttgcccgctggagcacacctgggagagcaccacttgtgagggaagggttccagcaggacatcgatgggaaacgcacatcaggaaatga

SEQ ID NO: 983 - protein, 10 aa, homo sapiens
MGNAHQEMNI

SEQ ID NO: 984 - DNA, 33 bp, homo sapiens
atgggaaacgcacatcaggaaatgaacatctga

SEQ ID NO: 985 - protein, 87 aa, homo sapiens; identical to SEQ ID NO: 441

SEQ ID NO: 986 - DNA, 264 bp, homo sapiens; identical to SEQ ID NO: 442

SEQ ID NO: 987 - protein, 85 aa, homo sapiens [sequence omitted]

SEQ ID NO: 988 - DNA, 258 bp, homo sapiens; identical to SEQ ID NO: 444

SEQ ID NO: 989 - protein, 96 aa, homo sapiens; identical to SEQ ID NO: 445

SEQ ID NO: 990 - DNA, 291 bp, homo sapiens; identical to SEQ ID NO: 446

SEQ ID NO: 991 - protein, 14 aa, homo sapiens
MTGVGATSLVRFFT

SEQ ID NO: 992 - DNA, 45 bp, homo sapiens; identical to SEQ ID NO: 448

SEQ ID NO: 993 - protein, 5 aa, homo sapiens
MRRAL

SEQ ID NO: 994 - DNA, 18 bp, homo sapiens
atgaggagggcattgtag

SEQ ID NO: 995 - protein, 13 aa, homo sapiens
MRVIDPGCRSPKE

SEQ ID NO: 996 - DNA, 42 bp, homo sapiens; identical to SEQ ID NO: 148

SEQ ID NO: 997 - protein, 24 aa, homo sapiens
MTERKREWWKETIGWEKMKIEKRK

SEQ ID NO: 998 - DNA, 75 bp, homo sapiens; identical to SEQ ID NO: 150

SEQ ID NO: 999 - protein, 17 aa, homo sapiens
MGKNENRKKEVKEIINN

SEQ ID NO: 1000 - DNA, 54 bp, homo sapiens; identical to SEQ ID NO: 152

SEQ ID NO: 1001 - protein, 5 aa, homo sapiens
MRRAL

SEQ ID NO: 1002 - DNA, 18 bp, homo sapiens
atgaggagggcattgtag

SEQ ID NO: 1003 - protein, 13 aa, homo sapiens
MRVIDPGCRSPKE

SEQ ID NO: 1004 - DNA, 42 bp, homo sapiens; identical to SEQ ID NO: 148

SEQ ID NO: 1005 - protein, 24 aa, homo sapiens
MTERKREWWKETIGWEKMKIEKRK

SEQ ID NO: 1006 - DNA, 75 bp, homo sapiens; identical to SEQ ID NO: 150

SEQ ID NO: 1007 - protein, 17 aa, homo sapiens
MGKNENRKKEVKEIINN

SEQ ID NO: 1008 - DNA, 54 bp, homo sapiens; identical to SEQ ID NO: 152

SEQ ID NO: 1009 - protein, 5 aa, homo sapiens
MRRAL

SEQ ID NO: 1010 - DNA, 18 bp, homo sapiens
atgaggagggcattgtag

SEQ ID NO: 1011 - protein, 13 aa, homo sapiens
MRVIDPGCRSPKE

SEQ ID NO: 1012 - DNA, 42 bp, homo sapiens; identical to SEQ ID NO: 148

SEQ ID NO: 1013 - protein, 24 aa, homo sapiens
MTERKREWWKETIGWEKMKIEKRK

SEQ ID NO: 1014 - DNA, 75 bp, homo sapiens; identical to SEQ ID NO: 150

SEQ ID NO: 1015 - protein, 17 aa, homo sapiens
MGKNENRKKEVKEIINN

SEQ ID NO: 1016 - DNA, 54 bp, homo sapiens; identical to SEQ ID NO: 152

SEQ ID NO: 1017 - protein, 79 aa, homo sapiens; identical to SEQ ID NO: 257

SEQ ID NO: 1018 - DNA, 240 bp, homo sapiens; identical to SEQ ID NO: 258

SEQ ID NO: 1019 - protein, 17 aa, homo sapiens
MGRGPETEVVSRHSQTR

SEQ ID NO: 1020 - DNA, 54 bp, homo sapiens; identical to SEQ ID NO: 260

SEQ ID NO: 1021 - protein, 24 aa, homo sapiens
MLQVPEFLSRWGMGTAVLGKRNCY

SEQ ID NO: 1022 - DNA, 75 bp, homo sapiens; identical to SEQ ID NO: 262

SEQ ID NO: 1023 - protein, 45 aa, homo sapiens; identical to SEQ ID NO: 263

SEQ ID NO: 1024 - DNA, 138 bp, homo sapiens; identical to SEQ ID NO: 264

SEQ ID NO: 1025 - protein, 13 aa, homo sapiens
MPNPGSMMTTGGV

SEQ ID NO: 1026 - DNA, 42 bp, homo sapiens; identical to SEQ ID NO: 202

SEQ ID NO: 1027 - protein, 4 aa, homo sapiens
MSHT

SEQ ID NO: 1028 - DNA, 15 bp, homo sapiens
atgagtcatacatga

SEQ ID NO: 1029 - protein, 8 aa, homo sapiens
MMNMCLEL

SEQ ID NO: 1030 - DNA, 27 bp, homo sapiens
atgatgaatatgtgtctggaactctga

SEQ ID NO: 1031 - protein, 14 aa, homo sapiens
MHSYVIIMIGSMKE

SEQ ID NO: 1032 - DNA, 45 bp, homo sapiens; identical to SEQ ID NO: 208

SEQ ID NO: 1033 - protein, 13 aa, homo sapiens
MPNPGSMMTTGGV

SEQ ID NO: 1034 - DNA, 42 bp, homo sapiens; identical to SEQ ID NO: 202

SEQ ID NO: 1035 - protein, 4 aa, homo sapiens
MSHT

SEQ ID NO: 1036 - DNA, 15 bp, homo sapiens
atgagtcatacatga

SEQ ID NO: 1037 - protein, 8 aa, homo sapiens
MMNMCLEL

SEQ ID NO: 1038 - DNA, 27 bp, homo sapiens
atgatgaatatgtgtctggaactctga

SEQ ID NO: 1039 - protein, 14 aa, homo sapiens
MHSYVIIMIGSMKE

SEQ ID NO: 1040 - DNA, 45 bp, homo sapiens; identical to SEQ ID NO: 208

SEQ ID NO: 1041 - protein, 13 aa, homo sapiens
MPNPGSMMTTGGV

SEQ ID NO: 1042 - DNA, 42 bp, homo sapiens; identical to SEQ ID NO: 202

SEQ ID NO: 1043 - protein, 4 aa, homo sapiens
MSHT

SEQ ID NO: 1044 - DNA, 15 bp, homo sapiens
atgagtcatacatga

SEQ ID NO: 1045 - protein, 8 aa, homo sapiens
MMNMCLEL

SEQ ID NO: 1046 - DNA, 27 bp, homo sapiens
atgatgaatatgtgtctggaactctga

SEQ ID NO: 1047 - protein, 14 aa, homo sapiens
MHSYVIIMIGSMKE

SEQ ID NO: 1048 - DNA, 45 bp, homo sapiens; identical to SEQ ID NO: 208

SEQ ID NO: 1049 - protein, 5 aa, homo sapiens
MRRAL

SEQ ID NO: 1050 - DNA, 18 bp, homo sapiens
atgaggagggcattgtag

SEQ ID NO: 1051 - protein, 13 aa, homo sapiens
MRVIDPGCRSPKE

SEQ ID NO: 1052 - DNA, 42 bp, homo sapiens; identical to SEQ ID NO: 148

SEQ ID NO: 1053 - protein, 24 aa, homo sapiens
MTERKREWWKETIGWEKMKIEKRK

SEQ ID NO: 1054 - DNA, 75 bp, homo sapiens; identical to SEQ ID NO: 150

SEQ ID NO: 1055 - protein, 17 aa, homo sapiens
MGKNENRKKEVKEIINN

SEQ ID NO: 1056 - DNA, 54 bp, homo sapiens; identical to SEQ ID NO: 152

SEQ ID NO: 1057 - protein, 13 aa, homo sapiens
MPNPGSMMTTGGV

SEQ ID NO: 1058 - DNA, 42 bp, homo sapiens; identical to SEQ ID NO: 202

SEQ ID NO: 1059 - protein, 4 aa, homo sapiens
MSHT

SEQ ID NO: 1060 - DNA, 15 bp, homo sapiens
atgagtcatacatga

SEQ ID NO: 1061 - protein, 8 aa, homo sapiens
MMNMCLEL

SEQ ID NO: 1062 - DNA, 27 bp, homo sapiens
atgatgaatatgtgtctggaactctga

SEQ ID NO: 1063 - protein, 14 aa, homo sapiens
MHSYVIIMIGSMKE

SEQ ID NO: 1064 - DNA, 45 bp, homo sapiens; identical to SEQ ID NO: 208

SEQ ID NO: 1065 - protein, 13 aa, homo sapiens
MPNPGSMMTTGGV

SEQ ID NO: 1066 - DNA, 42 bp, homo sapiens; identical to SEQ ID NO: 202

SEQ ID NO: 1067 - protein, 4 aa, homo sapiens
MSHT

SEQ ID NO: 1068 - DNA, 15 bp, homo sapiens
atgagtcatacatga

SEQ ID NO: 1069 - protein, 8 aa, homo sapiens
MMNMCLEL

SEQ ID NO: 1070 - DNA, 27 bp, homo sapiens
atgatgaatatgtgtctggaactctga

SEQ ID NO: 1071 - protein, 14 aa, homo sapiens
MHSYVIIMIGSMKE

SEQ ID NO: 1072 - DNA, 45 bp, homo sapiens; identical to SEQ ID NO: 208

SEQ ID NO: 1073 - protein, 13 aa, homo sapiens
MPNPGSMMTTGGV

SEQ ID NO: 1074 - DNA, 42 bp, homo sapiens; identical to SEQ ID NO: 202

SEQ ID NO: 1075 - protein, 4 aa, homo sapiens
MSHT

SEQ ID NO: 1076 - DNA, 15 bp, homo sapiens
atgagtcatacatga

SEQ ID NO: 1077 - protein, 8 aa, homo sapiens
MMNMCLEL

SEQ ID NO: 1078 - DNA, 27 bp, homo sapiens
atgatgaatatgtgtctggaactctga

SEQ ID NO: 1079 - protein, 14 aa, homo sapiens
MHSYVIIMIGSMKE

SEQ ID NO: 1080 - DNA, 45 bp, homo sapiens; identical to SEQ ID NO: 208

SEQ ID NO: 1081 - protein, 116 aa, homo sapiens [sequence omitted]

SEQ ID NO: 1082 - DNA, 351 bp, homo sapiens; identical to SEQ ID NO: 826

SEQ ID NO: 1083 - protein, 37 aa, homo sapiens; identical to SEQ ID NO: 827

SEQ ID NO: 1084 - DNA, 114 bp, homo sapiens; identical to SEQ ID NO: 828

SEQ ID NO: 1085 - protein, 28 aa, homo sapiens
MLWWWCLTSSSPEESFMMLRLNRQVLAL

SEQ ID NO: 1086 - DNA, 87 bp, homo sapiens; identical to SEQ ID NO: 830

SEQ ID NO: 1087 - protein, 8 aa, homo sapiens
MNKGIRGQ

SEQ ID NO: 1088 - DNA, 27 bp, homo sapiens
atgaacaagggcatcagaggccagtag

SEQ ID NO: 1089 - protein, 13 aa, homo sapiens
MPATWLPIKPEVL

SEQ ID NO: 1090 - DNA, 42 bp, homo sapiens
atgccagcaacatggcttcctataaagcctgaggtcctgtga

SEQ ID NO: 1091 - protein, 6 aa, homo sapiens
MASYKA

SEQ ID NO: 1092 - DNA, 21 bp, homo sapiens
atggcttcctataaagcctga

SEQ ID NO: 1093 - protein, 12 aa, homo sapiens
MQKWPNTKNWYQ

SEQ ID NO: 1094 - DNA, 39 bp, homo sapiens
atgcaaaaatggcctaatacaaaaaattggtaccagtag

SEQ ID NO: 1095 - protein, 36 aa, homo sapiens
MRKQLWNQVMSRVWKSLEGSEADMKIKESLDFLQDC

SEQ ID NO: 1096 - DNA, 111 bp, homo sapiens
atgaggaagcaactttggaaccaggtaatgagcagagtttggaagagtttggaggggtcagaagcagacatgaagataaaggaaagtttagattttcttcaagactgctga

SEQ ID NO: 1097 - protein, 13 aa, homo sapiens
MPATWLPIKPEVL

SEQ ID NO: 1098 - DNA, 42 bp, homo sapiens; identical to SEQ ID NO: 1090

SEQ ID NO: 1099 - protein, 6 aa, homo sapiens
MASYKA

SEQ ID NO: 1100 - DNA, 21 bp, homo sapiens
atggcttcctataaagcctga

SEQ ID NO: 1101 - protein, 12 aa, homo sapiens
MQKWPNTKNWYQ

SEQ ID NO: 1102 - DNA, 39 bp, homo sapiens; identical to SEQ ID NO: 1094

SEQ ID NO: 1103 - protein, 36 aa, homo sapiens; identical to SEQ ID NO: 1095

SEQ ID NO: 1104 - DNA, 111 bp, homo sapiens; identical to SEQ ID NO: 1096

SEQ ID NO: 1105 - protein, 13 aa, homo sapiens
MPATWLPIKPEVL

SEQ ID NO: 1106 - DNA, 42 bp, homo sapiens; identical to SEQ ID NO: 1090

SEQ ID NO: 1107 - protein, 6 aa, homo sapiens
MASYKA

SEQ ID NO: 1108 - DNA, 21 bp, homo sapiens
atggcttcctataaagcctga

SEQ ID NO: 1109 - protein, 12 aa, homo sapiens
MQKWPNTKNWYQ

SEQ ID NO: 1110 - DNA, 39 bp, homo sapiens; identical to SEQ ID NO: 1094

SEQ ID NO: 1111 - protein, 36 aa, homo sapiens; identical to SEQ ID NO: 1095

SEQ ID NO: 1112 - DNA, 111 bp, homo sapiens; identical to SEQ ID NO: 1096

SEQ ID NO: 1113 - protein, 13 aa, homo sapiens
MPATWLPIKPEVL

SEQ ID NO: 1114 - DNA, 42 bp, homo sapiens; identical to SEQ ID NO: 1090

SEQ ID NO: 1115 - protein, 6 aa, homo sapiens
MASYKA

SEQ ID NO: 1116 - DNA, 21 bp, homo sapiens
atggcttcctataaagcctga

SEQ ID NO: 1117 - protein, 12 aa, homo sapiens
MQKWPNTKNWYQ

SEQ ID NO: 1118 - DNA, 39 bp, homo sapiens; identical to SEQ ID NO: 1094

SEQ ID NO: 1119 - protein, 36 aa, homo sapiens; identical to SEQ ID NO: 1095

SEQ ID NO: 1120 - DNA, 111 bp, homo sapiens; identical to SEQ ID NO: 1096

SEQ ID NO: 1121 - protein, 13 aa, homo sapiens
MPATWLPIKPEVL

SEQ ID NO: 1122 - DNA, 42 bp, homo sapiens; identical to SEQ ID NO: 1090

SEQ ID NO: 1123 - protein, 6 aa, homo sapiens
MASYKA

SEQ ID NO: 1124 - DNA, 21 bp, homo sapiens
atggcttcctataaagcctga

SEQ ID NO: 1125 - protein, 12 aa, homo sapiens
MQKWPNTKNWYQ

SEQ ID NO: 1126 - DNA, 39 bp, homo sapiens; identical to SEQ ID NO: 1094

SEQ ID NO: 1127 - protein, 36 aa, homo sapiens; identical to SEQ ID NO: 1095

SEQ ID NO: 1128 - DNA, 111 bp, homo sapiens; identical to SEQ ID NO: 1096

SEQ ID NO: 1129 - protein, 116 aa, homo sapiens [sequence omitted]

SEQ ID NO: 1130 - DNA, 351 bp, homo sapiens; identical to SEQ ID NO: 826

SEQ ID NO: 1131 - protein, 37 aa, homo sapiens; identical to SEQ ID NO: 827

SEQ ID NO: 1132 - DNA, 114 bp, homo sapiens; identical to SEQ ID NO: 828

SEQ ID NO: 1133 - protein, 28 aa, homo sapiens
MLWWWCLTSSSPEESFMMLRLNRQVLAL

SEQ ID NO: 1134 - DNA, 87 bp, homo sapiens; identical to SEQ ID NO: 830

SEQ ID NO: 1135 - protein, 8 aa, homo sapiens
MNKGIRGQ

SEQ ID NO: 1136 - DNA, 27 bp, homo sapiens
atgaacaagggcatcagaggccagtag

SEQ ID NO: 1137 - protein, 116 aa, homo sapiens [sequence omitted]

SEQ ID NO: 1138 - DNA, 351 bp, homo sapiens; identical to SEQ ID NO: 826

SEQ ID NO: 1139 - protein, 37 aa, homo sapiens; identical to SEQ ID NO: 827

SEQ ID NO: 1140 - DNA, 114 bp, homo sapiens; identical to SEQ ID NO: 828

SEQ ID NO: 1141 - protein, 28 aa, homo sapiens
MLWWWCLTSSSPEESFMMLRLNRQVLAL

SEQ ID NO: 1142 - DNA, 87 bp, homo sapiens; identical to SEQ ID NO: 830

SEQ ID NO: 1143 - protein, 8 aa, homo sapiens
MNKGIRGQ

SEQ ID NO: 1144 - DNA, 27 bp, homo sapiens
atgaacaagggcatcagaggccagtag

SEQ ID NO: 1145 - protein, 13 aa, homo sapiens
MPATWLPIKPEVL

SEQ ID NO: 1146 - DNA, 42 bp, homo sapiens; identical to SEQ ID NO: 1090

SEQ ID NO: 1147 - protein, 6 aa, homo sapiens
MASYKA

SEQ ID NO: 1148 - DNA, 21 bp, homo sapiens
atggcttcctataaagcctga

SEQ ID NO: 1149 - protein, 12 aa, homo sapiens
MQKWPNTKNWYQ

SEQ ID NO: 1150 - DNA, 39 bp, homo sapiens; identical to SEQ ID NO: 1094

SEQ ID NO: 1151 - protein, 36 aa, homo sapiens; identical to SEQ ID NO: 1095

SEQ ID NO: 1152 - DNA, 111 bp, homo sapiens; identical to SEQ ID NO: 1096

SEQ ID NO: 1153 - protein, 13 aa, homo sapiens
MPATWLPIKPEVL

SEQ ID NO: 1154 - DNA, 42 bp, homo sapiens; identical to SEQ ID NO: 1090

SEQ ID NO: 1155 - protein, 6 aa, homo sapiens
MASYKA

SEQ ID NO: 1156 - DNA, 21 bp, homo sapiens
atggcttcctataaagcctga

SEQ ID NO: 1157 - protein, 12 aa, homo sapiens
MQKWPNTKNWYQ

SEQ ID NO: 1158 - DNA, 39 bp, homo sapiens; identical to SEQ ID NO: 1094

SEQ ID NO: 1159 - protein, 36 aa, homo sapiens; identical to SEQ ID NO: 1095

SEQ ID NO: 1160 - DNA, 111 bp, homo sapiens; identical to SEQ ID NO: 1096

SEQ ID NO: 1161 - protein, 13 aa, homo sapiens
MPATWLPIKPEVL

SEQ ID NO: 1162 - DNA, 42 bp, homo sapiens; identical to SEQ ID NO: 1090

SEQ ID NO: 1163 - protein, 6 aa, homo sapiens
MASYKA

SEQ ID NO: 1164 - DNA, 21 bp, homo sapiens
atggcttcctataaagcctga

SEQ ID NO: 1165 - protein, 12 aa, homo sapiens
MQKWPNTKNWYQ

SEQ ID NO: 1166 - DNA, 39 bp, homo sapiens; identical to SEQ ID NO: 1094

SEQ ID NO: 1167 - protein, 36 aa, homo sapiens; identical to SEQ ID NO: 1095

SEQ ID NO: 1168 - DNA, 111 bp, homo sapiens; identical to SEQ ID NO: 1096

SEQ ID NO: 1169 - protein, 116 aa, homo sapiens [sequence omitted]

SEQ ID NO: 1170 - DNA, 351 bp, homo sapiens; identical to SEQ ID NO: 826

SEQ ID NO: 1171 - protein, 37 aa, homo sapiens; identical to SEQ ID NO: 827

SEQ ID NO: 1172 - DNA, 114 bp, homo sapiens; identical to SEQ ID NO: 828

SEQ ID NO: 1173 - protein, 28 aa, homo sapiens
MLWWWCLTSSSPEESFMMLRLNRQVLAL

SEQ ID NO: 1174 - DNA, 87 bp, homo sapiens; identical to SEQ ID NO: 830

SEQ ID NO: 1175 - protein, 8 aa, homo sapiens
MNKGIRGQ

SEQ ID NO: 1176 - DNA, 27 bp, homo sapiens
atgaacaagggcatcagaggccagtag

SEQ ID NO: 1177 - protein, 116 aa, homo sapiens [sequence omitted]

SEQ ID NO: 1178 - DNA, 351 bp, homo sapiens; identical to SEQ ID NO: 826

SEQ ID NO: 1179 - protein, 37 aa, homo sapiens; identical to SEQ ID NO: 827

SEQ ID NO: 1180 - DNA, 114 bp, homo sapiens; identical to SEQ ID NO: 828

SEQ ID NO: 1181 - protein, 28 aa, homo sapiens
MLWWWCLTSSSPEESFMMLRLNRQVLAL

SEQ ID NO: 1182 - DNA, 87 bp, homo sapiens; identical to SEQ ID NO: 830

SEQ ID NO: 1183 - protein, 8 aa, homo sapiens
MNKGIRGQ

SEQ ID NO: 1184 - DNA, 27 bp, homo sapiens
atgaacaagggcatcagaggccagtag

SEQ ID NO: 1185 - protein, 116 aa, homo sapiens [sequence omitted]

SEQ ID NO: 1186 - DNA, 351 bp, homo sapiens; identical to SEQ ID NO: 826

SEQ ID NO: 1187 - protein, 37 aa, homo sapiens; identical to SEQ ID NO: 827

SEQ ID NO: 1188 - DNA, 114 bp, homo sapiens; identical to SEQ ID NO: 828

SEQ ID NO: 1189 - protein, 28 aa, homo sapiens
MLWWWCLTSSSPEESFMMLRLNRQVLAL

SEQ ID NO: 1190 - DNA, 87 bp, homo sapiens; identical to SEQ ID NO: 830

SEQ ID NO: 1191 - protein, 8 aa, homo sapiens
MNKGIRGQ

SEQ ID NO: 1192 - DNA, 27 bp, homo sapiens
atgaacaagggcatcagaggccagtag

SEQ ID NO: 1193 - protein, 116 aa, homo sapiens [sequence omitted]

SEQ ID NO: 1194 - DNA, 351 bp, homo sapiens; identical to SEQ ID NO: 826

SEQ ID NO: 1195 - protein, 37 aa, homo sapiens; identical to SEQ ID NO: 827

SEQ ID NO: 1196 - DNA, 114 bp, homo sapiens; identical to SEQ ID NO: 828

SEQ ID NO: 1197 - protein, 28 aa, homo sapiens
MLWWWCLTSSSPEESFMMLRLNRQVLAL

SEQ ID NO: 1198 - DNA, 87 bp, homo sapiens; identical to SEQ ID NO: 830

SEQ ID NO: 1199 - protein, 8 aa, homo sapiens
MNKGIRGQ

SEQ ID NO: 1200 - DNA, 27 bp, homo sapiens
atgaacaagggcatcagaggccagtag

SEQ ID NO: 1201 - protein, 116 aa, homo sapiens [sequence omitted]

SEQ ID NO: 1202 - DNA, 351 bp, homo sapiens; identical to SEQ ID NO: 826

SEQ ID NO: 1203 - protein, 37 aa, homo sapiens; identical to SEQ ID NO: 827

SEQ ID NO: 1204 - DNA, 114 bp, homo sapiens; identical to SEQ ID NO: 828

SEQ ID NO: 1205 - protein, 28 aa, homo sapiens
MLWWWCLTSSSPEESFMMLRLNRQVLAL

SEQ ID NO: 1206 - DNA, 87 bp, homo sapiens; identical to SEQ ID NO: 830

SEQ ID NO: 1207 - protein, 8 aa, homo sapiens
MNKGIRGQ

SEQ ID NO: 1208 - DNA, 27 bp, homo sapiens
atgaacaagggcatcagaggccagtag

SEQ ID NO: 1209 - protein, 116 aa, homo sapiens [sequence omitted]

SEQ ID NO: 1210 - DNA, 351 bp, homo sapiens; identical to SEQ ID NO: 826

SEQ ID NO: 1211 - protein, 37 aa, homo sapiens; identical to SEQ ID NO: 827

SEQ ID NO: 1212 - DNA, 114 bp, homo sapiens; identical to SEQ ID NO: 828

SEQ ID NO: 1213 - protein, 28 aa, homo sapiens
MLWWWCLTSSSPEESFMMLRLNRQVLAL

SEQ ID NO: 1214 - DNA, 87 bp, homo sapiens; identical to SEQ ID NO: 830

SEQ ID NO: 1215 - protein, 8 aa, homo sapiens
MNKGIRGQ

SEQ ID NO: 1216 - DNA, 27 bp, homo sapiens
atgaacaagggcatcagaggccagtag

SEQ ID NO: 1217 - protein, 116 aa, homo sapiens [sequence omitted]

SEQ ID NO: 1218 - DNA, 351 bp, homo sapiens; identical to SEQ ID NO: 826

SEQ ID NO: 1219 - protein, 37 aa, homo sapiens; identical to SEQ ID NO: 827

SEQ ID NO: 1220 - DNA, 114 bp, homo sapiens; identical to SEQ ID NO: 828

SEQ ID NO: 1221 - protein, 28 aa, homo sapiens
MLWWWCLTSSSPEESFMMLRLNRQVLAL

SEQ ID NO: 1222 - DNA, 87 bp, homo sapiens; identical to SEQ ID NO: 830

SEQ ID NO: 1223 - protein, 8 aa, homo sapiens
MNKGIRGQ

SEQ ID NO: 1224 - DNA, 27 bp, homo sapiens
atgaacaagggcatcagaggccagtag

SEQ ID NO: 1225 - protein, 116 aa, homo sapiens [sequence omitted]

SEQ ID NO: 1226 - DNA, 351 bp, homo sapiens; identical to SEQ ID NO: 826

SEQ ID NO: 1227 - protein, 37 aa, homo sapiens; identical to SEQ ID NO: 827

SEQ ID NO: 1228 - DNA, 114 bp, homo sapiens; identical to SEQ ID NO: 828

SEQ ID NO: 1229 - protein, 28 aa, homo sapiens
MLWWWCLTSSSPEESFMMLRLNRQVLAL

SEQ ID NO: 1230 - DNA, 87 bp, homo sapiens; identical to SEQ ID NO: 830

SEQ ID NO: 1231 - protein, 8 aa, homo sapiens
MNKGIRGQ

SEQ ID NO: 1232 - DNA, 27 bp, homo sapiens
atgaacaagggcatcagaggccagtag

SEQ ID NO: 1233 - protein, 116 aa, homo sapiens [sequence omitted]

SEQ ID NO: 1234 - DNA, 351 bp, homo sapiens; identical to SEQ ID NO: 826

SEQ ID NO: 1235 - protein, 37 aa, homo sapiens; identical to SEQ ID NO: 827

SEQ ID NO: 1236 - DNA, 114 bp, homo sapiens; identical to SEQ ID NO: 828

SEQ ID NO: 1237 - protein, 28 aa, homo sapiens
MLWWWCLTSSSPEESFMMLRLNRQVLAL

SEQ ID NO: 1238 - DNA, 87 bp, homo sapiens; identical to SEQ ID NO: 830

SEQ ID NO: 1239 - protein, 8 aa, homo sapiens
MNKGIRGQ

SEQ ID NO: 1240 - DNA, 27 bp, homo sapiens
atgaacaagggcatcagaggccagtag

SEQ ID NO: 1241 - protein, 116 aa, homo sapiens [sequence omitted]

SEQ ID NO: 1242 - DNA, 351 bp, homo sapiens; identical to SEQ ID NO: 826

SEQ ID NO: 1243 - protein, 37 aa, homo sapiens; identical to SEQ ID NO: 827

SEQ ID NO: 1244 - DNA, 114 bp, homo sapiens; identical to SEQ ID NO: 828

SEQ ID NO: 1245 - protein, 28 aa, homo sapiens
MLWWWCLTSSSPEESFMMLRLNRQVLAL

SEQ ID NO: 1246 - DNA, 87 bp, homo sapiens; identical to SEQ ID NO: 830

SEQ ID NO: 1247 - protein, 8 aa, homo sapiens
MNKGIRGQ

SEQ ID NO: 1248 - DNA, 27 bp, homo sapiens
atgaacaagggcatcagaggccagtag

SEQ ID NO: 1249 - protein, 116 aa, homo sapiens [sequence omitted]

SEQ ID NO: 1250 - DNA, 351 bp, homo sapiens; identical to SEQ ID NO: 826

SEQ ID NO: 1251 - protein, 37 aa, homo sapiens; identical to SEQ ID NO: 827

SEQ ID NO: 1252 - DNA, 114 bp, homo sapiens; identical to SEQ ID NO: 828

SEQ ID NO: 1253 - protein, 28 aa, homo sapiens
MLWWWCLTSSSPEESFMMLRLNRQVLAL

SEQ ID NO: 1254 - DNA, 87 bp, homo sapiens; identical to SEQ ID NO: 830

SEQ ID NO: 1255 - protein, 8 aa, homo sapiens
MNKGIRGQ

SEQ ID NO: 1256 - DNA, 27 bp, homo sapiens
atgaacaagggcatcagaggccagtag

SEQ ID NO: 1257 - protein, 116 aa, homo sapiens [sequence omitted]

SEQ ID NO: 1258 - DNA, 351 bp, homo sapiens; identical to SEQ ID NO: 826

SEQ ID NO: 1259 - protein, 37 aa, homo sapiens; identical to SEQ ID NO: 827

SEQ ID NO: 1260 - DNA, 114 bp, homo sapiens; identical to SEQ ID NO: 828

SEQ ID NO: 1261 - protein, 28 aa, homo sapiens
MLWWWCLTSSSPEESFMMLRLNRQVLAL

SEQ ID NO: 1262 - DNA, 87 bp, homo sapiens; identical to SEQ ID NO: 830

SEQ ID NO: 1263 - protein, 8 aa, homo sapiens
MNKGIRGQ

SEQ ID NO: 1264 - DNA, 27 bp, homo sapiens
atgaacaagggcatcagaggccagtag

SEQ ID NO: 1265 - protein, 116 aa, homo sapiens [sequence omitted]

SEQ ID NO: 1266 - DNA, 351 bp, homo sapiens; identical to SEQ ID NO: 826

SEQ ID NO: 1267 - protein, 37 aa, homo sapiens; identical to SEQ ID NO: 827

SEQ ID NO: 1268 - DNA, 114 bp, homo sapiens; identical to SEQ ID NO: 828

SEQ ID NO: 1269 - protein, 28 aa, homo sapiens
MLWWWCLTSSSPEESFMMLRLNRQVLAL

SEQ ID NO: 1270 - DNA, 87 bp, homo sapiens; identical to SEQ ID NO: 830

SEQ ID NO: 1271 - protein, 8 aa, homo sapiens
MNKGIRGQ

SEQ ID NO: 1272 - DNA, 27 bp, homo sapiens
atgaacaagggcatcagaggccagtag

SEQ ID NO: 1273 - protein, 116 aa, homo sapiens [sequence omitted]

SEQ ID NO: 1274 - DNA, 351 bp, homo sapiens; identical to SEQ ID NO: 826

SEQ ID NO: 1275 - protein, 37 aa, homo sapiens; identical to SEQ ID NO: 827

SEQ ID NO: 1276 - DNA, 114 bp, homo sapiens; identical to SEQ ID NO: 828

SEQ ID NO: 1277 - protein, 28 aa, homo sapiens
MLWWWCLTSSSPEESFMMLRLNRQVLAL

SEQ ID NO: 1278 - DNA, 87 bp, homo sapiens; identical to SEQ ID NO: 830

SEQ ID NO: 1279 - protein, 8 aa, homo sapiens
MNKGIRGQ

SEQ ID NO: 1280 - DNA, 27 bp, homo sapiens
atgaacaagggcatcagaggccagtag

SEQ ID NO: 1281 - protein, 116 aa, homo sapiens [sequence omitted]

SEQ ID NO: 1282 - DNA, 351 bp, homo sapiens; identical to SEQ ID NO: 826

SEQ ID NO: 1283 - protein, 37 aa, homo sapiens; identical to SEQ ID NO: 827

SEQ ID NO: 1284 - DNA, 114 bp, homo sapiens; identical to SEQ ID NO: 828

SEQ ID NO: 1285 - protein, 28 aa, homo sapiens
MLWWWCLTSSSPEESFMMLRLNRQVLAL

SEQ ID NO: 1286 - DNA, 87 bp, homo sapiens; identical to SEQ ID NO: 830

SEQ ID NO: 1287 - protein, 8 aa, homo sapiens
MNKGIRGQ

SEQ ID NO: 1288 - DNA, 27 bp, homo sapiens
atgaacaagggcatcagaggccagtag

SEQ ID NO: 1289 - protein, 116 aa, homo sapiens [sequence omitted]

SEQ ID NO: 1290 - DNA, 351 bp, homo sapiens; identical to SEQ ID NO: 826

SEQ ID NO: 1291 - protein, 37 aa, homo sapiens; identical to SEQ ID NO: 827

SEQ ID NO: 1292 - DNA, 114 bp, homo sapiens; identical to SEQ ID NO: 828

SEQ ID NO: 1293 - protein, 28 aa, homo sapiens
MLWWWCLTSSSPEESFMMLRLNRQVLAL

SEQ ID NO: 1294 - DNA, 87 bp, homo sapiens; identical to SEQ ID NO: 830

SEQ ID NO: 1295 - protein, 8 aa, homo sapiens
MNKGIRGQ

SEQ ID NO: 1296 - DNA, 27 bp, homo sapiens
atgaacaagggcatcagaggccagtag

SEQ ID NO: 1297 - protein, 116 aa, homo sapiens [sequence omitted]

SEQ ID NO: 1298 - DNA, 351 bp, homo sapiens; identical to SEQ ID NO: 826

SEQ ID NO: 1299 - protein, 37 aa, homo sapiens; identical to SEQ ID NO: 827

SEQ ID NO: 1300 - DNA, 114 bp, homo sapiens; identical to SEQ ID NO: 828

SEQ ID NO: 1301 - protein, 28 aa, homo sapiens
MLWWWCLTSSSPEESFMMLRLNRQVLAL

SEQ ID NO: 1302 - DNA, 87 bp, homo sapiens; identical to SEQ ID NO: 830

SEQ ID NO: 1303 - protein, 8 aa, homo sapiens
MNKGIRGQ

SEQ ID NO: 1304 - DNA, 27 bp, homo sapiens
atgaacaagggcatcagaggccagtag

SEQ ID NO: 1305 - protein, 116 aa, homo sapiens [sequence omitted]

SEQ ID NO: 1306 - DNA, 351 bp, homo sapiens; identical to SEQ ID NO: 826

SEQ ID NO: 1307 - protein, 37 aa, homo sapiens; identical to SEQ ID NO: 827

SEQ ID NO: 1308 - DNA, 114 bp, homo sapiens; identical to SEQ ID NO: 828

SEQ ID NO: 1309 - protein, 28 aa, homo sapiens
MLWWWCLTSSSPEESFMMLRLNRQVLAL

SEQ ID NO: 1310 - DNA, 87 bp, homo sapiens; identical to SEQ ID NO: 830

SEQ ID NO: 1311 - protein, 8 aa, homo sapiens
MNKGIRGQ

SEQ ID NO: 1312 - DNA, 27 bp, homo sapiens
atgaacaagggcatcagaggccagtag

SEQ ID NO: 1313 - protein, 116 aa, homo sapiens [sequence omitted]

SEQ ID NO: 1314 - DNA, 351 bp, homo sapiens; identical to SEQ ID NO: 826

SEQ ID NO: 1315 - protein, 37 aa, homo sapiens; identical to SEQ ID NO: 827

SEQ ID NO: 1316 - DNA, 114 bp, homo sapiens; identical to SEQ ID NO: 828

SEQ ID NO: 1317 - protein, 28 aa, homo sapiens
MLWWWCLTSSSPEESFMMLRLNRQVLAL

SEQ ID NO: 1318 - DNA, 87 bp, homo sapiens; identical to SEQ ID NO: 830

SEQ ID NO: 1319 - protein, 8 aa, homo sapiens
MNKGIRGQ

SEQ ID NO: 1320 - DNA, 27 bp, homo sapiens
atgaacaagggcatcagaggccagtag

SEQ ID NO: 1321 - protein, 116 aa, homo sapiens [sequence omitted]

SEQ ID NO: 1322 - DNA, 351 bp, homo sapiens; identical to SEQ ID NO: 826

SEQ ID NO: 1323 - protein, 37 aa, homo sapiens; identical to SEQ ID NO: 827

SEQ ID NO: 1324 - DNA, 114 bp, homo sapiens; identical to SEQ ID NO: 828

SEQ ID NO: 1325 - protein, 28 aa, homo sapiens
MLWWWCLTSSSPEESFMMLRLNRQVLAL

SEQ ID NO: 1326 - DNA, 87 bp, homo sapiens; identical to SEQ ID NO: 830

SEQ ID NO: 1327 - protein, 8 aa, homo sapiens
MNKGIRGQ

SEQ ID NO: 1328 - DNA, 27 bp, homo sapiens
atgaacaagggcatcagaggccagtag

SEQ ID NO: 1329 - protein, 116 aa, homo sapiens [sequence omitted]

SEQ ID NO: 1330 - DNA, 351 bp, homo sapiens; identical to SEQ ID NO: 826

SEQ ID NO: 1331 - protein, 37 aa, homo sapiens; identical to SEQ ID NO: 827

SEQ ID NO: 1332 - DNA, 114 bp, homo sapiens; identical to SEQ ID NO: 828

SEQ ID NO: 1333 - protein, 28 aa, homo sapiens
MLWWWCLTSSSPEESFMMLRLNRQVLAL

SEQ ID NO: 1334 - DNA, 87 bp, homo sapiens; identical to SEQ ID NO: 830

SEQ ID NO: 1335 - protein, 8 aa, homo sapiens
MNKGIRGQ

SEQ ID NO: 1336 - DNA, 27 bp, homo sapiens
atgaacaagggcatcagaggccagtag

SEQ ID NO: 1337 - protein, 116 aa, homo sapiens [sequence omitted]

SEQ ID NO: 1338 - DNA, 351 bp, homo sapiens; identical to SEQ ID NO: 826

SEQ ID NO: 1339 - protein, 37 aa, homo sapiens; identical to SEQ ID NO: 827

SEQ ID NO: 1340 - DNA, 114 bp, homo sapiens; identical to SEQ ID NO: 828

SEQ ID NO: 1341 - protein, 28 aa, homo sapiens
MLWWWCLTSSSPEESFMMLRLNRQVLAL

SEQ ID NO: 1342 - DNA, 87 bp, homo sapiens; identical to SEQ ID NO: 830

SEQ ID NO: 1343 - protein, 8 aa, homo sapiens
MNKGIRGQ

SEQ ID NO: 1344 - DNA, 27 bp, homo sapiens
atgaacaagggcatcagaggccagtag

SEQ ID NO: 1345 - protein, 116 aa, homo sapiens [sequence omitted]

SEQ ID NO: 1346 - DNA, 351 bp, homo sapiens; identical to SEQ ID NO: 826

SEQ ID NO: 1347 - protein, 37 aa, homo sapiens; identical to SEQ ID NO: 827

SEQ ID NO: 1348 - DNA, 114 bp, homo sapiens; identical to SEQ ID NO: 828

SEQ ID NO: 1349 - protein, 28 aa, homo sapiens
MLWWWCLTSSSPEESFMMLRLNRQVLAL

SEQ ID NO: 1350 - DNA, 87 bp, homo sapiens; identical to SEQ ID NO: 830

SEQ ID NO: 1351 - protein, 8 aa, homo sapiens
MNKGIRGQ

SEQ ID NO: 1352 - DNA, 27 bp, homo sapiens
atgaacaagggcatcagaggccagtag

SEQ ID NO: 1353 - protein, 116 aa, homo sapiens [sequence omitted]

SEQ ID NO: 1354 - DNA, 351 bp, homo sapiens; identical to SEQ ID NO: 826

SEQ ID NO: 1355 - protein, 37 aa, homo sapiens; identical to SEQ ID NO: 827

SEQ ID NO: 1356 - DNA, 114 bp, homo sapiens; identical to SEQ ID NO: 828

SEQ ID NO: 1357 - protein, 28 aa, homo sapiens
MLWWWCLTSSSPEESFMMLRLNRQVLAL

SEQ ID NO: 1358 - DNA, 87 bp, homo sapiens; identical to SEQ ID NO: 830

SEQ ID NO: 1359 - protein, 8 aa, homo sapiens
MNKGIRGQ

SEQ ID NO: 1360 - DNA, 27 bp, homo sapiens
atgaacaagggcatcagaggccagtag

SEQ ID NO: 1361 - protein, 116 aa, homo sapiens [sequence omitted]

SEQ ID NO: 1362 - DNA, 351 bp, homo sapiens; identical to SEQ ID NO: 826

SEQ ID NO: 1363 - protein, 37 aa, homo sapiens; identical to SEQ ID NO: 827

SEQ ID NO: 1364 - DNA, 114 bp, homo sapiens; identical to SEQ ID NO: 828

SEQ ID NO: 1365 - protein, 28 aa, homo sapiens
MLWWWCLTSSSPEESFMMLRLNRQVLAL

SEQ ID NO: 1366 - DNA, 87 bp, homo sapiens; identical to SEQ ID NO: 830

SEQ ID NO: 1367 - protein, 8 aa, homo sapiens
MNKGIRGQ

SEQ ID NO: 1368 - DNA, 27 bp, homo sapiens
atgaacaagggcatcagaggccagtag

SEQ ID NO: 1369 - protein, 116 aa, homo sapiens [sequence omitted]

SEQ ID NO: 1370 - DNA, 351 bp, homo sapiens; identical to SEQ ID NO: 826

SEQ ID NO: 1371 - protein, 37 aa, homo sapiens; identical to SEQ ID NO: 827

SEQ ID NO: 1372 - DNA, 114 bp, homo sapiens; identical to SEQ ID NO: 828

SEQ ID NO: 1373 - protein, 28 aa, homo sapiens
MLWWWCLTSSSPEESFMMLRLNRQVLAL

SEQ ID NO: 1374 - DNA, 87 bp, homo sapiens; identical to SEQ ID NO: 830

SEQ ID NO: 1375 - protein, 8 aa, homo sapiens
MNKGIRGQ

SEQ ID NO: 1376 - DNA, 27 bp, homo sapiens
atgaacaagggcatcagaggccagtag

SEQ ID NO: 1377 - protein, 116 aa, homo sapiens [sequence omitted]

SEQ ID NO: 1378 - DNA, 351 bp, homo sapiens; identical to SEQ ID NO: 826

SEQ ID NO: 1379 - protein, 37 aa, homo sapiens; identical to SEQ ID NO: 827

SEQ ID NO: 1380 - DNA, 114 bp, homo sapiens; identical to SEQ ID NO: 828

SEQ ID NO: 1381 - protein, 28 aa, homo sapiens
MLWWWCLTSSSPEESFMMLRLNRQVLAL

SEQ ID NO: 1382 - DNA, 87 bp, homo sapiens; identical to SEQ ID NO: 830

SEQ ID NO: 1383 - protein, 8 aa, homo sapiens
MNKGIRGQ

SEQ ID NO: 1384 - DNA, 27 bp, homo sapiens
atgaacaagggcatcagaggccagtag

SEQ ID NO: 1385 - protein, 116 aa, homo sapiens [sequence omitted]

SEQ ID NO: 1386 - DNA, 351 bp, homo sapiens; identical to SEQ ID NO: 826

SEQ ID NO: 1387 - protein, 37 aa, homo sapiens; identical to SEQ ID NO: 827

SEQ ID NO: 1388 - DNA, 114 bp, homo sapiens; identical to SEQ ID NO: 828

SEQ ID NO: 1389 - protein, 28 aa, homo sapiens
MLWWWCLTSSSPEESFMMLRLNRQVLAL

SEQ ID NO: 1390 - DNA, 87 bp, homo sapiens; identical to SEQ ID NO: 830

SEQ ID NO: 1391 - protein, 8 aa, homo sapiens
MNKGIRGQ

SEQ ID NO: 1392 - DNA, 27 bp, homo sapiens
atgaacaagggcatcagaggccagtag

SEQ ID NO: 1393 - protein, 116 aa, homo sapiens [sequence omitted]

SEQ ID NO: 1394 - DNA, 351 bp, homo sapiens; identical to SEQ ID NO: 826

SEQ ID NO: 1395 - protein, 37 aa, homo sapiens; identical to SEQ ID NO: 827

SEQ ID NO: 1396 - DNA, 114 bp, homo sapiens; identical to SEQ ID NO: 828

SEQ ID NO: 1397 - protein, 28 aa, homo sapiens
MLWWWCLTSSSPEESFMMLRLNRQVLAL

SEQ ID NO: 1398 - DNA, 87 bp, homo sapiens; identical to SEQ ID NO: 830

SEQ ID NO: 1399 - protein, 8 aa, homo sapiens
MNKGIRGQ

SEQ ID NO: 1400 - DNA, 27 bp, homo sapiens
atgaacaagggcatcagaggccagtag

SEQ ID NO: 1401 - protein, 116 aa, homo sapiens [sequence omitted]

SEQ ID NO: 1402 - DNA, 351 bp, homo sapiens; identical to SEQ ID NO: 826

SEQ ID NO: 1403 - protein, 37 aa, homo sapiens; identical to SEQ ID NO: 827

SEQ ID NO: 1404 - DNA, 114 bp, homo sapiens; identical to SEQ ID NO: 828

SEQ ID NO: 1405 - protein, 28 aa, homo sapiens
MLWWWCLTSSSPEESFMMLRLNRQVLAL

SEQ ID NO: 1406 - DNA, 87 bp, homo sapiens; identical to SEQ ID NO: 830

SEQ ID NO: 1407 - protein, 8 aa, homo sapiens
MNKGIRGQ

SEQ ID NO: 1408 - DNA, 27 bp, homo sapiens
atgaacaagggcatcagaggccagtag

SEQ ID NO: 1409 - protein, 116 aa, homo sapiens [sequence omitted]

SEQ ID NO: 1410 - DNA, 351 bp, homo sapiens; identical to SEQ ID NO: 826

SEQ ID NO: 1411 - protein, 37 aa, homo sapiens; identical to SEQ ID NO: 827

SEQ ID NO: 1412 - DNA, 114 bp, homo sapiens; identical to SEQ ID NO: 828

SEQ ID NO: 1413 - protein, 28 aa, homo sapiens
MLWWWCLTSSSPEESFMMLRLNRQVLAL

SEQ ID NO: 1414 - DNA, 87 bp, homo sapiens; identical to SEQ ID NO: 830

SEQ ID NO: 1415 - protein, 8 aa, homo sapiens
MNKGIRGQ

SEQ ID NO: 1416 - DNA, 27 bp, homo sapiens
atgaacaagggcatcagaggccagtag

SEQ ID NO: 1417 - protein, 116 aa, homo sapiens [sequence omitted]

SEQ ID NO: 1418 - DNA, 351 bp, homo sapiens; identical to SEQ ID NO: 826

SEQ ID NO: 1419 - protein, 37 aa, homo sapiens; identical to SEQ ID NO: 827

SEQ ID NO: 1420 - DNA, 114 bp, homo sapiens; identical to SEQ ID NO: 828

SEQ ID NO: 1421 - protein, 28 aa, homo sapiens
MLWWWCLTSSSPEESFMMLRLNRQVLAL

SEQ ID NO: 1422 - DNA, 87 bp, homo sapiens; identical to SEQ ID NO: 830

SEQ ID NO: 1423 - protein, 8 aa, homo sapiens
MNKGIRGQ

SEQ ID NO: 1424 - DNA, 27 bp, homo sapiens
atgaacaagggcatcagaggccagtag

SEQ ID NO: 1425 - protein, 116 aa, homo sapiens [sequence omitted]

SEQ ID NO: 1426 - DNA, 351 bp, homo sapiens; identical to SEQ ID NO: 826

SEQ ID NO: 1427 - protein, 37 aa, homo sapiens; identical to SEQ ID NO: 827

SEQ ID NO: 1428 - DNA, 114 bp, homo sapiens; identical to SEQ ID NO: 828

SEQ ID NO: 1429 - protein, 28 aa, homo sapiens
MLWWWCLTSSSPEESFMMLRLNRQVLAL

SEQ ID NO: 1430 - DNA, 87 bp, homo sapiens; identical to SEQ ID NO: 830

SEQ ID NO: 1431 - protein, 8 aa, homo sapiens
MNKGIRGQ

SEQ ID NO: 1432 - DNA, 27 bp, homo sapiens
atgaacaagggcatcagaggccagtag

SEQ ID NO: 1433 - protein, 116 aa, homo sapiens [sequence omitted]

SEQ ID NO: 1434 - DNA, 351 bp, homo sapiens; identical to SEQ ID NO: 826

SEQ ID NO: 1435 - protein, 37 aa, homo sapiens; identical to SEQ ID NO: 827

SEQ ID NO: 1436 - DNA, 114 bp, homo sapiens; identical to SEQ ID NO: 828

SEQ ID NO: 1437 - protein, 28 aa, homo sapiens
MLWWWCLTSSSPEESFMMLRLNRQVLAL

SEQ ID NO: 1438 - DNA, 87 bp, homo sapiens; identical to SEQ ID NO: 830

SEQ ID NO: 1439 - protein, 8 aa, homo sapiens
MNKGIRGQ

SEQ ID NO: 1440 - DNA, 27 bp, homo sapiens
atgaacaagggcatcagaggccagtag

SEQ ID NO: 1441 - protein, 116 aa, homo sapiens [sequence omitted]

SEQ ID NO: 1442 - DNA, 351 bp, homo sapiens; identical to SEQ ID NO: 826

SEQ ID NO: 1443 - protein, 37 aa, homo sapiens; identical to SEQ ID NO: 827

SEQ ID NO: 1444 - DNA, 114 bp, homo sapiens; identical to SEQ ID NO: 828

SEQ ID NO: 1445 - protein, 28 aa, homo sapiens
MLWWWCLTSSSPEESFMMLRLNRQVLAL

SEQ ID NO: 1446 - DNA, 87 bp, homo sapiens; identical to SEQ ID NO: 830

SEQ ID NO: 1447 - protein, 8 aa, homo sapiens
MNKGIRGQ

SEQ ID NO: 1448 - DNA, 27 bp, homo sapiens
atgaacaagggcatcagaggccagtag

SEQ ID NO: 1449 - protein, 13 aa, homo sapiens
MPNPGSMMTTGGV

SEQ ID NO: 1450 - DNA, 42 bp, homo sapiens; identical to SEQ ID NO: 202

SEQ ID NO: 1451 - protein, 4 aa, homo sapiens
MSHT

SEQ ID NO: 1452 - DNA, 15 bp, homo sapiens
atgagtcatacatga

SEQ ID NO: 1453 - protein, 8 aa, homo sapiens
MMNMCLEL

SEQ ID NO: 1454 - DNA, 27 bp, homo sapiens
atgatgaatatgtgtctggaactctga

SEQ ID NO: 1455 - protein, 14 aa, homo sapiens
MHSYVIIMIGSMKE

SEQ ID NO: 1456 - DNA, 45 bp, homo sapiens; identical to SEQ ID NO: 208

SEQ ID NO: 1457 - protein, 13 aa, homo sapiens
MPNPGSMMTTGGV

SEQ ID NO: 1458 - DNA, 42 bp, homo sapiens; identical to SEQ ID NO: 202

SEQ ID NO: 1459 - protein, 4 aa, homo sapiens
MSHT

SEQ ID NO: 1460 - DNA, 15 bp, homo sapiens
atgagtcatacatga

SEQ ID NO: 1461 - protein, 8 aa, homo sapiens
MMNMCLEL

SEQ ID NO: 1462 - DNA, 27 bp, homo sapiens
atgatgaatatgtgtctggaactctga

SEQ ID NO: 1463 - protein, 14 aa, homo sapiens
MHSYVIIMIGSMKE

SEQ ID NO: 1464 - DNA, 45 bp, homo sapiens; identical to SEQ ID NO: 208

SEQ ID NO: 1465 - protein, 13 aa, homo sapiens
MPNPGSMMTTGGV

SEQ ID NO: 1466 - DNA, 42 bp, homo sapiens; identical to SEQ ID NO: 202

SEQ ID NO: 1467 - protein, 4 aa, homo sapiens
MSHT

SEQ ID NO: 1468 - DNA, 15 bp, homo sapiens
atgagtcatacatga

SEQ ID NO: 1469 - protein, 8 aa, homo sapiens
MMNMCLEL

SEQ ID NO: 1470 - DNA, 27 bp, homo sapiens
atgatgaatatgtgtctggaactctga

SEQ ID NO: 1471 - protein, 14 aa, homo sapiens
MHSYVIIMIGSMKE

SEQ ID NO: 1472 - DNA, 45 bp, homo sapiens; identical to SEQ ID NO: 208

SEQ ID NO: 1473 - protein, 13 aa, homo sapiens
MPNPGSMMTTGGV

SEQ ID NO: 1474 - DNA, 42 bp, homo sapiens; identical to SEQ ID NO: 202

SEQ ID NO: 1475 - protein, 4 aa, homo sapiens
MSHT

SEQ ID NO: 1476 - DNA, 15 bp, homo sapiens
atgagtcatacatga

SEQ ID NO: 1477 - protein, 8 aa, homo sapiens
MMNMCLEL

SEQ ID NO: 1478 - DNA, 27 bp, homo sapiens
atgatgaatatgtgtctggaactctga

SEQ ID NO: 1479 - protein, 14 aa, homo sapiens
MHSYVIIMIGSMKE

SEQ ID NO: 1480 - DNA, 45 bp, homo sapiens; identical to SEQ ID NO: 208

SEQ ID NO: 1481 - protein, 36 aa, homo sapiens
MARFRLTATSASRVQAILLPQSPEKLGLQAPATTPS

SEQ ID NO: 1482 - DNA, 111 bp, homo sapiens
atggcacgatttcggctcactgcaacctctgcctcccgggttcaagcgattctcctgcctcagtctcccgagaagctgggattacaggcacccgccaccacgcccagctaa

SEQ ID NO: 1483 - protein, 9 aa, homo sapiens
MLVRLVLNS

SEQ ID NO: 1484 - DNA, 30 bp, homo sapiens
atgttggtcaggctggtcttgaactcctga

SEQ ID NO: 1485 - protein, 11 aa, homo sapiens
MSTGKQRHKEA

SEQ ID NO: 1486 - DNA, 36 bp, homo sapiens
atgtcaactggaaaacagaggcacaaagaggcttag

SEQ ID NO: 1487 - protein, 22 aa, homo sapiens
MVLGWNSEGLVLNSLLFTIFCQ

SEQ ID NO: 1488 - DNA, 69 bp, homo sapiens
atggtgctgggttggaactcagaaggtcttgttctaaattccctacttttcaccattttttgccaataa

SEQ ID NO: 1489 - protein, 9 aa, homo sapiens
MQPRIPELE

SEQ ID NO: 1490 - DNA, 30 bp, homo sapiens
atgcagcctcgaattcctgagctcgagtga

SEQ ID NO: 1491 - protein, 15 aa, homo sapiens
MFSRDGVSPCWPDWS

SEQ ID NO: 1492 - DNA, 48 bp, homo sapiens
atgtttagtagagatggggtttcaccatgttggccggactggtcttga

SEQ ID NO: 1493 - protein, 59 aa, homo sapiens
MGFHHVGRTGLELLTSGDPACLGLPKCWDDTCEPLCPAKKKKKNSFFRDRVFLYCPDWS

SEQ ID NO: 1494 - DNA, 180 bp, homo sapiens
atggggtttcaccatgttggccggactggtcttgaactcctgacctcaggtgatcctgcctgcctcggcctcccaaagtgctgggatgatacatgtgagccactgtgcccagccaaaaaaaaaaaaaaaaattctttttttagagatagagtcttcctgtattgcccagactggtcttaa

SEQ ID NO: 1495 - protein, 9 aa, homo sapiens
MLAGLVLNS

SEQ ID NO: 1496 - DNA, 30 bp, homo sapiens
atgttggccggactggtcttgaactcctga

SEQ ID NO: 1497 - protein, 38 aa, homo sapiens
MVFHQRGFVVENGREGMNKQPRLLVSRKEVEQGLLCLF

SEQ ID NO: 1498 - DNA, 117 bp, homo sapiens
atggtctttcatcaaagggggtttgttgttgaaaacggcagagaagggatgaataagcagccaaggctcttggtttcccgaaaagaggttgaacagggactgctgtgtctcttttag

SEQ ID NO: 1499 - protein, 5 aa, homo sapiens
MKVQI

SEQ ID NO: 1500 - DNA, 18 bp, homo sapiens
atgaaagtacagatttag

SEQ ID NO: 1501 - protein, 28 aa, homo sapiens
MKPVSNTKGCPEAHTAFISFQYSKSNIY

SEQ ID NO: 1502 - DNA, 87 bp, homo sapiens
atgaagcctgtttctaacaccaaaggctgcccagaggcccacacagccttcatttcattccaatattccaaatccaacatctactga

SEQ ID NO: 1503 - protein, 18 aa, homo sapiens
MPSLSTGRTQRQPTGLTW

SEQ ID NO: 1504 - DNA, 57 bp, homo sapiens
atgccatcactctcaacaggaaggacccagaggcagcccacaggcctgacttggtga

SEQ ID NO: 1505 - protein, 23 aa, homo sapiens
MWRDVFAFPSAMIVVYLGQHQPS

SEQ ID NO: 1506 - DNA, 72 bp, homo sapiens
atgtggagggatgtgtttgctttcccttctgccatgattgtagtttacctgggacaacaccagccatcctga

SEQ ID NO: 1507 - protein, 8 aa, homo sapiens
MCLLSLLP

SEQ ID NO: 1508 - DNA, 27 bp, homo sapiens
atgtgtttgctttcccttctgccatga

SEQ ID NO: 1509 - protein, 6 aa, homo sapiens
MSLLAM

SEQ ID NO: 1510 - DNA, 21 bp, homo sapiens
atgtctttattagcaatgtga

SEQ ID NO: 1511 - protein, 7 aa, homo sapiens
MWKQIWK

SEQ ID NO: 1512 - DNA, 24 bp, homo sapiens
atgtggaagcaaatttggaagtga

SEQ ID NO: 1513 - protein, 7 aa, homo sapiens
MAPEELR

SEQ ID NO: 1514 - DNA, 24 bp, homo sapiens
atggctccggaggagctgaggtag

SEQ ID NO: 1515 - protein, 17 aa, homo sapiens
MGYGRVFFLMSFAVDHS

SEQ ID NO: 1516 - DNA, 54 bp, homo sapiens
atgggctacggccgtgttttctttttgatgtcctttgcagtggatcacagctag

SEQ ID NO: 1517 - protein, 16 aa, homo sapiens
MALCTCTVAKAYLLSV

SEQ ID NO: 1518 - DNA, 51 bp, homo sapiens
atggctttatgtacatgcacagtagcaaaggcgtacttgctgtcagtgtaa

SEQ ID NO: 1519 - protein, 25 aa, homo sapiens
MYMHSSKGVLAVSVNVNTFTLYRRA

SEQ ID NO: 1520 - DNA, 78 bp, homo sapiens
atgtacatgcacagtagcaaaggcgtacttgctgtcagtgtaaatgttaatacgtttactctttatcggagagcctga

SEQ ID NO: 1521 - protein, 13 aa, homo sapiens
MGAAHQHVTCIHM

SEQ ID NO: 1522 - DNA, 42 bp, homo sapiens
atgggtgcagcacaccaacatgtcacatgtatacatatgtaa

SEQ ID NO: 1523 - protein, 17 aa, homo sapiens
MSHVYICNKPACHAHVP

SEQ ID NO: 1524 - DNA, 54 bp, homo sapiens
atgtcacatgtatacatatgtaacaaacctgcatgtcatgcacatgtgccctag

SEQ ID NO: 1525 - protein, 17 aa, homo sapiens
MYTYVTNLHVMHMCPRT

SEQ ID NO: 1526 - DNA, 54 bp, homo sapiens
atgtatacatatgtaacaaacctgcatgtcatgcacatgtgccctagaacttaa

SEQ ID NO: 1527 - protein, 11 aa, homo sapiens
MSCTCALELNV

SEQ ID NO: 1528 - DNA, 36 bp, homo sapiens
atgtcatgcacatgtgccctagaacttaatgtataa

SEQ ID NO: 1529 - protein, 57 aa, homo sapiens
MHSKGLLPFLMAPVFLSSLQFCNIQEGLRVAVLGLAWEPVKYHLHRVLCRIGESHCS

SEQ ID NO: 1530 - DNA, 174 bp, homo sapiens
atgcacagcaaaggccttcttccatttcttatggcccccgtgttcctgtcttcactacagttctgcaacatacaggaggggctgagagtagcagtcctggggttggcatgggaaccagtgaagtatcatttgcatcgtgttttatgtagaattggggaatctcattgttcctag

SEQ ID NO: 1531 - protein, 13 aa, homo sapiens
MGTSEVSFASCFM

SEQ ID NO: 1532 - DNA, 42 bp, homo sapiens
atgggaaccagtgaagtatcatttgcatcgtgttttatgtag

SEQ ID NO: 1533 - protein, 71 aa, homo sapiens
MEAEKLQPWTCPCTAAWALNTKRSLHFFFFSEELLDLMTPGFIIMVTIYHGGRRCQGLSSLLLSRNVHPPG

SEQ ID NO: 1534 - DNA, 216 bp, homo sapiens
atggaggctgagaagctacagccttggacttgtccttgcactgctgcgtgggccttgaacacaaagaggagcctgcattttttttttttttctgaagagctgctggacttgatgactcctggattcatcatcatggtgacgatttatcacggggggagacgatgtcaaggactgtcatctctgctgttgtccaggaatgtccaccctccaggataa

SEQ ID NO: 1535 - protein, 22 aa, homo sapiens
MSRTVISAVVQECPPSRIILTQ

SEQ ID NO: 1536 - DNA, 69 bp, homo sapiens
atgtcaaggactgtcatctctgctgttgtccaggaatgtccaccctccaggataatcctcacccagtga

SEQ ID NO: 1537 - protein, 23 aa, homo sapiens
MGTITPLPAYLSPRLTGKSKCLI

SEQ ID NO: 1538 - DNA, 72 bp, homo sapiens
atgggaacaataacaccactccctgcctatctctcaccaaggcttactgggaagagtaaatgcttgatttga

SEQ ID NO: 1539 - protein, 22 aa, homo sapiens
MLDLSHFSAPGRQNNDLEIKPG

SEQ ID NO: 1540 - DNA, 69 bp, homo sapiens
atgcttgatttgagccatttctctgcccctggtagacaaaataatgatcttgaaatcaagcctgggtga

SEQ ID NO: 1541 - protein, 37 aa, homo sapiens
MILKSSLGELGEGGQESPSSFLVVVREASMFPPSFVT

SEQ ID NO: 1542 - DNA, 114 bp, homo sapiens
atgatcttgaaatcaagcctgggtgagcttggggaaggtgggcaagaatctccctccagctttcttgtggtggtcagagaagcttctatgtttcccccttcctttgtgacctag

SEQ ID NO: 1543 - protein, 62 aa, homo sapiens
MPWLLEDWIACTGSTKILFWLRTQKSIFVDTRNHRNRKAELRGLVPMGQKSSLTNCDAETLL

SEQ ID NO: 1544 - DNA, 189 bp, homo sapiens
atgccgtggctcctggaggactggattgcctgcacagggtccactaagatccttttctggctaaggacccaaaagtctatctttgtggacaccagaaaccacagaaacaggaaagcagagctcagaggtcttgttcccatgggacagaaatcttccctgacaaattgtgatgcagaaacccttctctga

SEQ ID NO: 1545 - protein, 12 aa, homo sapiens
MHAACLPSLLWL

SEQ ID NO: 1546 - DNA, 39 bp, homo sapiens
atgcacgcagcatgccttcccagcctcctgtggttgtag

SEQ ID NO: 1547 - protein, 22 aa, homo sapiens
MPSQPPVVVECIEGSWITMDSG

SEQ ID NO: 1548 - DNA, 69 bp, homo sapiens
atgccttcccagcctcctgtggttgtagagtgtatagaaggcagttggatcactatggacagcgggtaa

SEQ ID NO: 1549 - protein, 31 aa, homo sapiens
MEDPEGKKGLLLVGSPVKSTYKLIRHNAISR

SEQ ID NO: 1550 - DNA, 96 bp, homo sapiens
atggaggaccctgaaggtaagaaagggctcttacttgttggaagcccagttaaatccacttacaaattaattagacacaatgccatttccagatga

SEQ ID NO: 1551 - protein, 21 aa, homo sapiens
MPFPDESSGKATVVRACSRSS

SEQ ID NO: 1552 - DNA, 66 bp, homo sapiens
atgccatttccagatgagagttctgggaaggctactgtggttagggcttgttctcgttcctcctag

SEQ ID NO: 1553 - protein, 42 aa, homo sapiens [sequence omitted]

SEQ ID NO: 1554 - DNA, 129 bp, homo sapiens
atggagttaggtgagctgctctacaacaagtctgagtatatcaagacggcatctgggaacaaagtcagtctccagtcagtgttgtgtggaagccagaacatacttctcaatcgcaagaccatgtggtga

SEQ ID NO: 1555 - protein, 11 aa, homo sapiens
MTVLSEGIWKT

SEQ ID NO: 1556 - DNA, 36 bp, homo sapiens
atgactgtattatctgaggggatctggaaaacataa

SEQ ID NO: 1557 - protein, 6 aa, homo sapiens
MDSIVL

SEQ ID NO: 1558 - DNA, 21 bp, homo sapiens
atggactccattgtgttgtga

SEQ ID NO: 1559 - protein, 25 aa, homo sapiens
MSLLRKSVWSTQLRLVLAFMLARTA

SEQ ID NO: 1560 - DNA, 78 bp, homo sapiens
atgtctttattgaggaagagtgtgtggtcaacgcagctcagattggttcttgcattcatgttggcaagaactgcgtga

SEQ ID NO: 1561 - protein, 11 aa, homo sapiens
MGEPDLHVEKA

SEQ ID NO: 1562 - DNA, 36 bp, homo sapiens
atgggcgagccggacttgcacgtggagaaagcgtga

SEQ ID NO: 1563 - protein, 36 aa, homo sapiens
MCPWVWGGWGAKEWDERWSRNGGRCCPPRGLQAETG

SEQ ID NO: 1564 - DNA, 111 bp, homo sapiens
atgtgcccctgggtttggggagggtggggagccaaggagtgggatgagaggtggtcacggaatggggggcgctgctgtcctccccgggggctgcaggccgagaccgggtga

SEQ ID NO: 1565 - protein, 26 aa, homo sapiens
MRGGHGMGGAAVLPGGCRPRPGEGRG

SEQ ID NO: 1566 - DNA, 81 bp, homo sapiens
atgagaggtggtcacggaatggggggcgctgctgtcctccccgggggctgcaggccgagaccgggtgaggggcgggggtga

SEQ ID NO: 1567 - protein, 31 aa, homo sapiens
MLALWTEGRRLRSRTGCGRPIVFLPVVPIRS

SEQ ID NO: 1568 - DNA, 96 bp, homo sapiens
atgctggcactctggacggaagggcgtcgtcttcgcagccgaacaggttgtggacgcccaatcgtttttctgcccgtagtcccaatccgaagctaa

SEQ ID NO: 1569 - protein, 12 aa, homo sapiens
MPPEPAVHEESA

SEQ ID NO: 1570 - DNA, 39 bp, homo sapiens
atgcctcctgagcctgcagtgcatgaagagagtgcttga

SEQ ID NO: 1571 - protein, 34 aa, homo sapiens
MKRVLELTQPPGLLGLDITSHWNSSSLFPLFVFS

SEQ ID NO: 1572 - DNA, 105 bp, homo sapiens
atgaagagagtgcttgagctgacccagccaccaggccttctggggctagacataacttcccactggaacagcagcagcctctttcccctctttgtgttttcatga

SEQ ID NO: 1573 - protein, 44 aa, homo sapiens
MKKTAVLLGSQEIDYMGQTFKSNLYPGAQATYRGRKGARKSPCS

SEQ ID NO: 1574 - DNA, 135 bp, homo sapiens
atgaagaaaacggctgttctcttaggtagccaggaaatagattacatggggcaaactttcaaaagcaatctctaccctggtgctcaggctacatacagaggcagaaaaggggcacggaagagcccttgctcttga

SEQ ID NO: 1575 - protein, 31 aa, homo sapiens
MWKLLIQSIISSTEYQDDQPDQNIAKSFLSL

SEQ ID NO: 1576 - DNA, 96 bp, homo sapiens
atgtggaaactactaatccaaagcatcatttctagcactgagtatcaagacgatcagcctgaccaaaatattgcaaagagttttctaagtctctga

SEQ ID NO: 1577 - protein, 6 aa, homo sapiens
MRWKVG

SEQ ID NO: 1578 - DNA, 21 bp, homo sapiens
atgcggtggaaggtcggctga

SEQ ID NO: 1579 - protein, 10 aa, homo sapiens
MDRARWPSSV

SEQ ID NO: 1580 - DNA, 33 bp, homo sapiens
atggaccgagcacggtggccgagctcagtttga

SEQ ID NO: 1581 - protein, 25 aa, homo sapiens
MGYPRGADTGRLRLLEEKRGVGFLS

SEQ ID NO: 1582 - DNA, 78 bp, homo sapiens
atgggttaccccagaggggcggatacgggaagattaaggttgttggaggagaaacgtggagtaggctttttgtcttga

SEQ ID NO: 1583 - protein, 4 aa, homo sapiens
MNCA

SEQ ID NO: 1584 - DNA, 15 bp, homo sapiens
atgaactgtgcctga

SEQ ID NO: 1585 - protein, 23 aa, homo sapiens
MRKNILRRSMLSTNLKFSYKPGL

SEQ ID NO: 1586 - DNA, 72 bp, homo sapiens
atgaggaagaacattctgaggcgcagcatgttaagcacaaatttaaagttttcatacaagcctggcttatag

SEQ ID NO: 1587 - protein, 23 aa, homo sapiens
MKNRFYNLIVVLIKNSLLNMLQH

SEQ ID NO: 1588 - DNA, 72 bp, homo sapiens
atgaaaaatagattttataacttgattgtggtactaataaaaaacagccttttaaacatgttacagcactaa

SEQ ID NO: 1589 - protein, 13 aa, homo sapiens
MVNDFKFLAIKKG

SEQ ID NO: 1590 - DNA, 42 bp, homo sapiens
atggtgaacgatttcaagtttttagcaatcaagaaaggttga

SEQ ID NO: 1591 - protein, 6 aa, homo sapiens
MQHIFI

SEQ ID NO: 1592 - DNA, 21 bp, homo sapiens
atgcaacatatatttatatga

SEQ ID NO: 1593 - protein, 11 aa, homo sapiens
MCSHCSTPTYE

SEQ ID NO: 1594 - DNA, 36 bp, homo sapiens
atgtgttctcattgttcaactcccacttatgagtga

SEQ ID NO: 1595 - protein, 10 aa, homo sapiens
MSENMRCLLF

SEQ ID NO: 1596 - DNA, 33 bp, homo sapiens
atgagtgagaacatgcggtgtttgcttttctga

SEQ ID NO: 1597 - protein, 21 aa, homo sapiens
MVSSFIHVPAKDMNSSFFMAA

SEQ ID NO: 1598 - DNA, 66 bp, homo sapiens
atggtttccagcttcatccatgtccctgcaaaggacatgaactcatccttttttatggctgcatag

SEQ ID NO: 1599 - protein, 6 aa, homo sapiens
MSLQRT

SEQ ID NO: 1600 - DNA, 21 bp, homo sapiens
atgtccctgcaaaggacatga

SEQ ID NO: 1601 - protein, 21 aa, homo sapiens
MQRQMQEECDLYYNESKNIFK

SEQ ID NO: 1602 - DNA, 66 bp, homo sapiens
atgcagcggcagatgcaagaagaatgtgacttatattataatgaaagcaaaaatattttcaaatag

SEQ ID NO: 1603 - protein, 32 aa, homo sapiens
MKAKIFSNRFRGLINRRSGYECQPKGEQRKRS

SEQ ID NO: 1604 - DNA, 99 bp, homo sapiens
atgaaagcaaaaatattttcaaatagattcagggggctaataaacagaaggtctggctatgagtgtcagcctaaaggagagcagagaaaaagatcctag

SEQ ID NO: 1605 - protein, 20 aa, homo sapiens
MSVSLKESREKDPRVLSQAR

SEQ ID NO: 1606 - DNA, 63 bp, homo sapiens
atgagtgtcagcctaaaggagagcagagaaaaagatcctagagttctcagccaggcaagatga

SEQ ID NO: 1607 - protein, 12 aa, homo sapiens
MTAYNTQLSYRE

SEQ ID NO: 1608 - DNA, 39 bp, homo sapiens
atgactgcttacaatacacagctttcatatagggagtga

SEQ ID NO: 1609 - protein, 39 aa, homo sapiens
MAAAALRRPTRPIPGCCLGHCPCVFLFYFRTLIKTQTDE

SEQ ID NO: 1610 - DNA, 120 bp, homo sapiens
atggcagctgctgcccttcggaggccgacccgacccatccctgggtgctgtctaggtcactgtccttgtgtgtttttgttttactttagaactcttataaagacacaaaccgatgagtag

SEQ ID NO: 1611 - protein, 67 aa, homo sapiens [sequence omitted]

SEQ ID NO: 1612 - DNA, 204 bp, homo sapiens
atgagtagagacaaactcacactaggaaatggactgggtgtggtttgcaaagcggggagcgcggtctgtgtccggaaccctctgagctcaggcagcgtcctgggctgtttcctggggcagcggccacagccgtcctatctgcagagcatcctgctttcctggagggcatctgcgatggcccccaggctgtactgttccctgtaa

SEQ ID NO: 1613 - protein, 18 aa, homo sapiens
MDWVWFAKRGARSVSGTL

SEQ ID NO: 1614 - DNA, 57 bp, homo sapiens
atggactgggtgtggtttgcaaagcggggagcgcggtctgtgtccggaaccctctga

SEQ ID NO: 1615 - protein, 51 aa, homo sapiens [sequence omitted]

SEQ ID NO: 1616 - DNA, 156 bp, homo sapiens
atgtgttgccccagggagcccggccgggtgatgcctcggggtgactggggacggcaggagggaggggaaggcagggcgcggagcagtgaggtcggcagcttcttcccagcgctcgtcgacactccagcctcttcagccacgtctggggttgcgtga

SEQ ID NO: 1617 - protein, 195 aa, homo sapiens [sequence omitted]

SEQ ID NO: 1618 - DNA, 588 bp, homo sapiens
atgagcttgtggcgccacgaatccagttcttgccgaaagccgcgtctctcaacggagcattgctgccgcctacacaccctcgccatcttctgccgcccgcccggcccagcctccgccgcggccccgcgcacgcccagccgcgtcgcccggggccgcgcacgcacccgcggcccgggcgtcgcgcctcctgccgggggcggtgcgggggcagggccggcctcacctcaccgtggccccggcgtggcccgggggcggcctgggcccgctcacccgccccgcgcgccgcccgccgggctgcgatcccgccgtccttctacgcggctgccgccgcctctggccgcccgggacggcgccttcccacagccggaagtcagtcccgctggccccgcgccgccttcgcactgtcccccaaggccacggctgcccccgccctccccggggctttttgttttttacgccagccccatttatcacttccaacctgcctatcgcccggcaccaactgttgcaagttccgtaataactgctgctatgaacttctccgtcgaaactgctcctccccagagcctgtttaagaagcagaaataa

SEQ ID NO: 1619 - protein, 19 aa, homo sapiens
MPVDALTSKIFKGEVDTRY

SEQ ID NO: 1620 - DNA, 60 bp, homo sapiens
atgccggtggatgcactgacctctaagattttcaaaggtgaagtggatacacgttattaa

SEQ ID NO: 1621 - protein, 11 aa, homo sapiens
MSKPLGIIESP

SEQ ID NO: 1622 - DNA, 36 bp, homo sapiens
atgagcaagcctcttggaataattgaatcaccttaa

SEQ ID NO: 1623 - protein, 29 aa, homo sapiens
MGNERRKGKEMGWKEKSRRDRPIPVGLVP

SEQ ID NO: 1624 - DNA, 90 bp, homo sapiens
atgggaaacgaaaggagaaagggaaaagaaatggggtggaaagaaaaaagcagaagagatcgccctataccagtaggcctagtaccctag

SEQ ID NO: 1625 - protein, 23 aa, homo sapiens
MSKGPKKNVFMVVFCMTHPEYAL

SEQ ID NO: 1626 - DNA, 72 bp, homo sapiens
atgtcgaagggaccaaaaaaaaatgtgtttatggtggttttctgtatgacacatcctgaatatgctctataa

SEQ ID NO: 1627 - protein, 8 aa, homo sapiens
MCLWWFSV

SEQ ID NO: 1628 - DNA, 27 bp, homo sapiens
atgtgtttatggtggttttctgtatga

SEQ ID NO: 1629 - protein, 27 aa, homo sapiens
MLYKYGITSVRAERDLKDYSHTLPARF

SEQ ID NO: 1630 - DNA, 84 bp, homo sapiens
atgctctataaatatggaatcaccagtgtcagagctgaaagggacctcaaagattattctcacactctcccagccagattttaa

SEQ ID NO: 1631 - protein, 30 aa, homo sapiens
MESPVSELKGTSKIILTLSQPDFKWINLIS

SEQ ID NO: 1632 - DNA, 93 bp, homo sapiens
atggaatcaccagtgtcagagctgaaagggacctcaaagattattctcacactctcccagccagattttaagtggataaacttgattagctga

SEQ ID NO: 1633 - protein, 29 aa, homo sapiens
MAVPAIIANPFASLCIDLNSDFVNFQRCG

SEQ ID NO: 1634 - DNA, 90 bp, homo sapiens
atggcagtgccagcaattattgctaatccgtttgcatccttatgcatagatctgaattcagactttgtgaatttccagaggtgtgggtaa

SEQ ID NO: 1635 - protein, 17 aa, homo sapiens
MHRSEFRLCEFPEVWVI

SEQ ID NO: 1636 - DNA, 54 bp, homo sapiens
atgcatagatctgaattcagactttgtgaatttccagaggtgtgggtaatataa

SEQ ID NO: 1637 - protein, 12 aa, homo sapiens
MADLVQIKSYGA

SEQ ID NO: 1638 - DNA, 39 bp, homo sapiens
atggctgatcttgtgcaaattaaaagttatggggcataa

SEQ ID NO: 1639 - protein, 8 aa, homo sapiens
MGHKNSKS

SEQ ID NO: 1640 - DNA, 27 bp, homo sapiens
atggggcataagaatagcaaaagttga

SEQ ID NO: 1641 - protein, 72 aa, homo sapiens
MPAIADNRRAPGIAAREMEQGEPFSLKEFFPALPVYVYRVTPYLLITASFVLLWVRLKVFVCFFWFYWHRKL

SEQ ID NO: 1642 - DNA, 219 bp, homo sapiens
atgcctgcaattgctgataatagacgtgccccaggaatcgctgcaagggaaatggagcaaggtgagccattctctttgaaggagttttttccagctctaccggtttatgtgtatagggtcacaccctaccttcttataactgcctcatttgttctcctttgggtcaggctgaaagtgtttgtttgctttttctggttttattggcatagaaaactctag

SEQ ID NO: 1643 - protein, 10 aa, homo sapiens
MCIGSHPTFL

SEQ ID NO: 1644 - DNA, 33 bp, homo sapiens
atgtgtatagggtcacaccctaccttcttataa

SEQ ID NO: 1645 - protein, 10 aa, homo sapiens
MASAFLEGAG

SEQ ID NO: 1646 - DNA, 33 bp, homo sapiens
atggcatctgcattcctggaaggtgcaggctga

SEQ ID NO: 1647 - protein, 7 aa, homo sapiens
MGGAEEF

SEQ ID NO: 1648 - DNA, 24 bp, homo sapiens
atgggtggagcggaggagttttga

SEQ ID NO: 1649 - protein, 143 aa, homo sapiens [sequence omitted]

SEQ ID NO: 1650 - DNA, 432 bp, homo sapiens
atggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctga

SEQ ID NO: 1651 - protein, 165 aa, homo sapiens [sequence omitted]

SEQ ID NO: 1652 - DNA, 498 bp, homo sapiens
atggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacgtaggtaacgcccagcgggtgggcggggccacaggcctaggggaagtcccaacccagctcccagccacaccttcgttgtctgccctctgccgtagacaactacgtgggatcgagcagcaccctctgctgggagcagcaccctctgctgggaacagctctctggtccctgggtcttcaggggatggttttcattcccacgtggccgcctctggacatcccttaggaagggcaccctag

SEQ ID NO: 1653 - protein, 13 aa, homo sapiens
MVFIPTWPPLDIP

SEQ ID NO: 1654 - DNA, 42 bp, homo sapiens
atggttttcattcccacgtggccgcctctggacatcccttag

SEQ ID NO: 1655 - protein, 60 aa, homo sapiens
MLGEFQAPADTLSKEGYQDRTSTSRPITTALLQMVDLLVPGGADHPRGMGGPGSSPLLGK

SEQ ID NO: 1656 - DNA, 183 bp, homo sapiens
atgcttggagagtttcaagcccctgccgacactttatccaaggaaggatatcaggataggacttctacctctaggcctatcacaacagctctcttgcagatggtggacctgctggttccgggtggagctgaccatcccagaggcatgggtgggccaggaagttcacctttgctgggaaagtga

SEQ ID NO: 1657 - protein, 9 aa, homo sapiens
MLSSLISHQ

SEQ ID NO: 1658 - DNA, 30 bp, homo sapiens
atgctctcgagtctcatttcccaccagtga

SEQ ID NO: 1659 - protein, 24 aa, homo sapiens
MCQKIKSGNLALWSLCSLQKFSEY

SEQ ID NO: 1660 - DNA, 75 bp, homo sapiens
atgtgccagaaaataaaaagtggaaatcttgctttgtggtctctttgctcgctgcaaaaattttctgagtactaa

SEQ ID NO: 1661 - protein, 12 aa, homo sapiens
MNRVNQILLIEF

SEQ ID NO: 1662 - DNA, 39 bp, homo sapiens
atgaatcgtgtaaatcaaatcttattaattgaattctaa

SEQ ID NO: 1663 - protein, 8 aa, homo sapiens
MEENASSV

SEQ ID NO: 1664 - DNA, 27 bp, homo sapiens
atggaggaaaatgcttcatcagtgtga

SEQ ID NO: 1665 - protein, 18 aa, homo sapiens
MSFWGTVEGVRGSTWGHQ

SEQ ID NO: 1666 - DNA, 57 bp, homo sapiens
atgtcattctggggaacagtggagggagtgcgcggcagcacctgggggcaccagtga

SEQ ID NO: 1667 - protein, 29 aa, homo sapiens
MWSGAPGLCGWGGICFWVTPCLPFSSTTF

SEQ ID NO: 1668 - DNA, 90 bp, homo sapiens
atgtggagtggggctccagggctgtgtgggtggggagggatctgcttctgggttaccccatgcctccccttctcaagtactactttttaa

SEQ ID NO: 1669 - protein, 69 aa, homo sapiens
MPPLLKYYFLIIMAPAIHFIVDVSQVRWLTSLIPALGEAEARRITRGQEFKTSLGNIVRPPSLQKNKNS

SEQ ID NO: 1670 - DNA, 210 bp, homo sapiens
atgcctccccttctcaagtactactttttaatcatcatggctcctgccattcatttcatagttgatgtaagccaggtgcggtggctcacgtctttaatcccagcacttggggaggctgaggccaggaggatcactcgaggccaggagttcaagaccagcttgggcaacatagtgagacccccgtctctacaaaaaaacaaaaacagttag

SEQ ID NO: 1671 - protein, 20 aa, homo sapiens
MLAPLHSSLGDRARPCLKNK

SEQ ID NO: 1672 - DNA, 63 bp, homo sapiens
atgcttgcaccactgcactctagcctgggtgacagagcaagaccctgtctcaaaaataaataa

SEQ ID NO: 1673 - protein, 13 aa, homo sapiens
MPNPGSMMTTGGV

SEQ ID NO: 1674 - DNA, 42 bp, homo sapiens; identical to SEQ ID NO: 202

SEQ ID NO: 1675 - protein, 4 aa, homo sapiens
MSHT

SEQ ID NO: 1676 - DNA, 15 bp, homo sapiens
atgagtcatacatga

SEQ ID NO: 1677 - protein, 8 aa, homo sapiens
MMNMCLEL

SEQ ID NO: 1678 - DNA, 27 bp, homo sapiens
atgatgaatatgtgtctggaactctga

SEQ ID NO: 1679 - protein, 14 aa, homo sapiens
MHSYVIIMIGSMKE

SEQ ID NO: 1680 - DNA, 45 bp, homo sapiens; identical to SEQ ID NO: 208

SEQ ID NO: 1681 - protein, 13 aa, homo sapiens
MPNPGSMMTTGGV

SEQ ID NO: 1682 - DNA, 42 bp, homo sapiens; identical to SEQ ID NO: 202

SEQ ID NO: 1683 - protein, 4 aa, homo sapiens
MSHT

SEQ ID NO: 1684 - DNA, 15 bp, homo sapiens
atgagtcatacatga

SEQ ID NO: 1685 - protein, 8 aa, homo sapiens
MMNMCLEL

SEQ ID NO: 1686 - DNA, 27 bp, homo sapiens
atgatgaatatgtgtctggaactctga

SEQ ID NO: 1687 - protein, 14 aa, homo sapiens
MHSYVIIMIGSMKE

SEQ ID NO: 1688 - DNA, 45 bp, homo sapiens; identical to SEQ ID NO: 208

SEQ ID NO: 1689 - protein, 13 aa, homo sapiens
MPNPGSMMTTGGV

SEQ ID NO: 1690 - DNA, 42 bp, homo sapiens; identical to SEQ ID NO: 202

SEQ ID NO: 1691 - protein, 4 aa, homo sapiens
MSHT

SEQ ID NO: 1692 - DNA, 15 bp, homo sapiens
atgagtcatacatga

SEQ ID NO: 1693 - protein, 8 aa, homo sapiens
MMNMCLEL

SEQ ID NO: 1694 - DNA, 27 bp, homo sapiens
atgatgaatatgtgtctggaactctga

SEQ ID NO: 1695 - protein, 14 aa, homo sapiens
MHSYVIIMIGSMKE

SEQ ID NO: 1696 - DNA, 45 bp, homo sapiens; identical to SEQ ID NO: 208

SEQ ID NO: 1697 - protein, 13 aa, homo sapiens
MPNPGSMMTTGGV

SEQ ID NO: 1698 - DNA, 42 bp, homo sapiens; identical to SEQ ID NO: 202

SEQ ID NO: 1699 - protein, 4 aa, homo sapiens
MSHT

SEQ ID NO: 1700 - DNA, 15 bp, homo sapiens
atgagtcatacatga

SEQ ID NO: 1701 - protein, 8 aa, homo sapiens
MMNMCLEL

SEQ ID NO: 1702 - DNA, 27 bp, homo sapiens
atgatgaatatgtgtctggaactctga

SEQ ID NO: 1703 - protein, 14 aa, homo sapiens
MHSYVIIMIGSMKE

SEQ ID NO: 1704 - DNA, 45 bp, homo sapiens; identical to SEQ ID NO: 208

SEQ ID NO: 1705 - protein, 38 aa, homo sapiens
MLSSIRMGYIVRAMASSACICSFCLLIWGWGGEWYWVK

SEQ ID NO: 1706 - DNA, 117 bp, homo sapiens
atgctctcatcaatacgcatggggtacatcgtgagggcaatggccagcagcgcatgcatctgctcattctgcttgttaatctggggatggggtggagagtggtactgggtcaaatga

SEQ ID NO: 1707 - protein, 25 aa, homo sapiens
MHLLILLVNLGMGWRVVLGQMRRTS

SEQ ID NO: 1708 - DNA, 78 bp, homo sapiens
atgcatctgctcattctgcttgttaatctggggatggggtggagagtggtactgggtcaaatgagacggacttcctga

SEQ ID NO: 1709 - protein, 5 aa, homo sapiens
MTTEI

SEQ ID NO: 1710 - DNA, 18 bp, homo sapiens
atgacgacagaaatatag

SEQ ID NO: 1711 - protein, 19 aa, homo sapiens
MCRATAFQSTTGHGPHIGW

SEQ ID NO: 1712 - DNA, 60 bp, homo sapiens
atgtgccgtgcaacagcgtttcagtcaacaacgggccatgggccacatataggatggtga

SEQ ID NO: 1713 - protein, 20 aa, homo sapiens
MGAASATHSSFCLAGHSRLL

SEQ ID NO: 1714 - DNA, 63 bp, homo sapiens
atgggcgctgccagcgccacgcactcctctttctgcctggccggccactcccgtctgctgtga

SEQ ID NO: 1715 - protein, 64 aa, homo sapiens
MESAPSIWRTGAAPGRASSTRAMVRLQLDADFTPQGTRRPICLEAAVLRQCRCLHGPSPALLQV

SEQ ID NO: 1716 - DNA, 195 bp, homo sapiens
atggaatctgcaccttccatctggagaactggggccgccccaggccgggcttccagcaccagagcgatggtcaggcttcagctggacgcagatttcaccccgcagggcacacgcagacccatttgtttggaagcggcagtcctaaggcagtgcaggtgcctccacggccccagcccagctctcctgcaggtgtaa

SEQ ID NO: 1717 - protein, 130 aa, homo sapiens
MQIPGPPMACRGPSEQEGPGSRGAPIPGAEVLGSHGAGVGSAQVPCDPMATFPSWLHAPQGLGVPLTAHFLAVGGVCFLPPSQGVQSLRGLPTSSGAWGSRVCHPEAVCLPATFPSGRADQAGSACGWGC

SEQ ID NO: 1718 - DNA, 393 bp, homo sapiens
atgcagattccagggccccccatggcctgcagaggcccctcagagcaggaagggccgggctctcggggagcccccatcccaggtgctgaggtccttgggtcacatggagctggggtggggagtgcccaggtcccctgtgatccgatggccacgtttccctcctggcttcacgcaccccaagggctgggggtcccactcactgcccattttctggctgtggggggggtctgttttcttccaccttctcaaggtgttcagagcctcaggggcctccccacttcctctggggcctgggggagtagagtctgtcacccggaggctgtgtgcctccccgcgacattccccagtggccgggccgaccaggcaggctctgcctgtggatggggctgctga

SEQ ID NO: 1719 - protein, 196 aa, homo sapiens [sequence omitted]

SEQ ID NO: 1720 - DNA, 591 bp, homo sapiens
atggagctggggtggggagtgcccaggtcccctgtgatccgatggccacgtttccctcctggcttcacgcaccccaagggctgggggtcccactcactgcccattttctggctgtggggggggtctgttttcttccaccttctcaaggtgttcagagcctcaggggcctccccacttcctctggggcctgggggagtagagtctgtcacccggaggctgtgtgcctccccgcgacattccccagtggccgggccgaccaggcaggctctgcctgtggatggggctgctgagcatgagcgtgtgacccccatttctgagctgtgggtggacccaccgggcctgggccaaggttttcaggaggcagctctattctactccgccatggtggcctccctgaaaggggtgagtgtagaagccagttccctcttctgcgagccccacccctaccccaggaggacaattcttgttcagggagggtctccccacccacttccccaccccacagtggcccacaggccccaccctagagagtacaaggggctccccaggctgctcactggcccagccccgccccacctggactgcacctga

SEQ ID NO: 1721 - protein, 5 aa, homo sapiens
MRRAL

SEQ ID NO: 1722 - DNA, 18 bp, homo sapiens
atgaggagggcattgtag

SEQ ID NO: 1723 - protein, 13 aa, homo sapiens
MRVIDPGCRSPKE

SEQ ID NO: 1724 - DNA, 42 bp, homo sapiens; identical to SEQ ID NO: 148

SEQ ID NO: 1725 - protein, 24 aa, homo sapiens
MTERKREWWKETIGWEKMKIEKRK

SEQ ID NO: 1726 - DNA, 75 bp, homo sapiens; identical to SEQ ID NO: 150

SEQ ID NO: 1727 - protein, 17 aa, homo sapiens
MGKNENRKKEVKEIINN

SEQ ID NO: 1728 - DNA, 54 bp, homo sapiens; identical to SEQ ID NO: 152

SEQ ID NO: 1729 - protein, 13 aa, homo sapiens
MPNPGSMMTTGGV

SEQ ID NO: 1730 - DNA, 42 bp, homo sapiens; identical to SEQ ID NO: 202

SEQ ID NO: 1731 - protein, 4 aa, homo sapiens
MSHT

SEQ ID NO: 1732 - DNA, 15 bp, homo sapiens
atgagtcatacatga

SEQ ID NO: 1733 - protein, 8 aa, homo sapiens
MMNMCLEL

SEQ ID NO: 1734 - DNA, 27 bp, homo sapiens
atgatgaatatgtgtctggaactctga

SEQ ID NO: 1735 - protein, 14 aa, homo sapiens
MHSYVIIMIGSMKE

SEQ ID NO: 1736 - DNA, 45 bp, homo sapiens; identical to SEQ ID NO: 208

SEQ ID NO: 1737 - protein, 7 aa, homo sapiens [sequence omitted]

SEQ ID NO: 1738 - DNA, 24 bp, homo sapiens
atggtgaaaccccgtctctactaa

SEQ ID NO: 1739 - protein, 13 aa, homo sapiens
MVACACSPSYLGG

SEQ ID NO: 1740 - DNA, 42 bp, homo sapiens
atggtggcgtgtgcctgtagtcccagctatttgggaggctga

SEQ ID NO: 1741 - protein, 8 aa, homo sapiens
MITPLHSV

SEQ ID NO: 1742 - DNA, 27 bp, homo sapiens
atgatcacaccactgcactctgtctag

SEQ ID NO: 1743 - protein, 7 aa, homo sapiens
MVKPGLY

SEQ ID NO: 1744 - DNA, 24 bp, homo sapiens
atggtgaaacctggtctctactaa

SEQ ID NO: 1745 - protein, 45 aa, homo sapiens
MCAGKCCKIYFLYVGIKISLKVINLINVCKEERKVKNRVLGFLNI

SEQ ID NO: 1746 - DNA, 138 bp, homo sapiens
atgtgtgctgggaaatgctgcaaaatatattttttatatgtagggatcaaaataagtttgaaagtcataaacctaataaatgtatgcaaagaagagaggaaggtcaagaacagagtgctagggtttctaaatatttga

SEQ ID NO: 1747 - protein, 45 aa, homo sapiens
MLQNIFFICRDQNKFESHKPNKCMQRREEGQEQSARVSKYLSLGS

SEQ ID NO: 1748 - DNA, 138 bp, homo sapiens
atgctgcaaaatatattttttatatgtagggatcaaaataagtttgaaagtcataaacctaataaatgtatgcaaagaagagaggaaggtcaagaacagagtgctagggtttctaaatatttgagtttgggaagttga

SEQ ID NO: 1749 - protein, 13 aa, homo sapiens
MYAKKRGRSRTEC

SEQ ID NO: 1750 - DNA, 42 bp, homo sapiens
atgtatgcaaagaagagaggaaggtcaagaacagagtgctag

SEQ ID NO: 1751 - protein, 44 aa, homo sapiens
MAKKNQPRGRKRTKKPSPGNQVKKCSMKESMVRRVNCVSNYYCI

SEQ ID NO: 1752 - DNA, 135 bp, homo sapiens
atggcaaagaagaatcagcccagaggtaggaagagaaccaagaaaccaagccctggcaaccaggttaaaaagtgttctatgaaggaaagcatggtccgtagggtcaactgtgtgtccaattactactgtatttag

SEQ ID NO: 1753 - protein, 36 aa, homo sapiens
MSYFFLFSFFLIGSLCVAQVGVHNHSSLQSQTCGLK

SEQ ID NO: 1754 - DNA, 111 bp, homo sapiens
atgtcctatttcttccttttttctttttttcttataggttctctctgtgttgcacaggttggagtgcacaatcatagctcattgcagtctcagacttgtgggctcaagtga

SEQ ID NO: 1755 - protein, 8 aa, homo sapiens
MPPCQAEF

SEQ ID NO: 1756 - DNA, 27 bp, homo sapiens
atgccaccatgccaggctgaattttaa

SEQ ID NO: 1757 - protein, 12 aa, homo sapiens
MLSSRPPKLLGL

SEQ ID NO: 1758 - DNA, 39 bp, homo sapiens
atgctctcatctcggcctcccaaattgctggggttatag

SEQ ID NO: 1759 - protein, 74 aa, homo sapiens
MKCCVNTRRKVSPQRCLSLSRMSNIWADNKTLNSHEVWQYIHLMNWQYYKCLRIIKMLRFHLFLSRTLRSCVGF

SEQ ID NO: 1760 - DNA, 225 bp, homo sapiens
atgaaatgctgtgtgaacacaagaaggaaggttagcccacagagatgtctctcactttccagaatgtcaaatatttgggctgataacaaaactttgaacagtcatgaagtatggcaatatattcatctaatgaactggcaatattataaatgtctaagaatcataaaaatgttaaggtttcatcttttcttaagtagaacactcagaagctgtgttggattctaa

SEQ ID NO: 1761 - protein, 13 aa, homo sapiens
MPNPGSMMTTGGV

SEQ ID NO: 1762 - DNA, 42 bp, homo sapiens; identical to SEQ ID NO: 202

SEQ ID NO: 1763 - protein, 4 aa, homo sapiens
MSHT

SEQ ID NO: 1764 - DNA, 15 bp, homo sapiens
atgagtcatacatga

SEQ ID NO: 1765 - protein, 8 aa, homo sapiens
MMNMCLEL

SEQ ID NO: 1766 - DNA, 27 bp, homo sapiens
atgatgaatatgtgtctggaactctga

SEQ ID NO: 1767 - protein, 14 aa, homo sapiens
MHSYVIIMIGSMKE

SEQ ID NO: 1768 - DNA, 45 bp, homo sapiens; identical to SEQ ID NO: 208

SEQ ID NO: 1769 - protein, 13 aa, homo sapiens
MLLGHHLPGPRSR

SEQ ID NO: 1770 - DNA, 42 bp, homo sapiens
atgcttctgggccaccatttgccagggcctcgctcgaggtaa

SEQ ID NO: 1771 - protein, 34 aa, homo sapiens
MGTLTWAIQIMIKMERGWDAGEGVLQPEGPGPRG

SEQ ID NO: 1772 - DNA, 105 bp, homo sapiens
atgggcacccttacctgggctattcaaataatgatcaaaatggaacggggatgggatgcgggtgagggagtgctccagccggagggcccggggcccagaggatga

SEQ ID NO: 1773 - protein, 4 aa, homo sapiens
MGCG

SEQ ID NO: 1774 - DNA, 15 bp, homo sapiens
atgggatgcgggtga

SEQ ID NO: 1775 - protein, 68 aa, homo sapiens
MRVRECSSRRARGPEDDVRLEAWTPGSCPWAPCASSQGSERLRGAPAIRFPFLSRAFDSSLLYTPACK

SEQ ID NO: 1776 - DNA, 207 bp, homo sapiens
atgcgggtgagggagtgctccagccggagggcccggggcccagaggatgatgtgcgcctggaagcttggaccccgggctcttgcccctgggcaccttgtgcctccagccaaggttccgagcgactgcgtggggctccagctatccgatttcccttcctaagtcgcgcgttcgacagctccctcctttacacacccgcgtgcaaatga

SEQ ID NO: 1777 - protein, 26 aa, homo sapiens
MKKGRKPTCASDSRWRNDCGFRCIHR

SEQ ID NO: 1778 - DNA, 81 bp, homo sapiens; identical to SEQ ID NO: 90

SEQ ID NO: 1779 - protein, 12 aa, homo sapiens
MIVVFVASTADS

SEQ ID NO: 1780 - DNA, 39 bp, homo sapiens; identical to SEQ ID NO: 92

SEQ ID NO: 1781 - protein, 57 aa, homo sapiens; identical to SEQ ID NO: 93

SEQ ID NO: 1782 - DNA, 174 bp, homo sapiens; identical to SEQ ID NO: 94

SEQ ID NO: 1783 - protein, 26 aa, homo sapiens
MLNSILIVRLKLRHHFILQSAVGLWP

SEQ ID NO: 1784 - DNA, 81 bp, homo sapiens; identical to SEQ ID NO: 96

SEQ ID NO: 1785 - protein, 10 aa, homo sapiens
MAMCCHLSWG

SEQ ID NO: 1786 - DNA, 33 bp, homo sapiens
atggcaatgtgctgtcatctttcctggggttag

SEQ ID NO: 1787 - protein, 44 aa, homo sapiens [sequence omitted]

SEQ ID NO: 1788 - DNA, 135 bp, homo sapiens
atggaccccaaggccaaagggtctaaaattctgaattctgaatctggtggcctcctcctcacacccttccctggagcagctgcctccggaatggctcaaagtcctcaggcactgtgtctgaagaaggggaaataa

SEQ ID NO: 1789 - protein, 7 aa, homo sapiens
MWLSHKA

SEQ ID NO: 1790 - DNA, 24 bp, homo sapiens
atgtggctctcccacaaggcatga

SEQ ID NO: 1791 - protein, 32 aa, homo sapiens
MFSWEKQNTPRRPPRMDVSMITPESATSWGPS

SEQ ID NO: 1792 - DNA, 99 bp, homo sapiens
atgttttcttgggagaagcagaatacaccaagacgcccccctcgcatggatgtgtcaatgatcaccccagaatccgccacaagctggggtccctcatag

SEQ ID NO: 1793 - protein, 21 aa, homo sapiens
MTGRVSQDNQKGEFNLIFKNK

SEQ ID NO: 1794 - DNA, 66 bp, homo sapiens
atgactgggagagtcagtcaagataatcagaaaggagaatttaaccttatctttaagaataagtag

SEQ ID NO: 1795 - protein, 4 aa, homo sapiens
MVKS

SEQ ID NO: 1796 - DNA, 15 bp, homo sapiens
atggttaagtcataa

SEQ ID NO: 1797 - protein, 11 aa, homo sapiens
MSKLEKNLHEC

SEQ ID NO: 1798 - DNA, 36 bp, homo sapiens
atgagtaaattagagaagaacctacacgaatgctga

SEQ ID NO: 1799 - protein, 21 aa, homo sapiens
MLRNCSEENGKSSKPLHKPQS

SEQ ID NO: 1800 - DNA, 66 bp, homo sapiens
atgctgagaaattgttctgaagaaaatggaaagtcatcaaagcctttacacaagccacaatcttaa

SEQ ID NO: 1801 - protein, 7 aa, homo sapiens
MKLIRLG

SEQ ID NO: 1802 - DNA, 24 bp, homo sapiens
atgaagctgattaggttggggtag

SEQ ID NO: 1803 - protein, 7 aa, homo sapiens
MERARMQ

SEQ ID NO: 1804 - DNA, 24 bp, homo sapiens
atggagagggcaaggatgcagtaa

SEQ ID NO: 1805 - protein, 22 aa, homo sapiens
MFKFGVLKREKIRIYELKNHNI

SEQ ID NO: 1806 - DNA, 69 bp, homo sapiens
atgtttaaatttggtgttctgaaaagagagaaaattaggatatatgagttgaagaatcacaatatatag

SEQ ID NO: 1807 - protein, 29 aa, homo sapiens [sequence omitted]

SEQ ID NO: 1808 - DNA, 90 bp, homo sapiens
atgctttttaaagcaatgggactagatgatgtggagggtaagggaaagagcatgttgagggaagagatgggaatctacattcatttataa

SEQ ID NO: 1809 - protein, 12 aa, homo sapiens
MRSPGQGRPEGG

SEQ ID NO: 1810 - DNA, 39 bp, homo sapiens
atgcgctcgccggggcaggggcgcccggagggcggctag

SEQ ID NO: 1811 - protein, 29 aa, homo sapiens
MRGALPLRVGGRTQSSRAKGCGAVGSAQR

SEQ ID NO: 1812 - DNA, 90 bp, homo sapiens
atgagaggtgcgctcccactgcgggtgggaggcaggactcagtcatcccgggcaaagggttgtggggcagtgggaagcgcccagaggtga

SEQ ID NO: 1813 - protein, 53 aa, homo sapiens
MHHTAPALDKIYDVFPPLKWEVVGKSYSLCSPLRAPEQASLICLWASLQPPPA

SEQ ID NO: 1814 - DNA, 162 bp, homo sapiens
atgcaccacacagcacccgctctagacaagatttatgacgtttttccccctctgaaatgggaagttgttgggaaatcctattcactctgctccccactccgtgccccagaacaggcctctttgatctgtctgtgggcgtctctgcagcctcctccagcctag

SEQ ID NO: 1815 - protein, 6 aa, homo sapiens
MTFFPL

SEQ ID NO: 1816 - DNA, 21 bp, homo sapiens
atgacgtttttccccctctga

SEQ ID NO: 1817 - protein, 54 aa, homo sapiens; identical to SEQ ID NO: 337

SEQ ID NO: 1818 - DNA, 165 bp, homo sapiens; identical to SEQ ID NO: 338

SEQ ID NO: 1819 - protein, 146 aa, homo sapiens; identical to SEQ ID NO: 339

SEQ ID NO: 1820 - DNA, 441 bp, homo sapiens; identical to SEQ ID NO: 340

SEQ ID NO: 1821 - protein, 83 aa, homo sapiens; identical to SEQ ID NO: 341

SEQ ID NO: 1822 - DNA, 252 bp, homo sapiens; identical to SEQ ID NO: 342

SEQ ID NO: 1823 - protein, 8 aa, homo sapiens
MGTESADL

SEQ ID NO: 1824 - DNA, 27 bp, homo sapiens
atgggcaccgagtcggcggatctctga

SEQ ID NO: 1825 - protein, 301 aa, homo sapiens; identical to SEQ ID NO: 33

SEQ ID NO: 1826 - DNA, 906 bp, homo sapiens; identical to SEQ ID NO: 34

SEQ ID NO: 1827 - protein, 41 aa, homo sapiens; identical to SEQ ID NO: 35

SEQ ID NO: 1828 - DNA, 126 bp, homo sapiens; identical to SEQ ID NO: 36

SEQ ID NO: 1829 - protein, 50 aa, homo sapiens [sequence omitted]

SEQ ID NO: 1830 - DNA, 153 bp, homo sapiens; identical to SEQ ID NO: 38

SEQ ID NO: 1831 - protein, 13 aa, homo sapiens
MGAGAGRIVAGRD

SEQ ID NO: 1832 - DNA, 42 bp, homo sapiens; identical to SEQ ID NO: 40

SEQ ID NO: 1833 - protein, 58 aa, homo sapiens
MGCNGGPLRGGDTAAETRMEGRARRGNSRRRGSLEAGKGGPGTGSQARASFAAAARSV

SEQ ID NO: 1834 - DNA, 177 bp, homo sapiens
atggggtgcaacggcgggcctctccggggaggtgacactgccgctgagacccgaatggaagggcgcgcccggcgggggaacagcaggcgccgaggttcgctggaagcagggaagggaggcccgggtaccggctcgcaggcccgcgcgagcttcgcggcagcggcacggagcgtgtga

SEQ ID NO: 1835 - protein, 9 aa, homo sapiens
MLARLVENS

SEQ ID NO: 1836 - DNA, 30 bp, homo sapiens
atgttggccagactggtcgagaactcctga

SEQ ID NO: 1837 - protein, 5 aa, homo sapiens
MTWRL

SEQ ID NO: 1838 - DNA, 18 bp, homo sapiens
atgacttggagactttag

SEQ ID NO: 1839 - protein, 23 aa, homo sapiens
MSEQRTGCSLVTRSGWVGEWMDR

SEQ ID NO: 1840 - DNA, 72 bp, homo sapiens
atgtcagagcaaaggacagggtgcagcttggtgacccggagtgggtgggtgggtgaatggatggatagatag

SEQ ID NO: 1841 - protein, 7 aa, homo sapiens
MVSCRTR

SEQ ID NO: 1842 - DNA, 24 bp, homo sapiens
atggtttcttgcagaacgaggtga

SEQ ID NO: 1843 - protein, 140 aa, homo sapiens
MASVSFSWVAMTKDWSSRKSSSGSWPLLSCPWLSKASQEYFSRVWACSGSSLAGGGCRRSSSSTRDTSQRTSTSEKAPRAAGEGAAEPEFGGSSAAGRAGVAPGPGWGAGGGGGGSDCTGWLPCSRARRCMRVKTARAPV

SEQ ID NO: 1844 - DNA, 423 bp, homo sapiens
atggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtag

SEQ ID NO: 1845 - protein, 92 aa, homo sapiens
MLAAPSTSRRAAAAGGRAGAGRRALRPPRRAAAVPAPAPQPEPAPCPGEVQRAGSEAGPGRAVSGVCKSRVSGMRIQDPGKVRGAWRGTSCC

SEQ ID NO: 1846 - DNA, 279 bp, homo sapiens
atgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctggtgaggtgcaaagagcgggatcggaggcggggcctggccgggctgtgagcggcgtatgcaaatcgagggtctcggggatgcggatccaagaccctgggaaggtacgcggggcctggcggggcaccagctgctgctag

SEQ ID NO: 1847 - protein, 46 aa, homo sapiens
MQIEGLGDADPRPWEGTRGLAGHQLLLARLQCKWSRLLKASHSLSI

SEQ ID NO: 1848 - DNA, 141 bp, homo sapiens
atgcaaatcgagggtctcggggatgcggatccaagaccctgggaaggtacgcggggcctggcggggcaccagctgctgctagctcggctgcaatgcaagtggtctaggttgctaaaggcatcccacagcctctccatctga

SEQ ID NO: 1849 - protein, 47 aa, homo sapiens
MGLTLLPNSSTPAHYFLQHLEQLLFIALDTHSVRPYPSGLSQALPFQ

SEQ ID NO: 1850 - DNA, 144 bp, homo sapiens
atggggctcaccctccttccaaacagttcaactcctgcacattattttcttcaacatctggagcagttactttttattgccctagacacacactctgtccgcccatatccttcaggcctttctcaagcattaccctttcaatga

SEQ ID NO: 1851 - protein, 30 aa, homo sapiens
MTVDTVSNMSTSFLDFPYPHSQPYFSLAPI

SEQ ID NO: 1852 - DNA, 93 bp, homo sapiens
atgacggtggacacagtctctaacatgtcaacctccttccttgactttccctatccccattctcaaccttatttctccttagcacctatctag

SEQ ID NO: 1853 - protein, 18 aa, homo sapiens
MYFTYAFIVCYPSKIKAL

SEQ ID NO: 1854 - DNA, 57 bp, homo sapiens
atgtattttacttatgcttttattgtctgctatccttctaaaattaaagctctgtga

SEQ ID NO: 1855 - protein, 23 aa, homo sapiens
MLLLSAILLKLKLCEHKDFCLVP

SEQ ID NO: 1856 - DNA, 72 bp, homo sapiens
atgcttttattgtctgctatccttctaaaattaaagctctgtgagcacaaggatttttgtttggttccttaa

SEQ ID NO: 1857 - protein, 84 aa, homo sapiens [sequence omitted]

SEQ ID NO: 1858 - DNA, 255 bp, homo sapiens
atgcaaggttgtgagggttgtggatgggagggctggggcgaggcggggtccgcagagatgtggggggcgcagagatggggggggtccgcgggcccgccggggaccgcgcagcctcgggctctgtgcccggggccgcgcgggttaactagagaaggtgacgcgcgcccctgttgctcagccgcggcgcgtgccttccctgcggcgatcctaattggcccgacagaagcccgcccccagaagcccctcccacagtag

SEQ ID NO: 1859 - protein, 41 aa, homo sapiens [sequence omitted]

SEQ ID NO: 1860 - DNA, 126 bp, homo sapiens
atgggagggctggggcgaggcggggtccgcagagatgtggggggcgcagagatggggggggtccgcgggcccgccggggaccgcgcagcctcgggctctgtgcccggggccgcgcgggttaactag

SEQ ID NO: 1861 - protein, 33 aa, homo sapiens
MTVSRAHAPNAVSGLDVLGAHEVQRLGRRKGPG

SEQ ID NO: 1862 - DNA, 102 bp, homo sapiens
atgacggtctcccgtgcccacgccccaaacgcagtctctggcctggatgtgctcggagcccacgaggtgcagaggctcggacggcgaaagggacctggctga

SEQ ID NO: 1863 - protein, 87 aa, homo sapiens
MCSEPTRCRGSDGERDLAEIWVLNRGLGPASRQRAPTSDTRPGAVCGIAGAGSHLQFTHGTKRATPTSSESMHLQLHPSPHARPPNP

SEQ ID NO: 1864 - DNA, 264 bp, homo sapiens
atgtgctcggagcccacgaggtgcagaggctcggacggcgaaagggacctggctgagatctgggtcttaaaccgcgggctcggcccagcatcccggcagcgtgcgcccacaagtgacacccggccgggcgcggtctgcgggatcgcaggcgccgggtctcatctccagttcacacacgggacgaaacgggccacccctaccagctctgagagcatgcacctccaactccatccctccccacatgcccgaccccccaacccgtaa

SEQ ID NO: 1865 - protein, 21 aa, homo sapiens
MVTHDKEGQSCHLSREDCASF

SEQ ID NO: 1866 - DNA, 66 bp, homo sapiens
atggtgacccatgataaggaaggacagtcatgtcatctttcccgggaagactgtgccagtttttaa

SEQ ID NO: 1867 - protein, 22 aa, homo sapiens
MIRKDSHVIFPGKTVPVFNFAT

SEQ ID NO: 1868 - DNA, 69 bp, homo sapiens
atgataaggaaggacagtcatgtcatctttcccgggaagactgtgccagtttttaactttgcaacttga

SEQ ID NO: 1869 - protein, 27 aa, homo sapiens
MSSFPGRLCQFLTLQLECQDFCSFYLY

SEQ ID NO: 1870 - DNA, 84 bp, homo sapiens
atgtcatctttcccgggaagactgtgccagtttttaactttgcaacttgaatgtcaagatttttgttccttttatctgtattaa

SEQ ID NO: 1871 - protein, 21 aa, homo sapiens
MSRFLFLLSVLMFLRFQKYIY

SEQ ID NO: 1872 - DNA, 66 bp, homo sapiens
atgtcaagatttttgttccttttatctgtattaatgtttcttagatttcagaaatacatatattga

SEQ ID NO: 1873 - protein, 21 aa, homo sapiens
MVTHDKEGQSCHLSREDCASF

SEQ ID NO: 1874 - DNA, 66 bp, homo sapiens; identical to SEQ ID NO: 1866

SEQ ID NO: 1875 - protein, 22 aa, homo sapiens
MIRKDSHVIFPGKTVPVFNFAT

SEQ ID NO: 1876 - DNA, 69 bp, homo sapiens; identical to SEQ ID NO: 1868

SEQ ID NO: 1877 - protein, 27 aa, homo sapiens
MSSFPGRLCQFLTLQLECQDFCSFYLY

SEQ ID NO: 1878 - DNA, 84 bp, homo sapiens; identical to SEQ ID NO: 1870

SEQ ID NO: 1879 - protein, 21 aa, homo sapiens
MSRFLFLLSVLMFLRFQKYIY

SEQ ID NO: 1880 - DNA, 66 bp, homo sapiens; identical to SEQ ID NO: 1872

SEQ ID NO: 1881 - protein, 51 aa, homo sapiens
MFPRVSTFLPLRPLSRHPLSSGSPETSAAAIMLLTVRHGTVRYRSSALLAR

SEQ ID NO: 1882 - DNA, 156 bp, homo sapiens
atgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggtag

SEQ ID NO: 1883 - protein, 7 aa, homo sapiens
MLPPAGS

SEQ ID NO: 1884 - DNA, 24 bp, homo sapiens
atgttaccacctgctgggtcttag

SEQ ID NO: 1885 - protein, 6 aa, homo sapiens
MTCPRS

SEQ ID NO: 1886 - DNA, 21 bp, homo sapiens
atgacttgcccaaggtcatag

SEQ ID NO: 1887 - protein, 7 aa, homo sapiens
MNEYLLG

SEQ ID NO: 1888 - DNA, 24 bp, homo sapiens
atgaatgagtacttgctgggatag

SEQ ID NO: 1889 - protein, 66 aa, homo sapiens
MGHSSCQVLRSRSLECSFFFFFETEFRSCSPGWSAMARSWLTETSTSQIQGNYRRPPPHPANCLYF

SEQ ID NO: 1890 - DNA, 201 bp, homo sapiens
atgggacattcatcctgccaggtactaagatcaagaagcttggagtgttcttttttttttttttttgagacagagtttcgctcttgtagcccaggctggagtgcaatggcgcgatcttggctcactgaaacctccacttcccagattcaagggaattacaggcgcccgccaccacacccagctaattgtttgtatttttag

SEQ ID NO: 1891 - protein, 9 aa, homo sapiens
MLARLVLNS

SEQ ID NO: 1892 - DNA, 30 bp, homo sapiens
atgttggccaggttggtcttgaactcgtga

SEQ ID NO: 1893 - protein, 173 aa, homo sapiens
MPHQLLCYHSGLSLSPALTWFVAVAFQVGSLPLTVRGILVEQKSGQVVSPFKPSPGSHITLQKSSPYPRGPNLLGSSSSLPSTPITSLIPLAHSAAATLASPLSFEHSEHIAISGPLYSLSLNALPPQGLCTRCPVLLDQVFSGVCVASSTPLSGLRSDVSFTTRHLLKYYSS

SEQ ID NO: 1894 - DNA, 522 bp, homo sapiens
atgcctcaccagctcctttgctaccactctggcctcagtttgtctcctgctcttacctggtttgttgcagtggccttccaggtgggctctctgcctctcactgttagggggatactagtagaacagaagtcaggtcaggttgtttctcctttcaaaccctctcctggctcccacattacactgcaaaagtcttcaccatatccacgaggccccaacctattgggttcctcctcctccctcccctcaactcccatcacttctctcattcccctggctcactctgctgcagccaccctggcctccccgctgtcatttgaacatagcgaacacattgccatctcagggcctttgtactcgctgtccctgaacgcactgccacctcagggcctttgtactcgctgtcctgtccttctggatcaggtcttttcaggtgtctgtgtggcttcttccacacctctttcaggtctccgctcagacgtcagcttcacaaccaggcatttgctaaagtactactcaagctaa

SEQ ID NO: 1895 - protein, 24 aa, homo sapiens
MALHLALFFFITPLPDIDYYYYFF

SEQ ID NO: 1896 - DNA, 75 bp, homo sapiens
atggcccttcacttggctttatttttcttcataacaccactacctgatatagattattattattattttttttga

SEQ ID NO: 1897 - protein, 17 aa, homo sapiens
MTVPLFSGGEQNICLLS

SEQ ID NO: 1898 - DNA, 54 bp, homo sapiens
atgacagtcccacttttcagtggaggagaacaaaatatctgtctactctcttga

SEQ ID NO: 1899 - protein, 10 aa, homo sapiens
MQADECHSCN

SEQ ID NO: 1900 - DNA, 33 bp, homo sapiens
atgcaggcagatgagtgtcacagctgtaactga

SEQ ID NO: 1901 - protein, 28 aa, homo sapiens
MSVTAVTEAQSSTHSGADFRDGERGHRR

SEQ ID NO: 1902 - DNA, 87 bp, homo sapiens
atgagtgtcacagctgtaactgaggcacagagcagtacacacagtggagccgatttccgcgatggcgagagggggcaccggaggtga

SEQ ID NO: 1903 - protein, 21 aa, homo sapiens
MARGGTGGDNNNKTVLRTSFR

SEQ ID NO: 1904 - DNA, 66 bp, homo sapiens
atggcgagagggggcaccggaggtgacaacaataacaagactgtccttcggacaagttttaggtaa

SEQ ID NO: 1905 - protein, 43 aa, homo sapiens
MSDTGTTLPSQSPFQCWGSSVFSRFFPGFNASSRQRDGILGEC

SEQ ID NO: 1906 - DNA, 132 bp, homo sapiens
atgtctgacactggcaccacgctgccatctcagagtccatttcaatgctgggggtcatcggttttcagcaggttcttccctgggttcaacgcgtcttcccgccagagggatggaatcttgggtgagtgttga

SEQ ID NO: 1907 - protein, 26 aa, homo sapiens
MLGVIGFQQVLPWVQRVFPPEGWNLG

SEQ ID NO: 1908 - DNA, 81 bp, homo sapiens
atgctgggggtcatcggttttcagcaggttcttccctgggttcaacgcgtcttcccgccagagggatggaatcttgggtga

SEQ ID NO: 1909 - protein, 60 aa, homo sapiens [sequence omitted]

SEQ ID NO: 1910 - DNA, 183 bp, homo sapiens
atggaatcttgggtgagtgttgaaatgcgtcagaaacaaaaacgcaaagtggaactggagcacgtcacagaccttggaccagaagtggcctgtgaggcactggaagagacgccaccgtgcgagctgatggtcacacagcttgaggaccacaaagcccaggcaagagagcacccccaaagctaa

SEQ ID NO: 1911 - protein, 26 aa, homo sapiens
MQQSEAITGQGDALKREEQPGPPAAV

SEQ ID NO: 1912 - DNA, 81 bp, homo sapiens
atgcagcagagcgaggccataactggccagggagacgcactcaagagagaggaacagccagggccgccagccgcggtctag

SEQ ID NO: 1913 - protein, 32 aa, homo sapiens
MMNVSLGLSEPLVICGLLDRLLILLIDHVSGS

SEQ ID NO: 1914 - DNA, 99 bp, homo sapiens
atgatgaatgtttctcttggtctgtctgaaccccttgtcatttgtgggctgctagatcgattattaatattgctgattgatcatgttagtggttcttag

SEQ ID NO: 1915 - protein, 15 aa, homo sapiens
MFLLVCLNPLSFVGC

SEQ ID NO: 1916 - DNA, 48 bp, homo sapiens
atgtttctcttggtctgtctgaaccccttgtcatttgtgggctgctag

SEQ ID NO: 1917 - protein, 7 aa, homo sapiens
MLVVLSD

SEQ ID NO: 1918 - DNA, 24 bp, homo sapiens
atgttagtggttcttagtgattaa

SEQ ID NO: 1919 - protein, 15 aa, homo sapiens
MWRLPDLTSQWSMTA

SEQ ID NO: 1920 - DNA, 48 bp, homo sapiens
atgtggcgccttccagacttgacttcacagtggagcatgacagcttga

SEQ ID NO: 1921 - protein, 32 aa, homo sapiens; identical to SEQ ID NO: 1913

SEQ ID NO: 1922 - DNA, 99 bp, homo sapiens; identical to SEQ ID NO: 1914

SEQ ID NO: 1923 - protein, 15 aa, homo sapiens
MFLLVCLNPLSFVGC

SEQ ID NO: 1924 - DNA, 48 bp, homo sapiens; identical to SEQ ID NO: 1916

SEQ ID NO: 1925 - protein, 7 aa, homo sapiens
MLVVLSD

SEQ ID NO: 1926 - DNA, 24 bp, homo sapiens
atgttagtggttcttagtgattaa

SEQ ID NO: 1927 - protein, 15 aa, homo sapiens
MWRLPDLTSQWSMTA

SEQ ID NO: 1928 - DNA, 48 bp, homo sapiens; identical to SEQ ID NO: 1920

SEQ ID NO: 1929 - protein, 12 aa, homo sapiens
MWSECKKTSILK

SEQ ID NO: 1930 - DNA, 39 bp, homo sapiens
atgtggtcagagtgtaagaaaactagtattcttaagtag

SEQ ID NO: 1931 - protein, 44 aa, homo sapiens
MVGRLHFLPSVQFCFFSHVYCVRESCDKIKSTVLIIIGEITRVH

SEQ ID NO: 1932 - DNA, 135 bp, homo sapiens
atggtgggaagacttcattttttaccctctgtacagttttgttttttcagtcatgtttattgtgtaagagaaagttgtgacaaaataaaaagtactgtgttaataattataggcgaaattacaagagtccattga

SEQ ID NO: 1933 - protein, 4 aa, homo sapiens
MFIV

SEQ ID NO: 1934 - DNA, 15 bp, homo sapiens
atgtttattgtgtaa

SEQ ID NO: 1935 - protein, 9 aa, homo sapiens
MKTWGKIIL

SEQ ID NO: 1936 - DNA, 30 bp, homo sapiens
atgaagacttggggaaaaataattctgtaa

SEQ ID NO: 1937 - protein, 59 aa, homo sapiens [sequence omitted]

SEQ ID NO: 1938 - DNA, 180 bp, homo sapiens
atgaaaataaaacacatcgcaaccagggccactgaacacaaaaaggagcgaggacagagaagagaggcgaggtggcatctgctcccggctggctgcggcgcttcggagaggctccccgggctgggcgggacccccattttgaccctgcatttgaggaaggggcgactgtggagaaaatga

SEQ ID NO: 1939 - protein, 31 aa, homo sapiens
MRREGVRAGGGSACFFFFLSLSLFLEVWGPV

SEQ ID NO: 1940 - DNA, 96 bp, homo sapiens
atgaggcgagagggggtcagggctggtggcggttccgcctgtttttttttttttctctctctctctcttttcctggaggtgtgggggccggtttag

SEQ ID NO: 1941 - protein, 11 aa, homo sapiens
MMVRILVGDAV

SEQ ID NO: 1942 - DNA, 36 bp, homo sapiens
atgatggtgaggatattggtcggtgatgctgtctga

SEQ ID NO: 1943 - protein, 30 aa, homo sapiens
MLSEAPKQAGCNGGGEVRGHRERERAGWWE

SEQ ID NO: 1944 - DNA, 93 bp, homo sapiens
atgctgtctgaagctccgaagcaagcagggtgcaatggggggggagaggtaagagggcacagggaacgagaaagggctgggtggtgggaatga

SEQ ID NO: 1945 - protein, 70 aa, homo sapiens [sequence omitted]

SEQ ID NO: 1946 - DNA, 213 bp, homo sapiens
atgggcgacccgcacagacttgaatcccaggggctcctcagcagtgctgtgaaagggctgtcgctggctgggactggccttaacagaagggaaatgcactatctcgtgtcctgcgatctgggtcagcagctcggtcgtgtcatctgggatgcaggctcctttcctctttctcctcctccatttcatagctccaggttcaccactgcacagtaa

SEQ ID NO: 1947 - protein, 40 aa, homo sapiens
MQAPFLFLLLHFIAPGSPLHSNGQSKKGTIVPCAPFSGTR

SEQ ID NO: 1948 - DNA, 123 bp, homo sapiens
atgcaggctcctttcctctttctcctcctccatttcatagctccaggttcaccactgcacagtaatggccagagcaagaaagggaccattgtgccctgtgcccccttctcaggcaccaggtag

SEQ ID NO: 1949 - protein, 29 aa, homo sapiens
MARARKGPLCPVPPSQAPGRLSLCLVDQD

SEQ ID NO: 1950 - DNA, 90 bp, homo sapiens
atggccagagcaagaaagggaccattgtgccctgtgcccccttctcaggcaccaggtagactttccctctgtctcgttgaccaggactaa

SEQ ID NO: 1951 - protein, 13 aa, homo sapiens
MSLMAWAVTSPYW

SEQ ID NO: 1952 - DNA, 42 bp, homo sapiens
atgagcctaatggcatgggcagtgacatccccttactggtga

SEQ ID NO: 1953 - protein, 20 aa, homo sapiens
MWISKREYESSPSAVRCKCL

SEQ ID NO: 1954 - DNA, 63 bp, homo sapiens
atgtggatcagcaagcgggaatacgagtccagcccctccgctgtccgctgcaaatgcctctag

SEQ ID NO: 1955 - protein, 69 aa, homo sapiens
MPLGRLLLSCVIPFLAKTYLWAKNKIGKAFVLFCFWIDSGFKKTRPMKVTAVSWSEHPPKFCNVSEDFD

SEQ ID NO: 1956 - DNA, 210 bp, homo sapiens
atgcctctaggcagactgttacttagttgcgttataccctttcttgccaaaacctatctatgggcaaaaaacaagattggcaaggcttttgttttgttttgtttttggattgactcaggatttaaaaaaactagaccgatgaaggtgacagcagtcagttggagtgagcatcccccaaagttctgcaatgtgtctgaggactttgattaa

SEQ ID NO: 1957 - protein, 17 aa, homo sapiens
MGKKQDWQGFCFVLFLD

SEQ ID NO: 1958 - DNA, 54 bp, homo sapiens
atgggcaaaaaacaagattggcaaggcttttgttttgttttgtttttggattga

SEQ ID NO: 1959 - protein, 62 aa, homo sapiens
MCLRTLINLFLSHSKYREMHCYRKTLAIPKTTPLLSKENGPVLSRVPHMGGDSSAFNVNKVM

SEQ ID NO: 1960 - DNA, 189 bp, homo sapiens
atgtgtctgaggactttgattaatctttttttaagtcattccaaatatcgtgagatgcattgttacaggaagacgcttgccatccccaaaaccaccccacttctctctaaggagaatggcccagtcctctcccgagtcccacacatgggaggtgatagcagtgctttcaatgtaaataaggtaatgtaa

SEQ ID NO: 1961 - protein, 17 aa, homo sapiens
MIGLRPRHARRTVFWVV

SEQ ID NO: 1962 - DNA, 54 bp, homo sapiens
atgattggtctaaggccccggcacgctcggcgcacagtattctgggtggtgtag

SEQ ID NO: 1963 - protein, 6 aa, homo sapiens
MLTIEN

SEQ ID NO: 1964 - DNA, 21 bp, homo sapiens
atgttgacaattgagaattga

SEQ ID NO: 1965 - protein, 8 aa, homo sapiens
MDPLLSAL

SEQ ID NO: 1966 - DNA, 27 bp, homo sapiens
atggaccccctcctctcagcattatag

SEQ ID NO: 1967 - protein, 54 aa, homo sapiens [sequence omitted]

SEQ ID NO: 1968 - DNA, 165 bp, homo sapiens
atggaagaaggggttggacatgcctcattctacccctacagcaataacatcagcatagaccttaagtctgataagaaacatttacaatctatttctctgaaacttgctacctgcaggcttcatctgtatgataaaacctgggtctccaaccaaggtgatcactaa

SEQ ID NO: 1969 - protein, 28 aa, homo sapiens
MGAERLGVRGNSLTRGALAGPAAASETF

SEQ ID NO: 1970 - DNA, 87 bp, homo sapiens
atgggtgctgagcgtttaggggtgcggggcaactccctaactcgtggggccctggccggccctgccgcggcgtccgagaccttctga

SEQ ID NO: 1971 - protein, 59 aa, homo sapiens
MRRWPLFSISQSGDFSAVWGRGAHPRNLLRRGKPAWSLPLASVLLSCPSPLWVGVFQVG

SEQ ID NO: 1972 - DNA, 180 bp, homo sapiens
atgagaaggtggcccctcttctccatctcccagtcaggcgatttctctgctgtctggggcaggggcgcacaccccaggaacttactacgtagagggaagccagcctggtctctcccccttgcgtcagtgctcctaagctgcccctcaccactctgggtaggggtctttcaggtgggctag

SEQ ID NO: 1973 - protein, 11 aa, homo sapiens
MGWFPKPFSHS

SEQ ID NO: 1974 - DNA, 36 bp, homo sapiens
atgggatggttccccaagcccttttcccacagttag

SEQ ID NO: 1975 - protein, 15 aa, homo sapiens
MVPQALFPQLVSENA

SEQ ID NO: 1976 - DNA, 48 bp, homo sapiens
atggttccccaagcccttttcccacagttagtttcagaaaatgcataa

SEQ ID NO: 1977 - protein, 42 aa, homo sapiens
MRAALDGRHCQAGLVQTPRFFLGPLPTLCSGAALTWATRSKP

SEQ ID NO: 1978 - DNA, 129 bp, homo sapiens
atgagggctgcgttagatgggagacactgccaggctgggctcgtgcaaacccccagattcttcctgggccccctgccaacgctctgctcaggagcagccctaacctgggccacaaggagcaaaccctga

SEQ ID NO: 1979 - protein, 28 aa, homo sapiens
MGDTARLGSCKPPDSSWAPCQRSAQEQP

SEQ ID NO: 1980 - DNA, 87 bp, homo sapiens
atgggagacactgccaggctgggctcgtgcaaacccccagattcttcctgggccccctgccaacgctctgctcaggagcagccctaa

SEQ ID NO: 1981 - protein, 11 aa, homo sapiens
MMPQGDDAAGR

SEQ ID NO: 1982 - DNA, 36 bp, homo sapiens
atgatgccgcagggggatgatgccgcaggcagatga

SEQ ID NO: 1983 - protein, 8 aa, homo sapiens
MMPQADEQ

SEQ ID NO: 1984 - DNA, 27 bp, homo sapiens
atgatgccgcaggcagatgaacagtga

SEQ ID NO: 1985 - protein, 25 aa, homo sapiens
MEAWPLLHIHFLHNGNNNIYLVGSL

SEQ ID NO: 1986 - DNA, 78 bp, homo sapiens
atggaagcttggcctttgcttcatattcactttctgcacaatgggaataataatatctatcttgtgggctcattgtga

SEQ ID NO: 1987 - protein, 14 aa, homo sapiens
MGIIISILWAHCEM

SEQ ID NO: 1988 - DNA, 45 bp, homo sapiens
atgggaataataatatctatcttgtgggctcattgtgagatgtga

SEQ ID NO: 1989 - protein, 6 aa, homo sapiens
MCARPF

SEQ ID NO: 1990 - DNA, 21 bp, homo sapiens
atgtgcgcacgccctttctaa

SEQ ID NO: 1991 - protein, 21 aa, homo sapiens
MTMGIREWGGGQEWLQVVGSS

SEQ ID NO: 1992 - DNA, 66 bp, homo sapiens
atgaccatgggaataagggagtggggtggggggcaagaatggctgcaggtagtggggagtagttga

SEQ ID NO: 1993 - protein, 16 aa, homo sapiens
MGAGAERRGAARGRHG

SEQ ID NO: 1994 - DNA, 51 bp, homo sapiens
atgggcgccggcgcggagcgccgcggggcagcgcggggtcgccatggctga

SEQ ID NO: 1995 - protein, 210 aa, homo sapiens
MAELQQLRVQEAVESMVKSLERENIRKMQVAGLGPNQDPLLSGWVPGPSLSHHATPCTAAASPQTGCGRPWGRRGGLGQDFGSFGGSDEIRVPLPCARLFSAPSSPGQERPRRQVGSPWWQALAPPPSPLTRPLPQVSGPRPSRGAANVKDQKGEDFRPPRWPGHACFSCAQPRFTQRGFLHCSSLSPAMPLCVSVLLLSRSMRFPDSAP

SEQ ID NO: 1996 - DNA, 633 bp, homo sapiens
atggctgagctgcagcagctccgggtgcaggaggcggtggagtccatggtgaagagtctggaaagagagaacatccggaagatgcaggtagcggggctggggccgaaccaggacccccttctcagcgggtgggttccgggcccttccctcagccaccacgcgacgccttgcactgcagccgcgtccccgcagaccgggtgtgggcggccctggggtcgccggggcggcctcggacaggacttcggaagctttggcggatcggatgaaatccgtgtgcccttgccgtgcgcgaggctgttttccgccccttccagcccggggcaggagcgtcctcggcggcaggtgggaagcccctggtggcaggcgctcgccccaccaccttcccctcttacgcggccccttccgcaggtgagcggcccgaggcccagcagaggcgctgccaacgtgaaagaccagaaaggcgaggacttccggcctccccgttggccaggtcatgcctgcttctcttgcgcccaacctcgcttcacacagcgcgggtttctacactgttcttctctgagccccgcaatgcctctgtgtgtttcggtcctgcttctctcacggagtatgcgtttcccagatagtgccccttga

SEQ ID NO: 1997 - protein, 49 aa, homo sapiens
MKSVCPCRARGCFPPLPARGRSVLGGRWEAPGGRRSPHHLPLLRGPFRR

SEQ ID NO: 1998 - DNA, 150 bp, homo sapiens
atgaaatccgtgtgcccttgccgtgcgcgaggctgttttccgccccttccagcccggggcaggagcgtcctcggcggcaggtgggaagcccctggtggcaggcgctcgccccaccaccttcccctcttacgcggccccttccgcaggtga

SEQ ID NO: 1999 - protein, 21 aa, homo sapiens
MPASLAPNLASHSAGFYTVLL

SEQ ID NO: 2000 - DNA, 66 bp, homo sapiens
atgcctgcttctcttgcgcccaacctcgcttcacacagcgcgggtttctacactgttcttctctga

SEQ ID NO: 2001 - protein, 20 aa, homo sapiens
MGSCCCLFGDAAILASAREG

SEQ ID NO: 2002 - DNA, 63 bp, homo sapiens
atgggctcgtgctgctgtctcttcggagacgctgctatcttagcgtcagcgagggaaggttga

SEQ ID NO: 2003 - protein, 674 aa, homo sapiens
MQSREDAPRSRRLASPRGGKRPKKIHKPTVSAFFTGPEELKDTAHSAALLAQLKSFYDARLLCDVTIEVVTPGSGPGTGRLFPCNRNVLAAACPYFKSMFTGGMYESQQASVTMHDVDAESFEVLVDYCYTGRVSLSEANVERLYAASDMLQLEYVREACASFLARRLDLTNCTAILKFADAFGHRKLRSQAQSYIAQNFKQLSHMGSIREETLADLTLAQLLAVLRLDSLDVESEQTVCHVAVQWLEAAPKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCCDPYSGDLYKVPSPLTCLAHTRTVTTLAVCISPDHDIYLAAQPRTDLWVYKPAQNSWQQLADRLLCREGMDVAYLNGYIYILGGRDPITGVKLKEVECYNVKRNQWALVAPLPHSFLSFDLMVIRDYLYALNSKRMFCYDPSHNMWLKCVSLKRNDFQEACVFNEEIYCICDIPVMKVYNPVRAEWRQMNNIPLVSETNNYRIIKHGQKLLLITSRTPQWKKNRVTVYEYDIRGDQWINIGTTLGLLQFDSNFFCLSARVYPSCLEPGQSFLTEEEEIPSESSTEWDLGGFSEPDSESGSSSSLSDDDFWVRVAPQ

SEQ ID NO: 2004 - DNA, 2025 bp, homo sapiens
atgcagtcccgggaagacgccccgcgctctcgccgcctagccagtccccgtggtgggaagcggcccaagaagattcacaaacccacagtttcggcctttttcacgggtccagaggaattaaaggacacggcccattctgcagccctgctggcacagctcaagtccttctacgatgcgcggctgctgtgtgatgtgaccatcgaggtggtgacgcctggcagcgggcctggcacgggtcgcctgttcccctgcaaccgcaatgtgctggccgcggcatgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgatccatactcgggggacctttacaaagtgccgtcacctttgacctgtctggctcacactaggactgtcaccactttagctgtctgtatctctcctgaccatgacatctatctagctgctcagcccaggacagacctctgggtgtataaaccagctcagaatagttggcagcaacttgcagatcgcttgctgtgtcgtgagggcatggatgtggcatatctcaatggctatatctacattttgggggggcgagaccctattactggagttaagttgaaggaagtggaatgctacaatgttaagagaaaccagtgggcattggtggctccactgccccattcttttttatcctttgacctaatggtaattcgagactatctctatgctctcaacagtaagcgcatgttctgttatgatcctagccacaatatgtggctgaagtgcgtttctctgaagcgcaatgactttcaggaagcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtga

SEQ ID NO: 2005 - protein, 7 aa, homo sapiens
MRGCCVM

SEQ ID NO: 2006 - DNA, 24 bp, homo sapiens
atgcgcggctgctgtgtgatgtga

SEQ ID NO: 2007 - protein, 25 aa, homo sapiens
MCWPRHVPTSRACSQVACTRASRPA

SEQ ID NO: 2008 - DNA, 78 bp, homo sapiens
atgtgctggccgcggcatgtccctacttcaagagcatgttcacaggtggcatgtacgagagccagcaggccagcgtga

SEQ ID NO: 2009 - protein, 6 aa, homo sapiens
MLSPKL

SEQ ID NO: 2010 - DNA, 21 bp, homo sapiens
atgcttagccctaaactctaa

SEQ ID NO: 2011 - protein, 20 aa, homo sapiens
MRWQEMGYIFYIRQISQQPL

SEQ ID NO: 2012 - DNA, 63 bp, homo sapiens
atgaggtggcaagaaatgggctacattttctatatccggcaaatctcacaacaacctttatga

SEQ ID NO: 2013 - protein, 9 aa, homo sapiens
MKSKGSRRI

SEQ ID NO: 2014 - DNA, 30 bp, homo sapiens
atgaaatctaagggctcaaggaggatttag

SEQ ID NO: 2015 - protein, 15 aa, homo sapiens
MKHAHTAHHPPQILL

SEQ ID NO: 2016 - DNA, 48 bp, homo sapiens
atgaagcatgcacacaccgctcatcaccctcctcaaatattactctag

SEQ ID NO: 2017 - protein, 11 aa, homo sapiens
MFAYTLAPGRR

SEQ ID NO: 2018 - DNA, 36 bp, homo sapiens
atgtttgcttacacgttagctcctgggaggagatag

SEQ ID NO: 2019 - protein, 29 aa, homo sapiens
MKRVLPSHFPAGHKLLQFSKVSKPRQSQA

SEQ ID NO: 2020 - DNA, 90 bp, homo sapiens
atgaagcgggtactgccatcccactttccagcagggcacaagcttctccaattctccaaggtcagcaagccacggcagagccaggcctag

SEQ ID NO: 2021 - protein, 30 aa, homo sapiens
MPCAGTRGAPGGLRKVRPPHVTGQSHGRGS

SEQ ID NO: 2022 - DNA, 93 bp, homo sapiens
atgccctgtgccggcacgcgtggggcgccgggcgggttacgtaaagttcggcctccccacgtcaccgggcagagtcacggccgcggctcgtga

SEQ ID NO: 2023 - protein, 130 aa, homo sapiens
MGGAGATGRASPPLPRTGARAVPRGRAGKGPTTDAREGATAARARRSRALSRRGRIAGRRCRRRRRAAGGGRRAAQCGPGQAGQRDRPPPPLARAAGPRHHPLAAALHHCYVTGRRAGRTAGPAENFGET

SEQ ID NO: 2024 - DNA, 393 bp, homo sapiens
atggggggcgcgggggccacaggccgggcgtccccgcccctgccgcggaccggagcgcgcgctgtcccccgcgggcgagcgggcaaaggtcccacgacggacgcacgggagggagccaccgccgcccgcgcccgccgcagccgcgctctgagccgccgcggccggatcgcagggcggcggtgccgtcgccggcggcgggcggcgggcggcgggcggcgggcggcgcagtgcggccccggccaggcaggacagcgggaccgtccgccgccgccattggcccgcgccgccggcccccgccaccacccattggccgccgcgctgcaccattgttacgtcactggccggcgggcggggcgcaccgctggacccgcggaaaacttcggagaaacttga

SEQ ID NO: 2025 - protein, 64 aa, homo sapiens
MGRGLPGSRAGAAFPGGFAGRASLGRGGSPLQKGRVPPSASCARPSLGIGSGRGWRCFAFFPFS

SEQ ID NO: 2026 - DNA, 195 bp, homo sapiens
atggggaggggccttcccggctctcgggccggggcagcctttccgggcggctttgctgggcgggcttcccttgggagaggtgggagccccctccagaaaggccgtgtcccgccgagcgcttcctgcgcgaggccctccctgggaataggaagcgggagaggctggagatgtttcgcattctttccgttttcctga

SEQ ID NO: 2027 - protein, 22 aa, homo sapiens
MFRILSVFLRSFSWVQSLLKVC

SEQ ID NO: 2028 - DNA, 69 bp, homo sapiens
atgtttcgcattctttccgttttcctgagaagtttttcttgggttcagtcacttttaaaagtctgttaa

SEQ ID NO: 2029 - protein, 50 aa, homo sapiens
MRAGRWVLQTARRGLPALGPSTAGSGAAHSPPGVRQEARRLPFRRTLRVT

SEQ ID NO: 2030 - DNA, 153 bp, homo sapiens
atgcgtgcgggcaggtgggtcctgcagacggcgagacgagggctccccgctctcggacccagcaccgcgggctcgggggccgcgcactcgcctcccggagtgaggcaggaggcccggaggctgcccttccgacggacgctccgagtcacttag

SEQ ID NO: 2031 - protein, 119 aa, homo sapiens [sequence omitted]

SEQ ID NO: 2032 - DNA, 360 bp, homo sapiens
atgggggtgtctttgtcttggaacgtgtggggcctggtccagaggtggggcctggggtcctgctgggagggaggggcgccaaaggacaatggtggccccttttcaagttgcagtcaagtggacggctcacttccctgcccttctgagctttctctagcggggcctcgtgcagccagagggagccctgcggaggtggcagctgcagggacctacgggctctcctggcccggggacagctgggtgctcctgctgctgagtggccaccaggctaacgttgtctcctttctttctctctacagcattgtcccagatatagccgttggtacaaaggtaggcacttctcactttgcttctccgtga

SEQ ID NO: 2033 - protein, 30 aa, homo sapiens
MFIIISKEKKKTCKKCKNDNRKTILFRAFQ

SEQ ID NO: 2034 - DNA, 93 bp, homo sapiens
atgttcattataatctcaaaggagaaaaaaaaaacttgtaaaaaatgcaaaaatgacaacagaaaaaccatcttattccgagcattccagtaa

SEQ ID NO: 2035 - protein, 29 aa, homo sapiens
MTTEKPSYSEHSSNFFVYVLSCTISSWFV

SEQ ID NO: 2036 - DNA, 90 bp, homo sapiens
atgacaacagaaaaaccatcttattccgagcattccagtaacttttttgtgtatgtacttagctgtactataagtagttggtttgtatga

SEQ ID NO: 2037 - protein, 6 aa, homo sapiens
MYLAVL

SEQ ID NO: 2038 - DNA, 21 bp, homo sapiens
atgtacttagctgtactataa

SEQ ID NO: 2039 - protein, 19 aa, homo sapiens
MRWLKRPKIKGFFFFLFCL

SEQ ID NO: 2040 - DNA, 60 bp, homo sapiens
atgagatggttaaaaaggccaaagataaaaggtttcttttttttccttttttgtctatga

SEQ ID NO: 2041 - protein, 136 aa, homo sapiens
MAPPALRAGELGRERGGERDTRAGTKPCVRVVGQAGWLASLVSIGERPPAVAPTCESAGAGMVLGVMAGWGSRCPPCRSRRPALSHQLGPIPPAPVGAGRVPIAAAAAILASATPRHRARPGPLALSSLPARASRG

SEQ ID NO: 2042 - DNA, 411 bp, homo sapiens
atggccccgcctgccctgagagccggagaactcgggagggagagggggggagagagagacacgcgtgcggggacgaaaccttgtgttcgtgtcgtggggcaggctggatggctcgccagcctggtgagtatcggggagcgcccccctgccgtggcccctacatgtgagtcggcgggcgcggggatggttctcggcgtcatggcggggtgggggtctcggtgccctccctgccggagccgtcgtcccgccctgtcccaccagctcggccccatcccgccggctcccgttggggccggccgggttcccattgctgccgctgccgccatccttgcctctgccacaccgcgccaccgggcccggcctggcccgcttgctctctccagccttcccgctagggcgtctcgagggtag

SEQ ID NO: 2043 - protein, 19 aa, homo sapiens
MARQPGEYRGAPPCRGPYM

SEQ ID NO: 2044 - DNA, 60 bp, homo sapiens
atggctcgccagcctggtgagtatcggggagcgcccccctgccgtggcccctacatgtga

SEQ ID NO: 2045 - protein, 41 aa, homo sapiens
MGRVRWARGGVRSGGARPSLASPADSIPSASRGRASLSSRR

SEQ ID NO: 2046 - DNA, 126 bp, homo sapiens
atgggtcgggtgcggtgggcccgcgggggagtccgttcgggaggggcccgcccctccctcgcctcccccgccgactccatcccctcggccagccggggccgcgcctcactttcaagtcgccgctga

SEQ ID NO: 2047 - protein, 97 aa, homo sapiens
MACAPCCGGGNPRAPVGCCQCSPSAPVVDTASLCCETFLPLSGVWSRCCLTGGPEGNPLADVLCQEGLLVLGAPLPNPPCMTFSGGSLGFCVDEERS

SEQ ID NO: 2048 - DNA, 294 bp, homo sapiens
atggcctgtgcaccgtgctgtgggggcgggaatccccgggcgcccgtggggtgctgtcagtgttcgccctccgcccccgtggtcgacaccgcctccctgtgttgtgaaaccttcctacccctctctggagtctggtctcgttgctgtctgactggcgggcctgagggaaaccctctggcggacgtgctgtgccaggagggcctcctggtgttgggagcgcccttgccaaatccaccttgtatgacttttagcggtggatcactgggcttctgtgtcgatgaagaacgcagctag

SEQ ID NO: 2049 - protein, 67 aa, homo sapiens
MSLPGEHSSLRPHSQKLCLDSPGVGELAARIPKRYRGDVRASGGGKPQARRALARSTGSLGSALQGG

SEQ ID NO: 2050 - DNA, 204 bp, homo sapiens
atgtcactgcctggtgagcactcttccctcagaccccattcccagaagctctgcctcgattccccaggggtaggcgagctggctgcccgaattcctaagcgttaccggggagatgtgagggcctccgggggcgggaaacctcaggccaggcgcgcgctggcccgctctacggggtctctcgggagcgctttgcagggcggatga

SEQ ID NO: 2051 - protein, 123 aa, homo sapiens [sequence omitted]

SEQ ID NO: 2052 - DNA, 372 bp, homo sapiens
atgactgacgggccagctacctgccttcctgagcctgcagagataaacagcctatcctccctgtgcacacaggccccgagggcgggcaggtctccaagcgcagcacaactgccccaggcccgacgcagccacctgcccgagggctccctccccaccaggccatccctcagccggtcctcctccgacagcgaacaaggaaccccggaggcgcggaggcgtctcgccgccacccggcggcgcctgccagaggcccttcgcgatgtccgcaagcagagaaagccctgccctcccaagccccggcttcccctaggcccctcgacacttgtagtgtcctcacttgcggcccctgacccggggctgaccggttcgtga

SEQ ID NO: 2053 - protein, 16 aa, homo sapiens
MSASRESPALPSPGFP

SEQ ID NO: 2054 - DNA, 51 bp, homo sapiens
atgtccgcaagcagagaaagccctgccctcccaagccccggcttcccctag

SEQ ID NO: 2055 - protein, 81 aa, homo sapiens
MFQRKLRGAWAFRRLLRSVSALESRSANPRSCFQLGGRGVSRPCNCRRLLFFPCLLASCLPGKGKSKLLNFGKGSEANLNS

SEQ ID NO: 2056 - DNA, 246 bp, homo sapiens
atgtttcagagaaagttacgtggagcgtgggcgtttcgcagactcctaaggtcagtgtctgccctagagagccggagtgcaaacccgaggtcttgttttcagctgggaggtcgtggagtttcacgaccttgtaattgtcgccgtttgcttttttttccctgtttattggcttcctgtctccctggaaaaggcaaatcaaagctgctgaattttgggaaaggcagtgaagcaaacctaaactcctaa

SEQ ID NO: 2057 - protein, 56 aa, homo sapiens; identical to SEQ ID NO: 425

SEQ ID NO: 2058 - DNA, 171 bp, homo sapiens; identical to SEQ ID NO: 426

SEQ ID NO: 2059 - protein, 50 aa, homo sapiens; identical to SEQ ID NO: 427

SEQ ID NO: 2060 - DNA, 153 bp, homo sapiens; identical to SEQ ID NO: 428

SEQ ID NO: 2061 - protein, 99 aa, homo sapiens; identical to SEQ ID NO: 429

SEQ ID NO: 2062 - DNA, 300 bp, homo sapiens; identical to SEQ ID NO: 430

SEQ ID NO: 2063 - protein, 143 aa, homo sapiens [sequence omitted]

SEQ ID NO: 2064 - DNA, 432 bp, homo sapiens; identical to SEQ ID NO: 432

SEQ ID NO: 2065 - protein, 63 aa, homo sapiens
MAAVGITKRRSGNDVFLFLPRRKRGCMRFGNRQSHLVNVTDAKSPGLGKKKSLGEWDGSDSLS

SEQ ID NO: 2066 - DNA, 192 bp, homo sapiens
atggcggcagtaggaataacaaaacgcagaagcgggaacgatgtctttttattcctccccagacgcaaacgtggatgcatgaggtttggtaacaggcaaagtcatctggttaacgtgactgatgcaaaaagtcccggcctgggcaaaaagaagtcactgggtgaatgggatggatcagactccctgtcctga

SEQ ID NO: 2067 - protein, 13 aa, homo sapiens
MSFYSSPDANVDA

SEQ ID NO: 2068 - DNA, 42 bp, homo sapiens
atgtctttttattcctccccagacgcaaacgtggatgcatga

SEQ ID NO: 2069 - protein, 5 aa, homo sapiens
MHEVW

SEQ ID NO: 2070 - DNA, 18 bp, homo sapiens
atgcatgaggtttggtaa

SEQ ID NO: 2071 - protein, 33 aa, homo sapiens
MQKVPAWAKRSHWVNGMDQTPCPEGEMVSCRTR

SEQ ID NO: 2072 - DNA, 102 bp, homo sapiens
atgcaaaaagtcccggcctgggcaaaaagaagtcactgggtgaatgggatggatcagactccctgtcctgagggggagatggtttcttgcagaacgaggtga

SEQ ID NO: 2073 - protein, 51 aa, homo sapiens
MVSFVFFFVVVCLFVLRWSPAPSPRWKCSVMISAHCNLGLPGSSDSPASAS

SEQ ID NO: 2074 - DNA, 156 bp, homo sapiens
atggtctcatttgtttttttttttgttgttgtttgtttgtttgttttgagatggagtccagctccgtcacctaggtggaaatgcagtgtcatgatctcagctcactgcaacctcggcctcccaggttcaagcgattctcctgcctcagcctcctga

SEQ ID NO: 2075 - protein, 7 aa, homo sapiens
MESSSVT

SEQ ID NO: 2076 - DNA, 24 bp, homo sapiens
atggagtccagctccgtcacctag

SEQ ID NO: 2077 - protein, 38 aa, homo sapiens
MQCHDLSSLQPRPPRFKRFSCLSLLSSWNLQVPTTTPS

SEQ ID NO: 2078 - DNA, 117 bp, homo sapiens
atgcagtgtcatgatctcagctcactgcaacctcggcctcccaggttcaagcgattctcctgcctcagcctcctgagtagctggaatttacaggtgcccaccaccacacccagctaa

SEQ ID NO: 2079 - protein, 26 aa, homo sapiens
MIRPPRPPKVRDSKYEPPRPVSLICF

SEQ ID NO: 2080 - DNA, 81 bp, homo sapiens
atgattcgcccgcctaggcctcccaaagtgcgggattccaagtatgagccaccgcgcccagtcagtctcatttgtttttaa

SEQ ID NO: 2081 - protein, 4 aa, homo sapiens
MTPS

SEQ ID NO: 2082 - DNA, 15 bp, homo sapiens
atgacaccctcgtga

SEQ ID NO: 2083 - protein, 93 aa, homo sapiens
MVMRGAGARVVAGAGSSTNGSGAGQLVKAGGAGLGCGSARRTLGALARLSTGSGGLFLEPGVLLGSRAKGVLGTSSVGFPSSRVAALSAKQNR

SEQ ID NO: 2084 - DNA, 282 bp, homo sapiens
atggtgatgaggggtgctggggccagggtggtggcaggagctggcagctccacaaatggctcgggtgctgggcagctggtgaaggcgggtggtgcgggactgggctgcggcagtgcccggcgcaccttgggggccttggctcgcttgtccacaggctctggggggctcttcttggaacctggggtgctgctcggctccagggctaagggggtactggggacttcgtctgttgggttcccttcctccagggtagcagctctgtctgcaaaacaaaacagatga

SEQ ID NO: 2085 - protein, 8 aa, homo sapiens
MARVLGSW

SEQ ID NO: 2086 - DNA, 27 bp, homo sapiens
atggctcgggtgctgggcagctggtga

SEQ ID NO: 2087 - protein, 23 aa, homo sapiens
MRGWGGGFLAEMSCGFHQKGLLL

SEQ ID NO: 2088 - DNA, 72 bp, homo sapiens
atgagaggctggggcgggggcttcctggcagagatgagctgtggctttcatcagaaaggcctgcttctgtga

SEQ ID NO: 2089 - protein, 531 aa, homo sapiens
MTMLAAVLAGPLAARVCAAGGAACTTLLGDSALTPGAGAAAAAPGPGWPLTPAGPPAAGAGAGAAPALPPFWAAAGGGTAGAAVGGPAGWPGGRARVAGAGGGGGGAAAGAAGAGAAGGEGAAGAGGAAAPTKGGVWMTVPGAAGLGSGSSAAGPLLTRLTAGAAAWCEFSSAALPFKVCAAPGPAGLPGPGPGPGPGPGPGPGPARAASAAGPAGLAGPAGAGSGPAATAAAAGTGAQDPALPSGGGLSFAAGGAGPAGTRGRRGEGGPGRCGPPPPGRALPAGGGSGAAPGAPSAGAAGPAPAAPAGLPLTTWFPSAPAAAARTSGVRGARWWWWAALAASCDSSEPTRSLTTFSSTSLLKKTSSSRSEPAAIFFPRPPPPPPLGPSAPGRGGGSDWGGRWAGGGRRAAGGGRGRAAGGRGSGGGGPAQARRPRAPGDWLRRALKRRGQWLRALEAGARAVGRGAAAAAGSAGAGAQGRGRRGGGGRGGGRRAGRGMRERCAGPGRGGRGAATGPRSLSRLAPKWLRRR

SEQ ID NO: 2090 - DNA, 1596 bp, homo sapiens
atgaccatgctggccgccgtgctggccgggccgctggccgccagggtctgcgccgccgggggcgccgcctgcaccaccctcttgggcgactcggccttgacccccggcgccggcgccgcagccgccgcgccgggcccgggttggccgctgacccccgcggggcccccggcggccggggcgggggcgggggctgccccggcgctgcccccgttctgggcggcggcggggggcggcacggcgggcgcggcggtcgggggtccggcggggtggccgggcggccgggccagagtggcgggcgcggggggtggcgggggcggggcggcggcgggggcggcgggcgcgggggcggcggggggcgagggcgcggcgggcgcggggggcgcggcggcgcccacgaaggggggcgtctggatgacagtgccgggggcggcgggcttgggcagcggcagcagcgcggcgggcccgttgttgaccaggctgacagcaggtgcggcggcgtggtgcgagttcagcagcgcggcgctcccattcaaagtttgcgcggcgccggggccggcgggcttgccagggccagggccggggccggggccggggccgggcccggggccggggccggcgcgggcggccagcgcggcggggccggcgggcttggcggggccggcgggggcgggctcgggccccgcggcgacggcggcggcggcgggcaccggggcgcaggaccccgcgctgccctcgggcggcggcctcagcttcgcggcgggcggcgcgggccctgcggggacaagggggcggcgcggtgagggggggcccgggcgctgcggccccccgccccccggccgcgctctacctgcggggggcggctccggcgccgctccgggcgcgccctcggcgggggcggccggccctgcgcccgcggctccggccgggctgccgctcacaacatggttcccgagcgcgccggcggccgcggcccgcacctcgggcgtgcgcggcgcgaggtggtggtggtgggccgcgctggccgccagctgcgactccagcgagcccaccaggtcgctcaccactttctcgtccacctcgctgttgaagaagacctcgtccagcagatccgagcccgccgccatcttttttcctcggccgccgccgccgccgccgctcgggccgagcgcgcctgggcgaggaggaggttccgactggggcgggcgctgggcgggcggggggcggcgcgcggccggcggggggcgggggcgcgcggccggggggcgggggagcgggggtggcggccctgcgcaggcgcggagaccgcgggcgcccggcgattggctgcggcgcgcgcttaaaaggcgcggccaatggctgcgagcgctagaggccggggcgcgggcggtcggccggggtgcggcagcagcggcgggaagcgcgggggctggagctcaggggcgcgggcgccggggcggtggcggacggggagggggccgccgggcggggcgcgggatgcgggaacggtgcgctgggccgggccgaggcgggcgcggggcggcgacggggcctcgctctttgtctcggctcgctccaaaatggctgcggcggcgctga

SEQ ID NO: 2091 - protein, 132 aa, homo sapiens
MVPERAGGRGPHLGRARREVVVVGRAGRQLRLQRAHQVAHHFLVHLAVEEDLVQQIRARRHLFSSAAAAAAARAERAWARRRFRLGRALGGRGAARGRRGAGARGRGAGERGWRPCAGAETAGARRLAAARA

SEQ ID NO: 2092 - DNA, 399 bp, homo sapiens
atggttcccgagcgcgccggcggccgcggcccgcacctcgggcgtgcgcggcgcgaggtggtggtggtgggccgcgctggccgccagctgcgactccagcgagcccaccaggtcgctcaccactttctcgtccacctcgctgttgaagaagacctcgtccagcagatccgagcccgccgccatcttttttcctcggccgccgccgccgccgccgctcgggccgagcgcgcctgggcgaggaggaggttccgactggggcgggcgctgggcgggcggggggcggcgcgcggccggcggggggcgggggcgcgcggccggggggcgggggagcgggggtggcggccctgcgcaggcgcggagaccgcgggcgcccggcgattggctgcggcgcgcgcttaa

SEQ ID NO: 2093 - protein, 214 aa, homo sapiens [sequence omitted]

SEQ ID NO: 2094 - DNA, 645 bp, homo sapiens
atggctgcgagcgctagaggccggggcgcgggcggtcggccggggtgcggcagcagcggcgggaagcgcgggggctggagctcaggggcgcgggcgccggggcggtggcggacggggagggggccgccgggcggggcgcgggatgcgggaacggtgcgctgggccgggccgaggcgggcgcggggcggcgacggggcctcgctctttgtctcggctcgctccaaaatggctgcggcggcgctgacgggagcgccgggcgggcgccgtgcgcggtggcagcggcggcgcagggcccgtccgaggcccggggaacagcgcgcggggatgccggggcgccgccgggcggcgcgcaggccctggagtggatgggcctgggaggcgggcgggaacggggaggggactgtcgcagcgcgccctggggacggggaccggcgcccggcccctccaagccgccgcggggaagctgggtccgcctctggctcagccggtcccgggcggtggggaggggtcctgcgcgcacggctcttctcgccctccaatcgtgaccacccctggcccttccctccatttttaatcaataaacccagccgccccgggctgactgtccccgcacccagctgccttggagacaggagtgtcgtataa

SEQ ID NO: 2095 - protein, 59 aa, homo sapiens
MGLGGGRERGGDCRSAPWGRGPAPGPSKPPRGSWVRLWLSRSRAVGRGPARTALLALQS

SEQ ID NO: 2096 - DNA, 180 bp, homo sapiens
atgggcctgggaggcgggcgggaacggggaggggactgtcgcagcgcgccctggggacggggaccggcgcccggcccctccaagccgccgcggggaagctgggtccgcctctggctcagccggtcccgggcggtggggaggggtcctgcgcgcacggctcttctcgccctccaatcgtga

SEQ ID NO: 2097 - protein, 15 aa, homo sapiens
MGLASCRRGPGCCCS

SEQ ID NO: 2098 - DNA, 48 bp, homo sapiens
atgggcctcgcttcctgccggcgcggcccgggctgctgctgttcctga

SEQ ID NO: 2099 - protein, 11 aa, homo sapiens
MANRIPKTSSY

SEQ ID NO: 2100 - DNA, 36 bp, homo sapiens
atggcaaaccgtatcccaaaaacctcgagttattga

SEQ ID NO: 2101 - protein, 6 aa, homo sapiens
MEEERI

SEQ ID NO: 2102 - DNA, 21 bp, homo sapiens
atggaggaagaacgcatttaa

SEQ ID NO: 2103 - protein, 22 aa, homo sapiens
MPVATWAWFLSYSNGFVFYLQG

SEQ ID NO: 2104 - DNA, 69 bp, homo sapiens
atgccagtagccacgtgggcatggtttttaagctattcgaatggtttcgttttttatctacaaggatag

SEQ ID NO: 2105 - protein, 103 aa, homo sapiens
MRKRRRRKRRKTKRKRRRRKRRRRRRRGRRRPVRPPWSWQRCSYGPRRHGPRRRSPRPRSCRLPPPLLSPSHCCCCCCSRTLRPRPAQPGPCPGSWGSQSPRT

SEQ ID NO: 2106 - DNA, 312 bp, homo sapiens
atgaggaagaggaggaggaggaagaggaggaagacgaagaggaagaggaggaggaggaagaggaggaggaggaggaggagggggaggaggaggccggtgaggccgccctggagctggcagcgctgcagttacggcccccggcgccacggcccccggcgccgcagcccccgtccccgttcttgtcgccttcctcctccccttctgtctccgagccactgctgctgctgctgctgctctcggactcttcggccccgtcctgctcagcctgggccttgtccgggctcttggggttcccagagtcctcgaacgtga

SEQ ID NO: 2107 - protein, 4 aa, homo sapiens
MTPP

SEQ ID NO: 2108 - DNA, 15 bp, homo sapiens
atgacacccccgtga

SEQ ID NO: 2109 - protein, 93 aa, homo sapiens
MVMRGAGARVVAGAGSSTNGSGAGQLVKAGGAGLGCGSARRTLGALARLSTGSGGLFLEPGVLLGSRAKGVLGTSSVGFPSSRVEALSAKQNR

SEQ ID NO: 2110 - DNA, 282 bp, homo sapiens
atggtgatgaggggtgctggggccagggtggtggcaggagctggcagctccacaaatggctcgggtgctgggcagctggtgaaggcgggtggtgcgggactgggctgcggcagtgcccggcgcaccttgggggccttggctcgcttgtccacaggctctggggggctcttcttggaacctggggtgctgcttggctccagggctaagggggtactggggacttcgtctgttgggttcccttcctccagggtagaagctctgtctgcaaaacaaaacagatga

SEQ ID NO: 2111 - protein, 8 aa, homo sapiens
MARVLGSW

SEQ ID NO: 2112 - DNA, 27 bp, homo sapiens
atggctcgggtgctgggcagctggtga

SEQ ID NO: 2113 - protein, 23 aa, homo sapiens
MGDGQAGGAGRGCGHFPPVPNLQ

SEQ ID NO: 2114 - DNA, 72 bp, homo sapiens
atgggtgacggccaggctggcggagcgggaaggggatgcgggcacttccctcctgtccccaacctacagtga

SEQ ID NO: 2115 - protein, 30 aa, homo sapiens
MRALPSCPQPTVTPALSTEDALISSILALL

SEQ ID NO: 2116 - DNA, 93 bp, homo sapiens
atgcgggcacttccctcctgtccccaacctacagtgacaccggcgctgagcacggaggatgcactcatttcctccatccttgcgcttctgtga

SEQ ID NO: 2117 - protein, 24 aa, homo sapiens
MHSFPPSLRFCEMGRVPATGSWRS

SEQ ID NO: 2118 - DNA, 75 bp, homo sapiens
atgcactcatttcctccatccttgcgcttctgtgaaatgggtagagtccctgccaccgggagttggaggtcttaa

SEQ ID NO: 2119 - protein, 12 aa, homo sapiens
MLSARAHRPCFF

SEQ ID NO: 2120 - DNA, 39 bp, homo sapiens
atgctttcagctagagctcatcgcccctgcttcttctga

SEQ ID NO: 2121 - protein, 7 aa, homo sapiens
MAGERPR

SEQ ID NO: 2122 - DNA, 24 bp, homo sapiens
atggccggtgaaaggccccgttga

SEQ ID NO: 2123 - protein, 7 aa, homo sapiens
MNGNADL

SEQ ID NO: 2124 - DNA, 24 bp, homo sapiens
atgaatggcaatgctgacctctga

SEQ ID NO: 2125 - protein, 84 aa, homo sapiens [sequence omitted]

SEQ ID NO: 2126 - DNA, 255 bp, homo sapiens
atggcaatgctgacctctgagcagcttggaggtgggaacactgagcactttcacacccattcaactggtaatcagttaacaaggaggacaactgggccgaaaatgccaagggcactggtgacttttagcctcttcccatatcctaaaaactcagagctgcacagaaagacagttttaacaatcggtcagattattacaaataataataatggcaaacatttattgagcactcgctatatgccagagggtttataa

SEQ ID NO: 2127 - protein, 5 aa, homo sapiens
MANIY

SEQ ID NO: 2128 - DNA, 18 bp, homo sapiens
atggcaaacatttattga

SEQ ID NO: 2129 - protein, 6 aa, homo sapiens
MSLASQ

SEQ ID NO: 2130 - DNA, 21 bp, homo sapiens
atgtccttggcttctcagtga

SEQ ID NO: 2131 - protein, 14 aa, homo sapiens
MVVGHGGATCPTPA

SEQ ID NO: 2132 - DNA, 45 bp, homo sapiens
atggtggtaggtcacggaggcgccacctgccccacgcctgcctag

SEQ ID NO: 2133 - protein, 18 aa, homo sapiens
MLHSWEFPSPPTEPGRRR

SEQ ID NO: 2134 - DNA, 57 bp, homo sapiens
atgcttcactcctgggaattcccgtcacctcctaccgagcccgggcgccgcaggtag

SEQ ID NO: 2135 - protein, 88 aa, homo sapiens
MRVARGTGGPGQGWRVGRAARQVNQGFTPRLRGRRRDVQALPKAQLATHNLGSRRHRSSSFLLETKTKPFGDLNLFTKWNPILHFTLG

SEQ ID NO: 2136 - DNA, 267 bp, homo sapiens
atgagggtggcccggggcaccggaggacctgggcagggctggcgtgtgggccgagcagcccggcaagttaatcagggcttcacacccagactccggggccgccggcgagatgtacaggcccttcccaaagcccagctggccacccataacctgggaagccggcggcacagaagctcgtccttcctcctggaaacaaaaacaaagccctttggagacttgaatctgttcacgaagtggaaccccatattgcacttcactcttggatag

SEQ ID NO: 2137 - protein, 116 aa, homo sapiens [sequence omitted]

SEQ ID NO: 2138 - DNA, 351 bp, homo sapiens; identical to SEQ ID NO: 826

SEQ ID NO: 2139 - protein, 37 aa, homo sapiens; identical to SEQ ID NO: 827

SEQ ID NO: 2140 - DNA, 114 bp, homo sapiens; identical to SEQ ID NO: 828

SEQ ID NO: 2141 - protein, 28 aa, homo sapiens
MLWWWCLTSSSPEESFMMLRLNRQVLAL

SEQ ID NO: 2142 - DNA, 87 bp, homo sapiens; identical to SEQ ID NO: 830

SEQ ID NO: 2143 - protein, 8 aa, homo sapiens
MNKGIRGQ

SEQ ID NO: 2144 - DNA, 27 bp, homo sapiens
atgaacaagggcatcagaggccagtag

SEQ ID NO: 2145 - protein, 116 aa, homo sapiens [sequence omitted]

SEQ ID NO: 2146 - DNA, 351 bp, homo sapiens; identical to SEQ ID NO: 826

SEQ ID NO: 2147 - protein, 37 aa, homo sapiens; identical to SEQ ID NO: 827

SEQ ID NO: 2148 - DNA, 114 bp, homo sapiens; identical to SEQ ID NO: 828

SEQ ID NO: 2149 - protein, 28 aa, homo sapiens
MLWWWCLTSSSPEESFMMLRLNRQVLAL

SEQ ID NO: 2150 - DNA, 87 bp, homo sapiens; identical to SEQ ID NO: 830

SEQ ID NO: 2151 - protein, 8 aa, homo sapiens
MNKGIRGQ

SEQ ID NO: 2152 - DNA, 27 bp, homo sapiens
atgaacaagggcatcagaggccagtag

SEQ ID NO: 2153 - protein, 116 aa, homo sapiens [sequence omitted]

SEQ ID NO: 2154 - DNA, 351 bp, homo sapiens; identical to SEQ ID NO: 826

SEQ ID NO: 2155 - protein, 37 aa, homo sapiens; identical to SEQ ID NO: 827

SEQ ID NO: 2156 - DNA, 114 bp, homo sapiens; identical to SEQ ID NO: 828

SEQ ID NO: 2157 - protein, 28 aa, homo sapiens
MLWWWCLTSSSPEESFMMLRLNRQVLAL

SEQ ID NO: 2158 - DNA, 87 bp, homo sapiens; identical to SEQ ID NO: 830

SEQ ID NO: 2159 - protein, 8 aa, homo sapiens
MNKGIRGQ

SEQ ID NO: 2160 - DNA, 27 bp, homo sapiens
atgaacaagggcatcagaggccagtag

SEQ ID NO: 2161 - protein, 173 aa, homo sapiens
MSHHQCVLGLLPWLPNYLPHSIIVLIPKGSRITSLLCSAPSCGSHVTQSQRQDLGSVPKSRVVVCPHSAFLTSSLQPHWLPPSSWNISGTRQPQGLCTCCSLFLRLCALREPQASLSHLLQVFPSFSFFPFSFFFSFLSFCCFFFFFFFFLIHQAGVQWHDLGSLQSPPPGFK

SEQ ID NO: 2162 - DNA, 522 bp, homo sapiens
atgagccaccaccagtgtgtgcttggattgttgccatggcttccaaactatctcccccattctatcattgtcttgatacccaaaggaagtcggatcacgtctctgctctgctcagcaccctcctgtggctcccatgtcacccagagtcaaagacaagatcttggcagtgtccctaaatcccgtgtggttgtatgcccccactctgcctttctgacatcttccctccagccacactggcttcctccctcctcctggaacatatcaggcacacggcagcctcagggcctttgcacttgctgttccctcttcctgagactctgtgccctgagagaaccacaagcctccctctctcacctcctccaggtctttccctcattttctttttttcctttttcctttttcttttcttttctttctttctgttgttttttttttttttttttttttttcctgatacaccaggctggagtgcagtggcatgatcttggctcgctgcaatctccgcctcctgggttcaagtaa

SEQ ID NO: 2163 - protein, 46 aa, homo sapiens
MASKLSPPFYHCLDTQRKSDHVSALLSTLLWLPCHPESKTRSWQCP

SEQ ID NO: 2164 - DNA, 141 bp, homo sapiens
atggcttccaaactatctcccccattctatcattgtcttgatacccaaaggaagtcggatcacgtctctgctctgctcagcaccctcctgtggctcccatgtcacccagagtcaaagacaagatcttggcagtgtccctaa

SEQ ID NO: 2165 - protein, 26 aa, homo sapiens
MSPRVKDKILAVSLNPVWLYAPTLPF

SEQ ID NO: 2166 - DNA, 81 bp, homo sapiens
atgtcacccagagtcaaagacaagatcttggcagtgtccctaaatcccgtgtggttgtatgcccccactctgcctttctga

SEQ ID NO: 2167 - protein, 96 aa, homo sapiens
MPPLCLSDIFPPATLASSLLLEHIRHTAASGPLHLLFPLPETLCPERTTSLPLSPPPGLSLIFFFSFFLFLFFSFFLLFFFFFFFFPDTPGWSAVA

SEQ ID NO: 2168 - DNA, 291 bp, homo sapiens
atgcccccactctgcctttctgacatcttccctccagccacactggcttcctccctcctcctggaacatatcaggcacacggcagcctcagggcctttgcacttgctgttccctcttcctgagactctgtgccctgagagaaccacaagcctccctctctcacctcctccaggtctttccctcattttctttttttcctttttcctttttcttttcttttctttctttctgttgttttttttttttttttttttttttcctgatacaccaggctggagtgcagtggcatga

SEQ ID NO: 2169 - protein, 19 aa, homo sapiens
MVNGSRNSSPVRPSLSCSP

SEQ ID NO: 2170 - DNA, 60 bp, homo sapiens
atggtgaacggcagcaggaactcatcgcccgtgcggccctcgttgagctgcagcccgtag

SEQ ID NO: 2171 - protein, 6 aa, homo sapiens
MMESRA

SEQ ID NO: 2172 - DNA, 21 bp, homo sapiens
atgatggagtcacgtgcgtga

SEQ ID NO: 2173 - protein, 13 aa, homo sapiens
MHRSSRPHRNSTR

SEQ ID NO: 2174 - DNA, 42 bp, homo sapiens
atgcacaggtccagcaggccgcataggaactccacgcgctga

SEQ ID NO: 2175 - protein, 8 aa, homo sapiens
MPVPSSGR

SEQ ID NO: 2176 - DNA, 27 bp, homo sapiens
atgcccgtgcccagcagcggccggtga

SEQ ID NO: 2177 - protein, 46 aa, homo sapiens
MRMPPHSLLQMVTKLPAQLTSAEPVTRPALLQFRMWYSHPVWGWNC

SEQ ID NO: 2178 - DNA, 141 bp, homo sapiens
atgaggatgccgccgcacagcctacttcaaatggtcactaagttgcctgcacagctaacatctgccgagcctgtgacacgaccagctttgcttcaatttcgaatgtggtactcccacccagtttgggggtggaactgttag

SEQ ID NO: 2179 - protein, 51 aa, homo sapiens
MVEPAPGSLCQLGLPGHRPRALSKAGPVFIPCFLASVPPKALERPWSQRSG

SEQ ID NO: 2180 - DNA, 156 bp, homo sapiens
atggttgaacctgcaccagggtcactgtgtcagctgggcctgccaggccaccgtccccgagctctgtccaaggcagggccagtgttcataccttgcttccttgccagtgtcccacccaaggccctggaaaggccctggagtcagagatccggctaa

SEQ ID NO: 2181 - protein, 22 aa, homo sapiens
MPHTCCVTMGQRLSLSVPPGLL

SEQ ID NO: 2182 - DNA, 69 bp, homo sapiens
atgccccatacctgctgtgtgactatgggccagcgactcagcctctctgtgcctcccgggttgctgtga

SEQ ID NO: 2183 - protein, 5 aa, homo sapiens
MHRGP

SEQ ID NO: 2184 - DNA, 18 bp, homo sapiens
atgcacagagggccctga

SEQ ID NO: 2185 - protein, 40 aa, homo sapiens
MRVPVASYPHQHWILIICFQKPSQWEYMSLISYVFYKYSL

SEQ ID NO: 2186 - DNA, 123 bp, homo sapiens
atgagagttccagtggcttcatatcctcaccagcattggatattaattatctgttttcaaaagccatctcagtgggaatatatgtcacttatcagctatgtgttttacaaatatagtctttaa

SEQ ID NO: 2187 - protein, 61 aa, homo sapiens
MCFTNIVFKSVACHHFLNSVFQSIEVLHFYKVKFIIILWFKKPSQWEYMSLISYVFYKYSL

SEQ ID NO: 2188 - DNA, 186 bp, homo sapiens
atgtgttttacaaatatagtctttaagtctgtggcttgtcatcattttcttaacagtgtctttcaaagtatagaagttctacatttttataaagtcaaatttatcattattttatggtttaaaaagccatctcagtgggaatatatgtcacttatcagctatgtgttttacaaatatagtctttaa

SEQ ID NO: 2189 - protein, 46 aa, homo sapiens
MCFTNIVFKSVACHHFLNSVFQSIEVLHFYEVKFIIILWFMLFCLS

SEQ ID NO: 2190 - DNA, 141 bp, homo sapiens
atgtgttttacaaatatagtctttaagtctgtggcttgtcatcattttcttaacagtgtctttcaaagtatagaagttctacatttttatgaggtcaaatttatcattattttatggtttatgcttttttgtcttagctaa

SEQ ID NO: 2191 - protein, 34 aa, homo sapiens
MRSNLSLFYGLCFFVLAKKSLSNSRSQRFFSFFY

SEQ ID NO: 2192 - DNA, 105 bp, homo sapiens
atgaggtcaaatttatcattattttatggtttatgcttttttgtcttagctaagaaatctttgtctaactcaaggtcacaaagatttttctcctttttttattag

SEQ ID NO: 2193 - protein, 45 aa, homo sapiens; identical to SEQ ID NO: 1745

SEQ ID NO: 2194 - DNA, 138 bp, homo sapiens; identical to SEQ ID NO: 1746

SEQ ID NO: 2195 - protein, 45 aa, homo sapiens; identical to SEQ ID NO: 1747

SEQ ID NO: 2196 - DNA, 138 bp, homo sapiens; identical to SEQ ID NO: 1748

SEQ ID NO: 2197 - protein, 13 aa, homo sapiens
MYAKKRGRSRTEC

SEQ ID NO: 2198 - DNA, 42 bp, homo sapiens; identical to SEQ ID NO: 1750

SEQ ID NO: 2199 - protein, 44 aa, homo sapiens; identical to SEQ ID NO: 1751

SEQ ID NO: 2200 - DNA, 135 bp, homo sapiens; identical to SEQ ID NO: 1752

SEQ ID NO: 2201 - protein, 5 aa, homo sapiens
MIISR

SEQ ID NO: 2202 - DNA, 18 bp, homo sapiens
atgataatctcacgataa

SEQ ID NO: 2203 - protein, 5 aa, homo sapiens
MVSIW

SEQ ID NO: 2204 - DNA, 18 bp, homo sapiens
atggtttctatatggtaa

SEQ ID NO: 2205 - protein, 50 aa, homo sapiens
MVKCRVSLCLYNISFPSVFDFKQPILRIILDLTNYSCGIYCVWSLVSYGN

SEQ ID NO: 2206 - DNA, 153 bp, homo sapiens
atggtaaaatgccgtgtaagtctttgtttgtataacatttcttttccaagtgttttcgattttaaacaacccatacttagaataatacttgatttaactaactatagttgtggaatatattgtgtttggtctttggttagctatggtaactaa

SEQ ID NO: 2207 - protein, 8 aa, homo sapiens
MPCKSLFV

SEQ ID NO: 2208 - DNA, 27 bp, homo sapiens
atgccgtgtaagtctttgtttgtataa

SEQ ID NO: 2209 - protein, 10 aa, homo sapiens
MATYVAHLQS

SEQ ID NO: 2210 - DNA, 33 bp, homo sapiens
atggcaacttatgttgcacacctgcaatcctga

SEQ ID NO: 2211 - protein, 20 aa, homo sapiens
MLHTCNPESLGIQKEPPFPE

SEQ ID NO: 2212 - DNA, 63 bp, homo sapiens
atgttgcacacctgcaatcctgagtccttggggatacagaaggagcccccatttcctgagtga

SEQ ID NO: 2213 - protein, 5 aa, homo sapiens
MHILI

SEQ ID NO: 2214 - DNA, 18 bp, homo sapiens
atgcacattctaatctaa

SEQ ID NO: 2215 - protein, 25 aa, homo sapiens
MILLKEKEKKDTQGPYNSGDCIGSI

SEQ ID NO: 2216 - DNA, 78 bp, homo sapiens
atgattcttttgaaggagaaagaaaagaaggacacccaagggccgtataatagtggggactgtataggaagcatatag

SEQ ID NO: 2217 - protein, 64 aa, homo sapiens
MQGELKLCHPGRKPSDLASFGASLGDSLQLSFNTFQQFCVLYYHKNSFCIFYPLSNRNLNMHME

SEQ ID NO: 2218 - DNA, 195 bp, homo sapiens
atgcagggcgagctcaagctgtgccacccaggcaggaaaccctccgaccttgccagctttggcgccagccttggtgactctctccagctcagcttcaacacctttcaacagttctgtgttctctattatcacaagaattctttctgtattttctatcctttatcaaataggaatttaaatatgcatatggagtga

SEQ ID NO: 2219 - protein, 21 aa, homo sapiens
MCLFCLMYNFLRSKIMTLLQI

SEQ ID NO: 2220 - DNA, 66 bp, homo sapiens
atgtgtcttttttgtttaatgtataattttctaagaagtaaaattatgactctactgcaaatataa

SEQ ID NO: 2221 - protein, 29 aa, homo sapiens
MFFNSISDEGSSNRFKSLQGTLKELYSQC

SEQ ID NO: 2222 - DNA, 90 bp, homo sapiens
atgtttttcaactcaataagcgatgagggttccagtaacaggttcaaatcattgcaaggaacattaaaggagctttacagccaatgttaa

SEQ ID NO: 2223 - protein, 14 aa, homo sapiens
MRVPVTGSNHCKEH

SEQ ID NO: 2224 - DNA, 45 bp, homo sapiens
atgagggttccagtaacaggttcaaatcattgcaaggaacattaa

SEQ ID NO: 2225 - protein, 21 aa, homo sapiens
MLIGTSWSAIFLVTLRLIQID

SEQ ID NO: 2226 - DNA, 66 bp, homo sapiens
atgttaataggtacctcttggagtgccattttccttgtaacccttagattaattcagattgactga

SEQ ID NO: 2227 - protein, 5 aa, homo sapiens
MLLCI

SEQ ID NO: 2228 - DNA, 18 bp, homo sapiens
atgctgctttgcatctag

SEQ ID NO: 2229 - protein, 4 aa, homo sapiens
MFRK

SEQ ID NO: 2230 - DNA, 15 bp, homo sapiens
atgtttagaaaatag

SEQ ID NO: 2231 - protein, 39 aa, homo sapiens
MSPLLSASALGKFPRTSLLCLLKYENKINVAQQARESLL

SEQ ID NO: 2232 - DNA, 120 bp, homo sapiens
atgtcaccactcttgtcagcatctgcattgggcaaatttcctaggacctcccttctgtgtcttttaaaatatgaaaacaaaatcaatgtagcgcagcaagccagggaaagtctgctttga

SEQ ID NO: 2233 - protein, 43 aa, homo sapiens
MPHLARRVLRPRSRADCYHSCLRSNCKAAARLGEGRPPLPRLA

SEQ ID NO: 2234 - DNA, 132 bp, homo sapiens
atgccgcacctggctcggagggtcctacgcccacggagtcgcgctgattgctaccacagctgtctgagatcaaactgcaaggcggcagcgagactgggggaggggcgcccaccattgcccaggcttgcttag

SEQ ID NO: 2235 - protein, 20 aa, homo sapiens
MSLSDSFEESSGSPSTQLEI

SEQ ID NO: 2236 - DNA, 63 bp, homo sapiens
atgtccctgtctgacagctttgaagagagcagtggttctcccagcacacagctggagatctga

SEQ ID NO: 2237 - protein, 10 aa, homo sapiens
MDRLPPQVGP

SEQ ID NO: 2238 - DNA, 33 bp, homo sapiens
atggacagactgcctcctcaagtgggtccctga

SEQ ID NO: 2239 - protein, 12 aa, homo sapiens
MCTSPSSKTKSR

SEQ ID NO: 2240 - DNA, 39 bp, homo sapiens
atgtgcacatcaccatcatcaaagaccaaaagtagataa

SEQ ID NO: 2241 - protein, 42 aa, homo sapiens
MQHSRRHVGSREQTLTRQWTCWQLTLELLNLQNSEKINFCSL

SEQ ID NO: 2242 - DNA, 129 bp, homo sapiens
atgcagcattcaaggcgccatgttggaagcagagagcagaccctcaccagacaatggacttgctggcaactcactcttgaacttctcaacctccagaactctgagaaaataaatttctgttctttataa

SEQ ID NO: 2243 - protein, 30 aa, homo sapiens
MLEAESRPSPDNGLAGNSLLNFSTSRTLRK

SEQ ID NO: 2244 - DNA, 93 bp, homo sapiens
atgttggaagcagagagcagaccctcaccagacaatggacttgctggcaactcactcttgaacttctcaacctccagaactctgagaaaataa

SEQ ID NO: 2245 - protein, 8 aa, homo sapiens
MDLLATHS

SEQ ID NO: 2246 - DNA, 27 bp, homo sapiens
atggacttgctggcaactcactcttga

SEQ ID NO: 2247 - protein, 8 aa, homo sapiens
MASSWTYG

SEQ ID NO: 2248 - DNA, 27 bp, homo sapiens
atggcctcctcctggacgtacgggtga

SEQ ID NO: 2249 - protein, 13 aa, homo sapiens
MPATWLPIKPEVL

SEQ ID NO: 2250 - DNA, 42 bp, homo sapiens; identical to SEQ ID NO: 1090

SEQ ID NO: 2251 - protein, 6 aa, homo sapiens
MASYKA

SEQ ID NO: 2252 - DNA, 21 bp, homo sapiens
atggcttcctataaagcctga

SEQ ID NO: 2253 - protein, 12 aa, homo sapiens
MQKWPNTKNWYQ

SEQ ID NO: 2254 - DNA, 39 bp, homo sapiens; identical to SEQ ID NO: 1094

SEQ ID NO: 2255 - protein, 36 aa, homo sapiens; identical to SEQ ID NO: 1095

SEQ ID NO: 2256 - DNA, 111 bp, homo sapiens; identical to SEQ ID NO: 1096

SEQ ID NO: 2257 - protein, 13 aa, homo sapiens
MPATWLPIKPEVL

SEQ ID NO: 2258 - DNA, 42 bp, homo sapiens; identical to SEQ ID NO: 1090

SEQ ID NO: 2259 - protein, 6 aa, homo sapiens
MASYKA

SEQ ID NO: 2260 - DNA, 21 bp, homo sapiens
atggcttcctataaagcctga

SEQ ID NO: 2261 - protein, 12 aa, homo sapiens
MQKWPNTKNWYQ

SEQ ID NO: 2262 - DNA, 39 bp, homo sapiens; identical to SEQ ID NO: 1094

SEQ ID NO: 2263 - protein, 36 aa, homo sapiens; identical to SEQ ID NO: 1095

SEQ ID NO: 2264 - DNA, 111 bp, homo sapiens; identical to SEQ ID NO: 1096

SEQ ID NO: 2265 - protein, 13 aa, homo sapiens
MPATWLPIKPEVL

SEQ ID NO: 2266 - DNA, 42 bp, homo sapiens; identical to SEQ ID NO: 1090

SEQ ID NO: 2267 - protein, 6 aa, homo sapiens
MASYKA

SEQ ID NO: 2268 - DNA, 21 bp, homo sapiens
atggcttcctataaagcctga

SEQ ID NO: 2269 - protein, 12 aa, homo sapiens
MQKWPNTKNWYQ

SEQ ID NO: 2270 - DNA, 39 bp, homo sapiens; identical to SEQ ID NO: 1094

SEQ ID NO: 2271 - protein, 36 aa, homo sapiens; identical to SEQ ID NO: 1095

SEQ ID NO: 2272 - DNA, 111 bp, homo sapiens; identical to SEQ ID NO: 1096

SEQ ID NO: 2273 - protein, 13 aa, homo sapiens
MPATWLPIKPEVL

SEQ ID NO: 2274 - DNA, 42 bp, homo sapiens; identical to SEQ ID NO: 1090

SEQ ID NO: 2275 - protein, 6 aa, homo sapiens
MASYKA

SEQ ID NO: 2276 - DNA, 21 bp, homo sapiens
atggcttcctataaagcctga

SEQ ID NO: 2277 - protein, 12 aa, homo sapiens
MQKWPNTKNWYQ

SEQ ID NO: 2278 - DNA, 39 bp, homo sapiens; identical to SEQ ID NO: 1094

SEQ ID NO: 2279 - protein, 36 aa, homo sapiens; identical to SEQ ID NO: 1095

SEQ ID NO: 2280 - DNA, 111 bp, homo sapiens; identical to SEQ ID NO: 1096

SEQ ID NO: 2281 - protein, 13 aa, homo sapiens
MPATWLPIKPEVL

SEQ ID NO: 2282 - DNA, 42 bp, homo sapiens; identical to SEQ ID NO: 1090

SEQ ID NO: 2283 - protein, 6 aa, homo sapiens
MASYKA

SEQ ID NO: 2284 - DNA, 21 bp, homo sapiens
atggcttcctataaagcctga

SEQ ID NO: 2285 - protein, 12 aa, homo sapiens
MQKWPNTKNWYQ

SEQ ID NO: 2286 - DNA, 39 bp, homo sapiens; identical to SEQ ID NO: 1094

SEQ ID NO: 2287 - protein, 36 aa, homo sapiens; identical to SEQ ID NO: 1095

SEQ ID NO: 2288 - DNA, 111 bp, homo sapiens; identical to SEQ ID NO: 1096

SEQ ID NO: 2289 - protein, 26 aa, homo sapiens
MGQGREGGEGRAEWESRPWGVGRGGW

SEQ ID NO: 2290 - DNA, 81 bp, homo sapiens
atgggtcaaggccgtgagggtggagaagggagggcagagtgggagtcaaggccatggggggtggggaggggagggtggtga

SEQ ID NO: 2291 - protein, 28 aa, homo sapiens
MGGGEGRVVRPGVRAMGPVPEARNLDLS

SEQ ID NO: 2292 - DNA, 87 bp, homo sapiens
atggggggtggggaggggagggtggtgaggccaggggtcagggccatgggaccagtgcccgaggcaaggaacctggatttgtcctga

SEQ ID NO: 2293 - protein, 35 aa, homo sapiens
MGAPAEPSEGVVSPAWVSHHPSGCCRMRWAGSGRR

SEQ ID NO: 2294 - DNA, 108 bp, homo sapiens
atgggtgcccctgcagagcccagcgagggagtggtgagtcctgcctgggtttcccaccatccctccggctgctgcaggatgagatgggcaggtagcggcaggaggtga

SEQ ID NO: 2295 - protein, 37 aa, homo sapiens
MKAGRGAQLVKGEGPMAAGWGWGAVIDYLWSRLQLLS

SEQ ID NO: 2296 - DNA, 114 bp, homo sapiens
atgaaggctgggaggggtgctcagctggttaagggagagggtcccatggcagctggctgggggtggggggctgtgatagattatctgtggtccagactgcagctgctctcctga

SEQ ID NO: 2297 - protein, 41 aa, homo sapiens
MFRLMKFMVNCNTLMEGKKSFCFNMFQTFHLTKVFNSVLIL

SEQ ID NO: 2298 - DNA, 126 bp, homo sapiens
atgttcaggttaatgaaatttatggttaactgtaacactctgatggagggaaagaaatctttttgtttcaacatgtttcaaacctttcaccttactaaagtgtttaactctgtcctcatactttag

SEQ ID NO: 2299 - protein, 45 aa, homo sapiens
MNKIKYFFHKILGTLSPIEVGGSCNCTTDLECVKDHSRPCWENWE

SEQ ID NO: 2300 - DNA, 138 bp, homo sapiens
atgaacaaaattaaatatttctttcacaagatcctaggtactttaagtcccattgaagttggtggtagctgtaattgcactacagacctagaatgtgttaaagaccattccaggccatgctgggaaaattgggaatga

SEQ ID NO: 2301 - protein, 27 aa, homo sapiens
MLGKLGMNVSEVSWHLCFHCYFIVLIN

SEQ ID NO: 2302 - DNA, 84 bp, homo sapiens
atgctgggaaaattgggaatgaatgtcagtgaggtttcatggcatctttgttttcattgttattttattgtattaattaattaa

SEQ ID NO: 2303 - protein, 17 aa, homo sapiens
MSVRFHGIFVFIVILLY

SEQ ID NO: 2304 - DNA, 54 bp, homo sapiens
atgtcagtgaggtttcatggcatctttgttttcattgttattttattgtattaa

SEQ ID NO: 2305 - protein, 22 aa, homo sapiens
MKKQLPASPQRPVIIISALQFS

SEQ ID NO: 2306 - DNA, 69 bp, homo sapiens
atgaaaaaacaactccctgccagcccccagagacctgttatcataatttctgccttgcaattttcctaa

SEQ ID NO: 2307 - protein, 7 aa, homo sapiens
MNRSTMF

SEQ ID NO: 2308 - DNA, 24 bp, homo sapiens
atgaacagaagcacaatgttctaa

SEQ ID NO: 2309 - protein, 13 aa, homo sapiens
MLIFQFYVPFLTL

SEQ ID NO: 2310 - DNA, 42 bp, homo sapiens
atgcttatttttcagttttatgttcctttcctaacattatag

SEQ ID NO: 2311 - protein, 4 aa, homo sapiens
MFLS

SEQ ID NO: 2312 - DNA, 15 bp, homo sapiens
atgttcctttcctaa

SEQ ID NO: 2313 - protein, 57 aa, homo sapiens
MTLGPTLEATRISTAKAITQEMERNSWPGAVAHTCSPSTLGGQGGQITRSGDRDHPG

SEQ ID NO: 2314 - DNA, 174 bp, homo sapiens
atgaccttgggacccactctagaggccacgcgcatttccactgccaaagcaataacacaggagatggaaagaaattcttggccaggcgcggtggctcacacctgtagtcccagcactttgggaggccaaggcgggcagatcacgaggtcaggagatcgagaccatcctggctag

SEQ ID NO: 2315 - protein, 45 aa, homo sapiens
MKMWQRCGGVSVWQRGGVSVWWCVRVAECLCGAMSMWWCVHVSAW

SEQ ID NO: 2316 - DNA, 138 bp, homo sapiens
atgaaaatgtggcaacgatgtggtggtgtctctgtgtggcagcgtggtggtgtgtctgtgtggtggtgtgtccgtgtggcagagtgtctgtgtggtgctatgtccatgtggtggtgtgttcatgtatctgcatggtga

SEQ ID NO: 2317 - protein, 103 aa, homo sapiens
MWWCLCVAAWWCVCVVVCPCGRVSVWCYVHVVVCSCICMVMSPCDSVCIHVTMSVCPCVHMAVSVWWCLTVWRCVHVTVWRCVCVWQCPCGSVFVCSCDGVSM

SEQ ID NO: 2318 - DNA, 312 bp, homo sapiens
atgtggtggtgtctctgtgtggcagcgtggtggtgtgtctgtgtggtggtgtgtccgtgtggcagagtgtctgtgtggtgctatgtccatgtggtggtgtgttcatgtatctgcatggtgatgtctccgtgtgacagtgtgtgtatccatgtgacaatgtctgtgtgtccttgtgtccacatggcagtgtctgtgtggtggtgtctgacagtgtggaggtgtgtccatgtgacagtgtggcggtgtgtctgtgtgtggcagtgtccatgtggcagtgtgtttgtgtgttcctgtgatggtgtgtccatgtga

SEQ ID NO: 2319 - protein, 9 aa, homo sapiens
MYLHGDVSV

SEQ ID NO: 2320 - DNA, 30 bp, homo sapiens
atgtatctgcatggtgatgtctccgtgtga

SEQ ID NO: 2321 - protein, 4 aa, homo sapiens
MLRT

SEQ ID NO: 2322 - DNA, 15 bp, homo sapiens
atgctaagaacgtga

SEQ ID NO: 2323 - protein, 13 aa, homo sapiens
MRDSQVCPRSTLR

SEQ ID NO: 2324 - DNA, 42 bp, homo sapiens
atgagagattcccaagtatgtccacggtcaaccttgcggtaa

SEQ ID NO: 2325 - protein, 17 aa, homo sapiens
MSTVNLAVSLCARRNPG

SEQ ID NO: 2326 - DNA, 54 bp, homo sapiens
atgtccacggtcaaccttgcggtaagcttgtgtgctcggaggaatccagggtaa

SEQ ID NO: 2327 - protein, 143 aa, homo sapiens [sequence omitted]

SEQ ID NO: 2328 - DNA, 432 bp, homo sapiens
atggggcaagctgaaagtaaatatgcctcttatctcagcttcattaaaattatcttaagaagagggggagttaaagcttctacagaaaatctaattatgctatttcaaacaatagaacaattctgcccatggtttccagaacagggaactttatatttaaaagattgggaaaaaattggcaaagaattaaaacaagcaagtagggaaggtaaaatcatcccacttacagtatggaatgactgggccattattaaagcaactttagaaccgtttcaaatagaagaagatagtgtttcagtttctgatgcccctgagagctgtgtaatagattgtgaagaagaggcaggaacagagttcaagaaaggaatggaaagttcacattgtaaaaatgtagcagagtctgtaatggctcggtcaatgcaaaattgttga

SEQ ID NO: 2329 - protein, 44 aa, homo sapiens
MPPSRQRWECLFCRHLQAAAVPKVSCSRQDTNTRIDGEPLLSHL

SEQ ID NO: 2330 - DNA, 135 bp, homo sapiens
atgcccccatctaggcagagatgggagtgcctcttctgcagacacctacaagcagctgctgtccctaaagtgagctgttccaggcaggatacaaacaccaggatcgatggagagccactcctttcccatctgtaa

SEQ ID NO: 2331 - protein, 15 aa, homo sapiens
MGVPLLQTPTSSCCP

SEQ ID NO: 2332 - DNA, 48 bp, homo sapiens
atgggagtgcctcttctgcagacacctacaagcagctgctgtccctaa

SEQ ID NO: 2333 - protein, 12 aa, homo sapiens
MESHSFPICNPS

SEQ ID NO: 2334 - DNA, 39 bp, homo sapiens
atggagagccactcctttcccatctgtaatcccagttag

SEQ ID NO: 2335 - protein, 6 aa, homo sapiens
MFSGKL

SEQ ID NO: 2336 - DNA, 21 bp, homo sapiens
atgttctcagggaagttatga

SEQ ID NO: 2337 - protein, 5 aa, homo sapiens
MHDSK

SEQ ID NO: 2338 - DNA, 18 bp, homo sapiens
atgcatgattcaaaatga

SEQ ID NO: 2339 - protein, 26 aa, homo sapiens
MIQNDHIFIWMKIKLQRGKLRRGETS

SEQ ID NO: 2340 - DNA, 81 bp, homo sapiens
atgattcaaaatgatcacattttcatctggatgaagattaaattgcagaggggcaaacttagaagaggagagacaagttag

SEQ ID NO: 2341 - protein, 7 aa, homo sapiens
MITFSSG

SEQ ID NO: 2342 - DNA, 24 bp, homo sapiens
atgatcacattttcatctggatga

SEQ ID NO: 2343 - protein, 7 aa, homo sapiens
MVVRLAW

SEQ ID NO: 2344 - DNA, 24 bp, homo sapiens
atggtggtgagattagcatggtag

SEQ ID NO: 2345 - protein, 8 aa, homo sapiens
MCLTPFLS

SEQ ID NO: 2346 - DNA, 27 bp, homo sapiens
atgtgtttgactccctttctgtcatga

SEQ ID NO: 2347 - protein, 23 aa, homo sapiens
MIVSFLRPPQPSGTVSQLNLFSL

SEQ ID NO: 2348 - DNA, 72 bp, homo sapiens
atgattgtaagtttcctgaggcctccccagccatccggaactgtaagtcaattaaacctcttttctttataa

SEQ ID NO: 2349 - protein, 7 aa, homo sapiens
MLYMSLI

SEQ ID NO: 2350 - DNA, 24 bp, homo sapiens
atgctatacatgtcactcatttaa

SEQ ID NO: 2351 - protein, 35 aa, homo sapiens
MYIIQCFLLYAQNFALLLKSKFRIFHHLKKIPHTH

SEQ ID NO: 2352 - DNA, 108 bp, homo sapiens
atgtatataattcaatgctttttattatatgcacagaattttgcactattgctaaaatctaagtttagaatatttcatcacttaaaaaagatacctcatacccattag

SEQ ID NO: 2353 - protein, 110 aa, homo sapiens
MLARPGWRRGAGAERRAAPAQAQRHMLPRPGVEAWRRRREAHRAGAGAETHASASRGGGVAQAQRRKPTGGGWGGVCCRSKVARRRAGAGGGWRRARAETHVTVARRRDG

SEQ ID NO: 2354 - DNA, 333 bp, homo sapiens
atgctagcgcgtccggggtggaggcgtggcgcaggcgcagagaggcgcgccgcgccggcgcaggcgcagagacacatgctaccgcgtccaggggtggaggcgtggcgcaggcgcagagaggcgcaccgcgccggcgcaggcgcagagacacatgctagcgcgtccaggggtggaggcgtggcgcaggcgcagagacgcaagcctacgggcgggggttgggggggcgtgtgttgcaggagcaaagtcgcacggcgccgggctggggcggggggagggtggcgccgtgcacgcgcagaaactcacgtcacggtggcgcggcgcagagacgggtag

SEQ ID NO: 2355 - protein, 105 aa, homo sapiens [sequence omitted]

SEQ ID NO: 2356 - DNA, 318 bp, homo sapiens
atgctagcgcgtccaggggtggaggcgtggcgcaggcgcagagacgcaagcctacgggcgggggttgggggggcgtgtgttgcaggagcaaagtcgcacggcgccgggctggggcggggggagggtggcgccgtgcacgcgcagaaactcacgtcacggtggcgcggcgcagagacgggtagaacctcagtaatccgaaaagccgggatcgaccgccccttgcttgcagccgggcactacaggacccgcttgctcacggtgctgtgccagggcgccccctgctggcgactagggcaactgcagggctctcttgcttag

SEQ ID NO: 2357 - protein, 23 aa, homo sapiens
MLFGLSRLLNMGFLGLKVKNKYV

SEQ ID NO: 2358 - DNA, 72 bp, homo sapiens
atgctgtttggtctcagtagactcctaaatatgggattcctgggtttaaaagtaaaaaataaatatgtttaa

SEQ ID NO: 2359 - protein, 4 aa, homo sapiens
MFNL

SEQ ID NO: 2360 - DNA, 15 bp, homo sapiens
atgtttaatttgtga

SEQ ID NO: 2361 - protein, 11 aa, homo sapiens
MYIRCPDSLTH

SEQ ID NO: 2362 - DNA, 36 bp, homo sapiens
atgtacattcggtgtccagattcattaactcattaa

SEQ ID NO: 2363 - protein, 4 aa, homo sapiens
MATF

SEQ ID NO: 2364 - DNA, 15 bp, homo sapiens
atggcaacattctaa

SEQ ID NO: 2365 - protein, 11 aa, homo sapiens
MLDPFPFFTSF

SEQ ID NO: 2366 - DNA, 36 bp, homo sapiens
atgcttgatccctttcctttctttaccagcttttaa

SEQ ID NO: 2367 - protein, 5 aa, homo sapiens
MSWAS

SEQ ID NO: 2368 - DNA, 18 bp, homo sapiens
atgagttgggcttcttag

SEQ ID NO: 2369 - protein, 13 aa, homo sapiens
MPNPGSMMTTGGV

SEQ ID NO: 2370 - DNA, 42 bp, homo sapiens; identical to SEQ ID NO: 202

SEQ ID NO: 2371 - protein, 4 aa, homo sapiens
MSHT

SEQ ID NO: 2372 - DNA, 15 bp, homo sapiens
atgagtcatacatga

SEQ ID NO: 2373 - protein, 8 aa, homo sapiens
MMNMCLEL

SEQ ID NO: 2374 - DNA, 27 bp, homo sapiens
atgatgaatatgtgtctggaactctga

SEQ ID NO: 2375 - protein, 14 aa, homo sapiens
MHSYVIIMIGSMKE

SEQ ID NO: 2376 - DNA, 45 bp, homo sapiens; identical to SEQ ID NO: 208

SEQ ID NO: 2377 - protein, 13 aa, homo sapiens
MPNPGSMMTTGGV

SEQ ID NO: 2378 - DNA, 42 bp, homo sapiens; identical to SEQ ID NO: 202

SEQ ID NO: 2379 - protein, 4 aa, homo sapiens
MSHT

SEQ ID NO: 2380 - DNA, 15 bp, homo sapiens
atgagtcatacatga

SEQ ID NO: 2381 - protein, 8 aa, homo sapiens
MMNMCLEL

SEQ ID NO: 2382 - DNA, 27 bp, homo sapiens
atgatgaatatgtgtctggaactctga

SEQ ID NO: 2383 - protein, 14 aa, homo sapiens
MHSYVIIMIGSMKE

SEQ ID NO: 2384 - DNA, 45 bp, homo sapiens; identical to SEQ ID NO: 208

SEQ ID NO: 2385 - protein, 13 aa, homo sapiens
MPNPGSMMTTGGV

SEQ ID NO: 2386 - DNA, 42 bp, homo sapiens; identical to SEQ ID NO: 202

SEQ ID NO: 2387 - protein, 4 aa, homo sapiens
MSHT

SEQ ID NO: 2388 - DNA, 15 bp, homo sapiens
atgagtcatacatga

SEQ ID NO: 2389 - protein, 8 aa, homo sapiens
MMNMCLEL

SEQ ID NO: 2390 - DNA, 27 bp, homo sapiens
atgatgaatatgtgtctggaactctga

SEQ ID NO: 2391 - protein, 14 aa, homo sapiens
MHSYVIIMIGSMKE

SEQ ID NO: 2392 - DNA, 45 bp, homo sapiens; identical to SEQ ID NO: 208

SEQ ID NO: 2393 - protein, 13 aa, homo sapiens
MPNPGSMMTTGGV

SEQ ID NO: 2394 - DNA, 42 bp, homo sapiens; identical to SEQ ID NO: 202

SEQ ID NO: 2395 - protein, 4 aa, homo sapiens
MSHT

SEQ ID NO: 2396 - DNA, 15 bp, homo sapiens
atgagtcatacatga

SEQ ID NO: 2397 - protein, 8 aa, homo sapiens
MMNMCLEL

SEQ ID NO: 2398 - DNA, 27 bp, homo sapiens
atgatgaatatgtgtctggaactctga

SEQ ID NO: 2399 - protein, 14 aa, homo sapiens
MHSYVIIMIGSMKE

SEQ ID NO: 2400 - DNA, 45 bp, homo sapiens; identical to SEQ ID NO: 208

SEQ ID NO: 2401 - protein, 21 aa, homo sapiens
MQNENWSLLFKNYEEFQVSKD

SEQ ID NO: 2402 - DNA, 66 bp, homo sapiens
atgcaaaatgaaaattggagcctcttattcaaaaattatgaagaatttcaagttagcaaagactaa

SEQ ID NO: 2403 - protein, 31 aa, homo sapiens
MKIGASYSKIMKNFKLAKTKCGLGPLNRSPK

SEQ ID NO: 2404 - DNA, 96 bp, homo sapiens
atgaaaattggagcctcttattcaaaaattatgaagaatttcaagttagcaaagactaaatgtggcttgggccctttgaacaggagccctaagtga

SEQ ID NO: 2405 - protein, 10 aa, homo sapiens
MWLGPFEQEP

SEQ ID NO: 2406 - DNA, 33 bp, homo sapiens
atgtggcttgggccctttgaacaggagccctaa

SEQ ID NO: 2407 - protein, 59 aa, homo sapiens
MKTEVQFISGHRALPSLPAKMRGPRIGRTAPQREDPHVLRHILKQDKYVHVRITGSMSH

SEQ ID NO: 2408 - DNA, 180 bp, homo sapiens
atgaagacagaagtgcagttcatcagcgggcacagggcccttccttcccttccagccaaaatgagggggcccagaatcggcagaacagctcctcaaagagaagatccccatgtcctgagacacattctcaagcaggacaaatatgttcatgtccgcattactgggtctatgtctcattga

SEQ ID NO: 2409 - protein, 7 aa, homo sapiens
MTENHYH

SEQ ID NO: 2410 - DNA, 24 bp, homo sapiens
atgacagaaaatcactatcattaa

SEQ ID NO: 2411 - protein, 51 aa, homo sapiens [sequence omitted]

SEQ ID NO: 2412 - DNA, 156 bp, homo sapiens
atgcttaaaattctttgcgagtcctatttcccatttgtggctattgtgaggattctgcgttactaccgtgcatgcatgttcaagaagcatgaggaatttttttggctttccccaaatacagacaaatcagagcaacaagaagggggtcacatttga

SEQ ID NO: 2413 - protein, 6 aa, homo sapiens
MHVQEA

SEQ ID NO: 2414 - DNA, 21 bp, homo sapiens
atgcatgttcaagaagcatga

SEQ ID NO: 2415 - protein, 24 aa, homo sapiens
MRNFFGFPQIQTNQSNKKGVTFDY

SEQ ID NO: 2416 - DNA, 75 bp, homo sapiens
atgaggaatttttttggctttccccaaatacagacaaatcagagcaacaagaagggggtcacatttgattattaa

SEQ ID NO: 2417 - protein, 28 aa, homo sapiens
MELLGFCFHHIIEERGGCLWYPCFYCNL

SEQ ID NO: 2418 - DNA, 87 bp, homo sapiens
atggagctacttggcttttgctttcatcacatcattgaggaaagaggtggttgcttatggtacccctgtttttactgcaacctgtaa

SEQ ID NO: 2419 - protein, 24 aa, homo sapiens
MVPLFLLQPVIDENLPVAESKTLN

SEQ ID NO: 2420 - DNA, 75 bp, homo sapiens
atggtacccctgtttttactgcaacctgtaatagatgagaacctccctgttgcagagagcaaaacactgaactaa

SEQ ID NO: 2421 - protein, 11 aa, homo sapiens
MRTSLLQRAKH

SEQ ID NO: 2422 - DNA, 36 bp, homo sapiens
atgagaacctccctgttgcagagagcaaaacactga

SEQ ID NO: 2423 - protein, 40 aa, homo sapiens
MQTLASLHSDRDNCLGSCSLYERQLTKSQLLRYLNNFILF

SEQ ID NO: 2424 - DNA, 123 bp, homo sapiens
atgcaaacgcttgcaagtttgcacagtgacagagacaattgtttgggcagctgttctctatatgaaaggcaattgaccaaaagtcagttactgagatatctcaataatttcattttattttaa

SEQ ID NO: 2425 - protein, 13 aa, homo sapiens
MRFHCMNVPSLIN

SEQ ID NO: 2426 - DNA, 42 bp, homo sapiens
atgagattccattgtatgaatgtaccatcattaattaattaa

SEQ ID NO: 2427 - protein, 4 aa, homo sapiens
MYHH

SEQ ID NO: 2428 - DNA, 15 bp, homo sapiens
atgtaccatcattaa

SEQ ID NO: 2429 - protein, 17 aa, homo sapiens
MVLLAYIFFGTLGEAFP

SEQ ID NO: 2430 - DNA, 54 bp, homo sapiens
atggtcctccttgcatatatattttttggtacacttggggaagctttcccataa

SEQ ID NO: 2431 - protein, 6 aa, homo sapiens
MYLKLS

SEQ ID NO: 2432 - DNA, 21 bp, homo sapiens
atgtatttaaagttgtcatag

SEQ ID NO: 2433 - protein, 12 aa, homo sapiens
MEHLPGTTPTVC

SEQ ID NO: 2434 - DNA, 39 bp, homo sapiens
atggagcacctaccaggtaccacacctacggtgtgctag

SEQ ID NO: 2435 - protein, 15 aa, homo sapiens
MGQRVQGCAMPCALM

SEQ ID NO: 2436 - DNA, 48 bp, homo sapiens
atgggacagagggtacagggttgtgccatgccctgtgctctgatgtga

SEQ ID NO: 2437 - protein, 9 aa, homo sapiens
MGVFGHCKR

SEQ ID NO: 2438 - DNA, 30 bp, homo sapiens
atgggtgtatttggccattgcaaaagataa

SEQ ID NO: 2439 - protein, 32 aa, homo sapiens
MHRTALSTTGPAFNSKYSHSQVCVPSSLIWCD

SEQ ID NO: 2440 - DNA, 99 bp, homo sapiens
atgcatagaacagccttaagtaccacaggacctgccttcaacagcaaatacagccacagtcaagtttgtgtgccctcgagtttaatatggtgtgattga

SEQ ID NO: 2441 - protein, 9 aa, homo sapiens
MLASLVWNS

SEQ ID NO: 2442 - DNA, 30 bp, homo sapiens
atgttggccagcctggtctggaactcctga

SEQ ID NO: 2443 - protein, 5 aa, homo sapiens
MGLQV

SEQ ID NO: 2444 - DNA, 18 bp, homo sapiens
atgggattacaggtgtga

SEQ ID NO: 2445 - protein, 6 aa, homo sapiens
MPCLYL

SEQ ID NO: 2446 - DNA, 21 bp, homo sapiens
atgccatgtttatacttatga

SEQ ID NO: 2447 - protein, 14 aa, homo sapiens
MFILMNPYKLVKHY

SEQ ID NO: 2448 - DNA, 45 bp, homo sapiens
atgtttatacttatgaatccatataaactagtaaaacactattag

SEQ ID NO: 2449 - protein, 4 aa, homo sapiens
MKHR

SEQ ID NO: 2450 - DNA, 15 bp, homo sapiens
atgaagcacagatag

SEQ ID NO: 2451 - protein, 15 aa, homo sapiens
MYVICTFANSPRSFR

SEQ ID NO: 2452 - DNA, 48 bp, homo sapiens
atgtatgtcatatgcacttttgcaaactcaccaagaagtttccgatga

SEQ ID NO: 2453 - protein, 27 aa, homo sapiens
MSYALLQTHQEVSDEHMKKMSEGLIVL

SEQ ID NO: 2454 - DNA, 84 bp, homo sapiens
atgtcatatgcacttttgcaaactcaccaagaagtttccgatgaacatatgaagaaaatgtcagaagggctcatagtgctataa

SEQ ID NO: 2455 - protein, 14 aa, homo sapiens
MHFCKLTKKFPMNI

SEQ ID NO: 2456 - DNA, 45 bp, homo sapiens
atgcacttttgcaaactcaccaagaagtttccgatgaacatatga

SEQ ID NO: 2457 - protein, 10 aa, homo sapiens
MSPGKTRKPV

SEQ ID NO: 2458 - DNA, 33 bp, homo sapiens
atgagcccaggcaagaccagaaaacctgtgtaa

SEQ ID NO: 2459 - protein, 10 aa, homo sapiens
MHLLYATEAL

SEQ ID NO: 2460 - DNA, 33 bp, homo sapiens
atgcatttattgtatgccactgaggctttgtag

SEQ ID NO: 2461 - protein, 37 aa, homo sapiens
MPLRLCSVYYAAFFCDNAAFFVTIWCLLCSIFVTMDT

SEQ ID NO: 2462 - DNA, 114 bp, homo sapiens
atgccactgaggctttgtagtgtttattatgcagcatttttttgtgacaatgctgcattttttgtgacaatttggtgtttattatgcagcatttttgtgacaatggacacctga

SEQ ID NO: 2463 - protein, 12 aa, homo sapiens
MQHFFVTMLHFL

SEQ ID NO: 2464 - DNA, 39 bp, homo sapiens
atgcagcatttttttgtgacaatgctgcattttttgtga

SEQ ID NO: 2465 - protein, 6 aa, homo sapiens
MHLPFQ

SEQ ID NO: 2466 - DNA, 21 bp, homo sapiens
atgcacctgcccttccagtag

SEQ ID NO: 2467 - protein, 265 aa, homo sapiens [sequence omitted]

SEQ ID NO: 2468 - DNA, 798 bp, homo sapiens
atgctgggtgttggccgtggaggacaattgtgcccctggccaggcggggagggggcaggtggaccctgtgggagccctgtgggagccctgtggggttggccacacatcggttcctgctatccttgcaacaagatcccctggagggcagtgtgcctcctagaagaaggcaggagaaatcaccacgtgaagcagagaatggcgtttgatgagtgtgtgctttttctaggggtcgacgcaggtcctctgggcagcatggggtggtgccgggtggaccccacggtggcctgtgttcgccacgtggccgtgggtcagttcctcgctggaggagacccttccccagacacctgccgggcacccagccaaacccttgaggcctgggaaggtctctggatgccaccctacaccccgcccagactcctctccctgtggttcctggacagaacattccgtcaccacgaaacgaagtttgcccaggccctgccttcaccctgggaaaacccagccgggcatgggaaggaggaatgctgcccgcctgcccgcccagaccagagtcgccccacatgccaggccaggcccgcatcctcctggggcacacgggagccccaggcttcccggcaggaaaagccccccaccgcagaagggctggtctctggtggggagttgctgctgggtggggtgaccacagggcggggttcaggctggggtatttttaatgatgtagttgcatctggtcaccgccccctgccacccccgattctttcctgccctccccaccttgtgacccagactgtggcttga

SEQ ID NO: 2469 - protein, 6 aa, homo sapiens
MSVCFF

SEQ ID NO: 2470 - DNA, 21 bp, homo sapiens
atgagtgtgtgctttttctag

SEQ ID NO: 2471 - protein, 56 aa, homo sapiens
MGRRNAARLPAQTRVAPHARPGPHPPGAHGSPRLPGRKSPPPQKGWSLVGSCCWVG

SEQ ID NO: 2472 - DNA, 171 bp, homo sapiens
atgggaaggaggaatgctgcccgcctgcccgcccagaccagagtcgccccacatgccaggccaggcccgcatcctcctggggcacacgggagccccaggcttcccggcaggaaaagccccccaccgcagaagggctggtctctggtggggagttgctgctgggtggggtga

SEQ ID NO: 2473 - protein, 6 aa, homo sapiens
MHLPFQ

SEQ ID NO: 2474 - DNA, 21 bp, homo sapiens
atgcacctgcccttccagtag

SEQ ID NO: 2475 - protein, 265 aa, homo sapiens [sequence omitted]

SEQ ID NO: 2476 - DNA, 798 bp, homo sapiens; identical to SEQ ID NO: 2468

SEQ ID NO: 2477 - protein, 6 aa, homo sapiens
MSVCFF

SEQ ID NO: 2478 - DNA, 21 bp, homo sapiens
atgagtgtgtgctttttctag

SEQ ID NO: 2479 - protein, 56 aa, homo sapiens; identical to SEQ ID NO: 2471

SEQ ID NO: 2480 - DNA, 171 bp, homo sapiens; identical to SEQ ID NO: 2472

SEQ ID NO: 2481 - protein, 24 aa, homo sapiens
MGVTSVSFTDVLLCLSEGLAHTRT

SEQ ID NO: 2482 - DNA, 75 bp, homo sapiens
atgggagtcacatcagtttctttcactgatgttctcctatgcctatcagaaggcctggcacatactaggacttaa

SEQ ID NO: 2483 - protein, 17 aa, homo sapiens
MFSYAYQKAWHILGLNK

SEQ ID NO: 2484 - DNA, 54 bp, homo sapiens
atgttctcctatgcctatcagaaggcctggcacatactaggacttaataaataa

SEQ ID NO: 2485 - protein, 9 aa, homo sapiens
MPIRRPGTY

SEQ ID NO: 2486 - DNA, 30 bp, homo sapiens
atgcctatcagaaggcctggcacatactag

SEQ ID NO: 2487 - protein, 25 aa, homo sapiens
MRTGNLNFYVNECVICFLVLLNHGA

SEQ ID NO: 2488 - DNA, 78 bp, homo sapiens
atgagaactggaaatttaaatttttatgtcaatgaatgtgtcatctgctttcttgttttgctgaatcatggggcttaa

SEQ ID NO: 2489 - protein, 4 aa, homo sapiens
MKHR

SEQ ID NO: 2490 - DNA, 15 bp, homo sapiens
atgaagcacagatag

SEQ ID NO: 2491 - protein, 15 aa, homo sapiens
MYVICTFANSPRSFR

SEQ ID NO: 2492 - DNA, 48 bp, homo sapiens; identical to SEQ ID NO: 2452

SEQ ID NO: 2493 - protein, 27 aa, homo sapiens
MSYALLQTHQEVSDEHMKKMSEGLIVL

SEQ ID NO: 2494 - DNA, 84 bp, homo sapiens; identical to SEQ ID NO: 2454

SEQ ID NO: 2495 - protein, 14 aa, homo sapiens
MHFCKLTKKFPMNI

SEQ ID NO: 2496 - DNA, 45 bp, homo sapiens; identical to SEQ ID NO: 2456

SEQ ID NO: 2497 - protein, 13 aa, homo sapiens
MPLHSSLGNPSQK

SEQ ID NO: 2498 - DNA, 42 bp, homo sapiens
atgccactgcactccagcctgggcaatccgtctcaaaaataa

SEQ ID NO: 2499 - protein, 4 aa, homo sapiens
MHNH

SEQ ID NO: 2500 - DNA, 15 bp, homo sapiens
atgcataaccattag

SEQ ID NO: 2501 - protein, 17 aa, homo sapiens
MNTMEYYITIKMNEEVL

SEQ ID NO: 2502 - DNA, 54 bp, homo sapiens
atgaatacaatggaatattatatcactattaaaatgaatgaggaggttctataa

SEQ ID NO: 2503 - protein, 54 aa, homo sapiens [sequence omitted]

SEQ ID NO: 2504 - DNA, 165 bp, homo sapiens
atgaggaggttctataagcctagatatgggaggatctttggatatcatgtaaaaaaaaaaaaaaaaaccaaggtgcagaataatgtgatcctatcaggggacagaaaagaggagggtggtatatatgtgcatagatgtataaaattcctctggaaagatacataa

SEQ ID NO: 2505 - protein, 4 aa, homo sapiens
MKHR

SEQ ID NO: 2506 - DNA, 15 bp, homo sapiens
atgaagcacagatag

SEQ ID NO: 2507 - protein, 15 aa, homo sapiens
MYVICTFANSPRSFR

SEQ ID NO: 2508 - DNA, 48 bp, homo sapiens; identical to SEQ ID NO: 2452

SEQ ID NO: 2509 - protein, 27 aa, homo sapiens
MSYALLQTHQEVSDEHMKKMSEGLIVL

SEQ ID NO: 2510 - DNA, 84 bp, homo sapiens; identical to SEQ ID NO: 2454

SEQ ID NO: 2511 - protein, 14 aa, homo sapiens
MHFCKLTKKFPMNI

SEQ ID NO: 2512 - DNA, 45 bp, homo sapiens; identical to SEQ ID NO: 2456

SEQ ID NO: 2513 - protein, 18 aa, homo sapiens
MMGTGTNILEHNKELKIL

SEQ ID NO: 2514 - DNA, 57 bp, homo sapiens
atgatgggcactgggacaaatatacttgaacataacaaagaactaaaaatactgtga

SEQ ID NO: 2515 - protein, 34 aa, homo sapiens
MTLKVALGFYYWSRFKTFYLFKTYVVCFKKLCYK

SEQ ID NO: 2516 - DNA, 105 bp, homo sapiens
atgaccttgaaagttgcattgggtttttattattggtccaggtttaaaacattttatctatttaaaacatatgttgtgtgttttaagaagttatgttataaataa

SEQ ID NO: 2517 - protein, 53 aa, homo sapiens [sequence omitted]

SEQ ID NO: 2518 - DNA, 162 bp, homo sapiens
atgttgtgtgttttaagaagttatgttataaataacagcattgtggttaagagcccagagtctggggccaggcttcttagatgcaaatcccaactctgttattttactaaatgtgtgaccttgggcaagttaattaacctgttttggtgtcctcctctgtga

SEQ ID NO: 2519 - protein, 9 aa, homo sapiens
MQIPTLLFY

SEQ ID NO: 2520 - DNA, 30 bp, homo sapiens
atgcaaatcccaactctgttattttactaa

SEQ ID NO: 2521 - protein, 10 aa, homo sapiens
MSPGKTRKPV

SEQ ID NO: 2522 - DNA, 33 bp, homo sapiens; identical to SEQ ID NO: 2458

SEQ ID NO: 2523 - protein, 10 aa, homo sapiens
MHLLYATEAL

SEQ ID NO: 2524 - DNA, 33 bp, homo sapiens; identical to SEQ ID NO: 2460

SEQ ID NO: 2525 - protein, 37 aa, homo sapiens; identical to SEQ ID NO: 2461

SEQ ID NO: 2526 - DNA, 114 bp, homo sapiens; identical to SEQ ID NO: 2462

SEQ ID NO: 2527 - protein, 12 aa, homo sapiens
MQHFFVTMLHFL

SEQ ID NO: 2528 - DNA, 39 bp, homo sapiens; identical to SEQ ID NO: 2464

SEQ ID NO: 2529 - protein, 5 aa, homo sapiens
MQGIS

SEQ ID NO: 2530 - DNA, 18 bp, homo sapiens
atgcaaggaatttcctag

SEQ ID NO: 2531 - protein, 17 aa, homo sapiens
MELWKRSSSGLHLLIHC

SEQ ID NO: 2532 - DNA, 54 bp, homo sapiens
atggaattatggaaaagatcctcttcaggccttcatttgctcattcattgctag

SEQ ID NO: 2533 - protein, 25 aa, homo sapiens
MEKILFRPSFAHSLLVMVLNMGDIK

SEQ ID NO: 2534 - DNA, 78 bp, homo sapiens
atggaaaagatcctcttcaggccttcatttgctcattcattgctagtcatggtgctaaatatgggagatataaaatga

SEQ ID NO: 2535 - protein, 12 aa, homo sapiens
MSMAWPWPQSLP

SEQ ID NO: 2536 - DNA, 39 bp, homo sapiens
atgagtatggcatggccctggcctcaaagcttaccctag

SEQ ID NO: 2537 - protein, 32 aa, homo sapiens
MCFLNAVLAAVNFVWNPVSVVWKCDFWQCALF

SEQ ID NO: 2538 - DNA, 99 bp, homo sapiens
atgtgtttccttaatgctgtattggcggccgtgaactttgtttggaatccagtctctgtagtctggaaatgtgatttctggcagtgtgctctgttttga

SEQ ID NO: 2539 - protein, 6 aa, homo sapiens
MLYWRP

SEQ ID NO: 2540 - DNA, 21 bp, homo sapiens
atgctgtattggcggccgtga

SEQ ID NO: 2541 - protein, 36 aa, homo sapiens
MGFITVGSPLFSLGVQMVVSFDDDAGKWGRAFQGRT

SEQ ID NO: 2542 - DNA, 111 bp, homo sapiens
atgggtttcatcacagtggggtcccccttgttctctctgggtgtgcagatggtcgtgtcctttgatgatgatgctgggaaatggggaagggctttccaggggagaacataa

SEQ ID NO: 2543 - protein, 17 aa, homo sapiens
MMMLGNGEGLSRGEHKS

SEQ ID NO: 2544 - DNA, 54 bp, homo sapiens
atgatgatgctgggaaatggggaagggctttccaggggagaacataaaagttaa

SEQ ID NO: 2545 - protein, 22 aa, homo sapiens
MFDLKKKIKGLLMFLGCSILGS

SEQ ID NO: 2546 - DNA, 69 bp, homo sapiens
atgtttgatttaaaaaaaaaaattaaagggctgttaatgtttttagggtgttccatactaggaagttag

SEQ ID NO: 2547 - protein, 13 aa, homo sapiens
MEGLILFCGRFLL

SEQ ID NO: 2548 - DNA, 42 bp, homo sapiens
atggaaggtcttatccttttttgtggaaggtttttactttga

SEQ ID NO: 2549 - protein, 6 aa, homo sapiens
MLGPQI

SEQ ID NO: 2550 - DNA, 21 bp, homo sapiens
atgctaggaccacagatatag

SEQ ID NO: 2551 - protein, 21 aa, homo sapiens
MGVVYTHDFPTLHFSILMLIT

SEQ ID NO: 2552 - DNA, 66 bp, homo sapiens
atgggtgttgtttatacacatgacttcccaactctgcatttcagtatccttatgctgataacttga

SEQ ID NO: 2553 - protein, 33 aa, homo sapiens
MHSLQYPLASPPRKQFPVCEAALWTASPLVDPG

SEQ ID NO: 2554 - DNA, 102 bp, homo sapiens
atgcactctctgcagtatcctctagcttctcctccccggaaacagttcccagtctgcgaggccgccctctggactgcctctcccctagtggatccgggctga

SEQ ID NO: 2555 - protein, 36 aa, homo sapiens
MHLGRKGTSQAPDHFALPKDDPGQLERWGVRTERHT

SEQ ID NO: 2556 - DNA, 111 bp, homo sapiens
atgcatctagggaggaaaggtacctcgcaggccccagaccattttgccttaccaaaagatgacccaggccagttggaaaggtggggagtcaggacggaaaggcacacctag

SEQ ID NO: 2557 - protein, 33 aa, homo sapiens
MTQASWKGGESGRKGTPRGEVEGKCQPVWGVAS

SEQ ID NO: 2558 - DNA, 102 bp, homo sapiens
atgacccaggccagttggaaaggtggggagtcaggacggaaaggcacacctaggggagaagtggagggaaagtgccagcctgtgtggggcgtcgcctcttga

SEQ ID NO: 2559 - protein, 84 aa, homo sapiens
MIEDTLFRGSCRLVLRCMHLSNSFSFLFSESQGIPRREKGNPSQGEVGVWEAIFGRKGNRKRTGCPHRRCSGPEAEAVTSRSCQ

SEQ ID NO: 2560 - DNA, 255 bp, homo sapiens
atgatagaggataccctatttcggggctcctgcaggcttgtccttaggtgcatgcatctctctaattcgttttcttttctgttttctgaatcccaagggatcccaaggagggagaaaggaaatccttcccagggagaggtgggggtctgggaggcgatatttgggcggaagggaaaccgaaagcgcacgggttgtccgcaccgccgctgctctggaccagaggcagaggctgtaacatcccggagctgccagtag

SEQ ID NO: 2561 - protein, 19 aa, homo sapiens
MPAPKAHFWHSWSTLEKLQ

SEQ ID NO: 2562 - DNA, 60 bp, homo sapiens
atgccagctcccaaggcccacttttggcactcctggagcactctggaaaagctccagtag

SEQ ID NO: 2563 - protein, 10 aa, homo sapiens
MAGLSLASQP

SEQ ID NO: 2564 - DNA, 33 bp, homo sapiens
atggcagggctgtctctggcttcccagccatag

SEQ ID NO: 2565 - protein, 40 aa, homo sapiens
MVTQASSWLSQCPSSMACPHMDPRFRGSASIRLKARCLPF

SEQ ID NO: 2566 - DNA, 123 bp, homo sapiens
atggtcacacaagcttcctcttggctgtctcaatgcccttcttccatggcgtgccctcatatggaccctcgattccgcggctcagcgagcatcaggctgaaggcccgttgtctccccttctag

SEQ ID NO: 2567 - protein, 46 aa, homo sapiens
MPFFHGVPSYGPSIPRLSEHQAEGPLSPLLASSTSDSPGSLSHPPT

SEQ ID NO: 2568 - DNA, 141 bp, homo sapiens
atgcccttcttccatggcgtgccctcatatggaccctcgattccgcggctcagcgagcatcaggctgaaggcccgttgtctccccttctagcaagctccacaagtgactctccaggatccctttcccatccacctacatga

SEQ ID NO: 2569 - protein, 13 aa, homo sapiens
MPLHSSLGNPSQK

SEQ ID NO: 2570 - DNA, 42 bp, homo sapiens; identical to SEQ ID NO: 2498

SEQ ID NO: 2571 - protein, 4 aa, homo sapiens
MHNH

SEQ ID NO: 2572 - DNA, 15 bp, homo sapiens
atgcataaccattag

SEQ ID NO: 2573 - protein, 17 aa, homo sapiens
MNTMEYYITIKMNEEVL

SEQ ID NO: 2574 - DNA, 54 bp, homo sapiens; identical to SEQ ID NO: 2502

SEQ ID NO: 2575 - protein, 54 aa, homo sapiens [sequence omitted]

SEQ ID NO: 2576 - DNA, 165 bp, homo sapiens; identical to SEQ ID NO: 2504

SEQ ID NO: 2577 - protein, 35 aa, homo sapiens
MPSVKLRPVCVYISVCNREIAWIRGKKSCICICCF

SEQ ID NO: 2578 - DNA, 108 bp, homo sapiens
atgccttctgtaaagttaaggcctgtgtgtgtgtatatctctgtatgtaatagagagatagcatggattaggggaaaaaaaagttgtatttgcatttgttgtttctga

SEQ ID NO: 2579 - protein, 14 aa, homo sapiens
MWSPQSWNISRQLL

SEQ ID NO: 2580 - DNA, 45 bp, homo sapiens
atgtggagtccacagagctggaatatcagtaggcagttgctgtaa

SEQ ID NO: 2581 - protein, 4 aa, homo sapiens
MFNY

SEQ ID NO: 2582 - DNA, 15 bp, homo sapiens
atgttcaattattaa

SEQ ID NO: 2583 - protein, 44 aa, homo sapiens [sequence omitted]

SEQ ID NO: 2584 - DNA, 135 bp, homo sapiens
atgtctgatagccatagcgaggtcatgacattaatttatccaaagtattgtgggcaactgtctagaaaaataaatagcataaaggacacagatgccagagaactaaaaaagaaaaaaaaaaaaaggtgggtctga

SEQ ID NO: 2585 - protein, 33 aa, homo sapiens
MNQQGPLCALHPVPLGGRGTPMPGSGLWEEGEG

SEQ ID NO: 2586 - DNA, 102 bp, homo sapiens
atgaaccaacagggacctctctgcgcccttcacccggttcctctgggaggaaggggaacgccaatgcccgggagcggcctttgggaggaaggggaaggctaa

SEQ ID NO: 2587 - protein, 16 aa, homo sapiens
MPSQMLFPASRIYSGV

SEQ ID NO: 2588 - DNA, 51 bp, homo sapiens
atgccctctcaaatgctcttccctgcttcccgcatctactcaggtgtgtga

SEQ ID NO: 2589 - protein, 18 aa, homo sapiens
MCYYFGRASVSRGNLMTQ

SEQ ID NO: 2590 - DNA, 57 bp, homo sapiens
atgtgttactatttcgggcgagccagtgtttccaggggaaacctaatgacgcaatga

SEQ ID NO: 2591 - protein, 73 aa, homo sapiens [sequence omitted]

SEQ ID NO: 2592 - DNA, 222 bp, homo sapiens
atgacgtcaatgcaggtcagcagcagactctccgggagggcgggcgggctcccggctttcgggctcggcgcagtctgcgggcgggagggcgccggcgaggtggcgagggcggctggcgcgggggcgcgggagccccggctaagcccggggacgggagggcgccccctcccagcgcccgaacccaggcaacttcccgccgcccgggcaggagtttctccgtag

SEQ ID NO: 2593 - protein, 73 aa, homo sapiens [sequence omitted]

SEQ ID NO: 2594 - DNA, 222 bp, homo sapiens
atgctgtgggagcagataagattgttccaggcagaatgcaggacaaggccaaaaataaaaactgtagtggcagcagaactcactttcagtgaacacttactaaatgccaggtgctgggccaacaatttacacagcatctcatttgctgctggcaacagccagccctatggggcaggtttgattgccatctcaattttgcaagaaggcaacaggggttcataa

SEQ ID NO: 2595 - protein, 18 aa, homo sapiens
MQDKAKNKNCSGSRTHFQ

SEQ ID NO: 2596 - DNA, 57 bp, homo sapiens
atgcaggacaaggccaaaaataaaaactgtagtggcagcagaactcactttcagtga

SEQ ID NO: 2597 - protein, 25 aa, homo sapiens
MPGAGPTIYTASHLLLATASPMGQV

SEQ ID NO: 2598 - DNA, 78 bp, homo sapiens
atgccaggtgctgggccaacaatttacacagcatctcatttgctgctggcaacagccagccctatggggcaggtttga

SEQ ID NO: 2599 - protein, 38 aa, homo sapiens
MNASPQSGSQSRRNQSLHFRSPYLPQIQKTTGPRTRSP

SEQ ID NO: 2600 - DNA, 117 bp, homo sapiens
atgaatgcttctccgcaaagtggatcacaatcacgaagaaaccaaagcttacacttccgttccccatatctcccacagatccaaaagaccacggggcccaggacccggtctccatag

SEQ ID NO: 2601 - protein, 11 aa, homo sapiens
MLFIFSVRRLR

SEQ ID NO: 2602 - DNA, 36 bp, homo sapiens
atgttgttcattttttctgtgagaaggctaagatga

SEQ ID NO: 2603 - protein, 29 aa, homo sapiens
MRGKRDILGGVMEIGYWNCTGDWIPGPYP

SEQ ID NO: 2604 - DNA, 90 bp, homo sapiens
atgaggggcaagagagacatactggggggagttatggagattgggtattggaactgtactggagattggatacctggaccatatccctga

SEQ ID NO: 2605 - protein, 34 aa, homo sapiens
MIKLNHGPEDAKAVHPESNHYVNHPASLSRLSLM

SEQ ID NO: 2606 - DNA, 105 bp, homo sapiens
atgataaagttgaaccatggcccagaagatgcaaaagcagtgcatccggaaagcaaccactatgtgaatcacccagccagtcttagcaggctgtccctgatgtga

SEQ ID NO: 2607 - protein, 16 aa, homo sapiens
MAQKMQKQCIRKATTM

SEQ ID NO: 2608 - DNA, 51 bp, homo sapiens
atggcccagaagatgcaaaagcagtgcatccggaaagcaaccactatgtga

SEQ ID NO: 2609 - protein, 5 aa, homo sapiens
MPLRK

SEQ ID NO: 2610 - DNA, 18 bp, homo sapiens
atgccactcaggaagtga

SEQ ID NO: 2611 - protein, 27 aa, homo sapiens
MLNAESENEPLGWRVDPGLTKSWQSPH

SEQ ID NO: 2612 - DNA, 84 bp, homo sapiens
atgctgaatgctgagtcagaaaatgaacccctgggctggcgggttgacccaggcctgacaaagtcttggcagtccccacactga

SEQ ID NO: 2613 - protein, 16 aa, homo sapiens
MLSQKMNPWAGGLTQA

SEQ ID NO: 2614 - DNA, 51 bp, homo sapiens
atgctgagtcagaaaatgaacccctgggctggcgggttgacccaggcctga

SEQ ID NO: 2615 - protein, 9 aa, homo sapiens
MEMCVLYQN

SEQ ID NO: 2616 - DNA, 30 bp, homo sapiens
atggaaatgtgtgttttatatcagaattga

SEQ ID NO: 2617 - protein, 6 aa, homo sapiens
MDRLTT

SEQ ID NO: 2618 - DNA, 21 bp, homo sapiens
atggacagactcacaacctga

SEQ ID NO: 2619 - protein, 27 aa, homo sapiens
MAASPPPLPDPVYSPARPQAGPTLLLL

SEQ ID NO: 2620 - DNA, 84 bp, homo sapiens
atggctgcatcccccccacctctccctgaccctgtatatagcccagccaggccccaggcagggccaacccttctcctcttgtaa

SEQ ID NO: 2621 - protein, 12 aa, homo sapiens
MGNCVCLRACLA

SEQ ID NO: 2622 - DNA, 39 bp, homo sapiens
atgggtaactgtgtgtgcctccgtgcgtgcctcgcgtga

SEQ ID NO: 2623 - protein, 62 aa, homo sapiens [sequence omitted]

SEQ ID NO: 2624 - DNA, 189 bp, homo sapiens
atggagggcgatcataacagggtggttgtgaaaagcaccgagatgacggctgacgataagacgggcacagtgactcatcacacgcttgccatgtgcccaggcactaaaagactacacacgttagttcagtctaggcacttctgtcattctcattttaccgtggcggaaactgagggacagaaaaactaa

SEQ ID NO: 2625 - protein, 12 aa, homo sapiens
MAKFSIVYFYLT

SEQ ID NO: 2626 - DNA, 39 bp, homo sapiens
atggcaaagttttccattgtatatttttatttgacctaa

SEQ ID NO: 2627 - protein, 5 aa, homo sapiens
MPCIQ

SEQ ID NO: 2628 - DNA, 18 bp, homo sapiens
atgccttgtattcagtga

SEQ ID NO: 2629 - protein, 13 aa, homo sapiens
MFKRLITFIQMFL

SEQ ID NO: 2630 - DNA, 42 bp, homo sapiens
atgtttaagcgtttgatcacttttattcaaatgttcctatga

SEQ ID NO: 2631 - protein, 46 aa, homo sapiens
MITRRYCAFSYYFNAPMYTAGLNNHKSNVCLESDWFVYLHCCRKSH

SEQ ID NO: 2632 - DNA, 141 bp, homo sapiens
atgataaccagaagatactgtgcattctcatattattttaatgctccaatgtatactgcaggcttaaataaccataaaagtaatgtttgtttagaaagtgactggtttgtttaccttcactgctgcagaaaatctcactag

SEQ ID NO: 2633 - protein, 26 aa, homo sapiens
MSQMTVLYNDLVSQWLRKMENKPQGP

SEQ ID NO: 2634 - DNA, 81 bp, homo sapiens
atgtcacaaatgacagtcctgtataatgacctggtttcccagtggctcagaaagatggaaaataaaccccaaggaccctag

SEQ ID NO: 2635 - protein, 32 aa, homo sapiens
MTWFPSGSERWKINPKDPSSDRLKRADRGCLA

SEQ ID NO: 2636 - DNA, 99 bp, homo sapiens
atgacctggtttcccagtggctcagaaagatggaaaataaaccccaaggaccctagttcagacagactgaagagagcagaccgtggctgtcttgcatga

SEQ ID NO: 2637 - protein, 9 aa, homo sapiens
MIKGYVTAQ

SEQ ID NO: 2638 - DNA, 30 bp, homo sapiens
atgattaaaggctatgtcacagctcagtag

SEQ ID NO: 2639 - protein, 20 aa, homo sapiens
MSQLSRVHAFIASPPQQPLM

SEQ ID NO: 2640 - DNA, 63 bp, homo sapiens
atgtcacagctcagtagggtccatgctttcatagcttcccccccccagcaacccctaatgtga

SEQ ID NO: 2641 - protein, 12 aa, homo sapiens
MAKFSIVYFYLT

SEQ ID NO: 2642 - DNA, 39 bp, homo sapiens; identical to SEQ ID NO: 2626

SEQ ID NO: 2643 - protein, 5 aa, homo sapiens
MPCIQ

SEQ ID NO: 2644 - DNA, 18 bp, homo sapiens
atgccttgtattcagtga

SEQ ID NO: 2645 - protein, 13 aa, homo sapiens
MFKRLITFIQMFL

SEQ ID NO: 2646 - DNA, 42 bp, homo sapiens; identical to SEQ ID NO: 2630

SEQ ID NO: 2647 - protein, 46 aa, homo sapiens; identical to SEQ ID NO: 2631

SEQ ID NO: 2648 - DNA, 141 bp, homo sapiens; identical to SEQ ID NO: 2632

SEQ ID NO: 2649 - protein, 26 aa, homo sapiens
MSQMTVLYNDLVSQWLRKMENKPQGP

SEQ ID NO: 2650 - DNA, 81 bp, homo sapiens; identical to SEQ ID NO: 2634

SEQ ID NO: 2651 - protein, 32 aa, homo sapiens; identical to SEQ ID NO: 2635

SEQ ID NO: 2652 - DNA, 99 bp, homo sapiens; identical to SEQ ID NO: 2636

SEQ ID NO: 2653 - protein, 9 aa, homo sapiens
MIKGYVTAQ

SEQ ID NO: 2654 - DNA, 30 bp, homo sapiens; identical to SEQ ID NO: 2638

SEQ ID NO: 2655 - protein, 20 aa, homo sapiens
MSQLSRVHAFIASPPQQPLM

SEQ ID NO: 2656 - DNA, 63 bp, homo sapiens; identical to SEQ ID NO: 2640

SEQ ID NO: 2657 - protein, 7 aa, homo sapiens
MPVIPAL

SEQ ID NO: 2658 - DNA, 24 bp, homo sapiens
atgcctgtaatcccagcactttaa

SEQ ID NO: 2659 - protein, 13 aa, homo sapiens
MGGWLESGRRRIQ

SEQ ID NO: 2660 - DNA, 42 bp, homo sapiens
atgggaggatggcttgaatccgggaggcggaggatacagtga

SEQ ID NO: 2661 - protein, 5 aa, homo sapiens
MGCIC

SEQ ID NO: 2662 - DNA, 18 bp, homo sapiens
atgggttgcatctgttaa

SEQ ID NO: 2663 - protein, 20 aa, homo sapiens
MELPFPETGKMAGDRLQLRK

SEQ ID NO: 2664 - DNA, 63 bp, homo sapiens
atggagctgccatttccggagaccgggaagatggcgggagaccgtttgcagttgaggaaatga

SEQ ID NO: 2665 - protein, 7 aa, homo sapiens
MPVIPAL

SEQ ID NO: 2666 - DNA, 24 bp, homo sapiens
atgcctgtaatcccagcactttaa

SEQ ID NO: 2667 - protein, 13 aa, homo sapiens
MGGWLESGRRRIQ

SEQ ID NO: 2668 - DNA, 42 bp, homo sapiens; identical to SEQ ID NO: 2660

SEQ ID NO: 2669 - protein, 5 aa, homo sapiens
MGCIC

SEQ ID NO: 2670 - DNA, 18 bp, homo sapiens
atgggttgcatctgttaa

SEQ ID NO: 2671 - protein, 20 aa, homo sapiens
MELPFPETGKMAGDRLQLRK

SEQ ID NO: 2672 - DNA, 63 bp, homo sapiens; identical to SEQ ID NO: 2664

SEQ ID NO: 2673 - protein, 187 aa, homo sapiens [sequence omitted]

SEQ ID NO: 2674 - DNA, 564 bp, homo sapiens
atggcgctgcgcgaggggcgggcggggcccggggcggggggcggtaaaaccctcctggagtcattctctgtgcactccgtcgagcccccgcgcagccgtgccggagccgcagggcctccgtccagccgcgcggtccgggcagcccgcgccccctgttcttccggtcctcgggcccaggtacccctctggacctcccccgcctgcagcgcggaggcggctcctcttcaggtggccgggccggggccttccccggcagacctgtcacccgacacccaggaagcgcgcggccgggtcccggctcccctttgttcccccgctgggctcggcgctccggcgccgccccctctcgcggggcagcggaggtttgggcccgggccgggcgcgcttcaagctccgtccatgcggctctttccaaaccggggccgtttttgcctggcttctctggtgtggactccgcgcggagctgagaggcggctgtgcgcccagcctggagccggcgcaggtgagtgtctggggccgggagcgggggggcgggccgggcggagccagagcggggctcagtag

SEQ ID NO: 2675 - protein, 146 aa, homo sapiens; identical to SEQ ID NO: 339

SEQ ID NO: 2676 - DNA, 441 bp, homo sapiens; identical to SEQ ID NO: 340

SEQ ID NO: 2677 - protein, 83 aa, homo sapiens; identical to SEQ ID NO: 341

SEQ ID NO: 2678 - DNA, 252 bp, homo sapiens; identical to SEQ ID NO: 342

SEQ ID NO: 2679 - protein, 8 aa, homo sapiens
MGTESADL

SEQ ID NO: 2680 - DNA, 27 bp, homo sapiens
atgggcaccgagtcggcggatctctga

SEQ ID NO: 2681 - protein, 187 aa, homo sapiens [sequence omitted]

SEQ ID NO: 2682 - DNA, 564 bp, homo sapiens; identical to SEQ ID NO: 2674

SEQ ID NO: 2683 - protein, 146 aa, homo sapiens; identical to SEQ ID NO: 339

SEQ ID NO: 2684 - DNA, 441 bp, homo sapiens; identical to SEQ ID NO: 340

SEQ ID NO: 2685 - protein, 83 aa, homo sapiens; identical to SEQ ID NO: 341

SEQ ID NO: 2686 - DNA, 252 bp, homo sapiens; identical to SEQ ID NO: 342

SEQ ID NO: 2687 - protein, 8 aa, homo sapiens
MGTESADL

SEQ ID NO: 2688 - DNA, 27 bp, homo sapiens
atgggcaccgagtcggcggatctctga

SEQ ID NO: 2689 - protein, 6 aa, homo sapiens
MAETWA

SEQ ID NO: 2690 - DNA, 21 bp, homo sapiens
atggctgagacttgggcatga

SEQ ID NO: 2691 - protein, 11 aa, homo sapiens
MRTEEQRKERK

SEQ ID NO: 2692 - DNA, 36 bp, homo sapiens
atgaggacagaggagcaaaggaaggagagaaaatga

SEQ ID NO: 2693 - protein, 11 aa, homo sapiens
MKRRGKQGICS

SEQ ID NO: 2694 - DNA, 36 bp, homo sapiens
atgaaaagacggggaaagcaaggaatttgtagttaa

SEQ ID NO: 2695 - protein, 9 aa, homo sapiens
MRLSDEIKL

SEQ ID NO: 2696 - DNA, 30 bp, homo sapiens
atgagattatctgatgaaatcaagttataa

SEQ ID NO: 2697 - protein, 16 aa, homo sapiens
MGKPRLGLGIREPSPC

SEQ ID NO: 2698 - DNA, 51 bp, homo sapiens
atggggaaaccaaggctcgggttgggaatcagggaaccctcaccttgctag

SEQ ID NO: 2699 - protein, 96 aa, homo sapiens [sequence omitted]

SEQ ID NO: 2700 - DNA, 291 bp, homo sapiens
atgccacccggagaggcagatggggcccagcctgatgcttcctggacccgccccaccctgcccgggcacagtccagggcttcctgcccttcgaaccgcacttgtgatcagtattgacggtggtgggataatcattaaccaccaccaggggctgggtcaacggctcaaaaggccctgggcccagggtgtccccacttcctccttgtgccccgaaggccagcccggcactcaggtaagaggcttcctgagtggtaggacccctgccgccctccctgtcctaggaggctcctga

SEQ ID NO: 2701 - protein, 28 aa, homo sapiens
MGPSLMLPGPAPPCPGTVQGFLPFEPHL

SEQ ID NO: 2702 - DNA, 87 bp, homo sapiens
atggggcccagcctgatgcttcctggacccgccccaccctgcccgggcacagtccagggcttcctgcccttcgaaccgcacttgtga

SEQ ID NO: 2703 - protein, 22 aa, homo sapiens
MGWPGRAPSSLCLGFHCGIRGP

SEQ ID NO: 2704 - DNA, 69 bp, homo sapiens
atggggtggccgggacgagccccttcctctctgtgccttggtttccactgtgggataagggggccttag

SEQ ID NO: 2705 - protein, 13 aa, homo sapiens
MVAHACNPSYSGG

SEQ ID NO: 2706 - DNA, 42 bp, homo sapiens
atggtggcgcatgcctgtaatcccagttactctggaggctga

SEQ ID NO: 2707 - protein, 20 aa, homo sapiens
MPVIPVTLEAEAGESPTPGR

SEQ ID NO: 2708 - DNA, 63 bp, homo sapiens
atgcctgtaatcccagttactctggaggctgaggcaggagaatcgcctacacctgggagatag

SEQ ID NO: 2709 - protein, 57 aa, homo sapiens
MERAGTPQAEGEEASSLPLAGVPGTSSVASGLPAKLGGVFYERDLCWPTEDSKIHFL

SEQ ID NO: 2710 - DNA, 174 bp, homo sapiens
atggagagggcagggacaccacaggcagaaggagaggaggccagctcgctccccttggctggggtccctgggacctcctctgtggcatcaggactgcccgctaagttgggtggtgtgttttatgagcgtgacctgtgttggccaacagaggacagcaaaatacattttttatga

SEQ ID NO: 2711 - protein, 199 aa, homo sapiens [sequence omitted]

SEQ ID NO: 2712 - DNA, 600 bp, homo sapiens
atgagcgtgacctgtgttggccaacagaggacagcaaaatacattttttatgatcctgggaggttcaggccagtcacgttttcgcgcagagaggctgggcggtggagagggacaagtcatgtctcagttatgtggattctctttgcgaaagaggggccacttctgcaatggatttgggggtccctgggcaggggtgtgggggtgggggaagattttaggaaggggatgagctgctgggggggggcatctcccttactgcgggaaatgaaaagtattacagctatggctggtgagagtgtcagcaccagaggccagatctttgccaggtggaggggacacccttgtgccctacccccaagttccagcacctctccaagagcccttagccccggaagcagcaacaaagtgacattggactggggaggaggaagcacaactttattttctggcccgaagctgggttggtatttgggggagttcttgggaacacagtgtgtctgtgcaatttcaaccctgggggatccaggggactccagccattccagaggaggtgagagaccgtcatggggtgggtgtaagaggcttggggaacctgcctga

SEQ ID NO: 2713 - protein, 16 aa, homo sapiens
MGKPRLGLGIREPSPC

SEQ ID NO: 2714 - DNA, 51 bp, homo sapiens; identical to SEQ ID NO: 2698

SEQ ID NO: 2715 - protein, 96 aa, homo sapiens [sequence omitted]

SEQ ID NO: 2716 - DNA, 291 bp, homo sapiens; identical to SEQ ID NO: 2700

SEQ ID NO: 2717 - protein, 28 aa, homo sapiens
MGPSLMLPGPAPPCPGTVQGFLPFEPHL

SEQ ID NO: 2718 - DNA, 87 bp, homo sapiens; identical to SEQ ID NO: 2702

SEQ ID NO: 2719 - protein, 22 aa, homo sapiens
MGWPGRAPSSLCLGFHCGIRGP

SEQ ID NO: 2720 - DNA, 69 bp, homo sapiens; identical to SEQ ID NO: 2704

SEQ ID NO: 2721 - protein, 40 aa, homo sapiens
MDTQEAFSPGEKQGEGREDRRLKFWGVLILGVFCHSGCFW

SEQ ID NO: 2722 - DNA, 123 bp, homo sapiens
atggatacccaagaagctttttccccaggggagaaacaaggtgagggccgcgaggacaggagactaaagttctggggtgttcttattttgggggtgttttgtcactctggctgcttttggtga

SEQ ID NO: 2723 - protein, 56 aa, homo sapiens
MSFAYSALSPQILEVSLVNPQISPGFEGRNLERVWYLLLLLCGLREKRGRKGGFRL

SEQ ID NO: 2724 - DNA, 171 bp, homo sapiens
atgtcttttgcttatagtgccctctcaccccagattctagaagtttctttagtgaacccccaaataagcccaggatttgaagggagaaacttggaaagggtgtggtatctccttttattattatgtggcttgagggagaagagagggagaaaaggcggtttcagactctga

SEQ ID NO: 2725 - protein, 71 aa, homo sapiens [sequence omitted]

SEQ ID NO: 2726 - DNA, 216 bp, homo sapiens
atgtggcttgagggagaagagagggagaaaaggcggtttcagactctgaatcccaatttcttaagggagcaccccttagtttgggggaagttggagaaaaatggggtgtcccttggccaagtgggcacccctgaccagggcagtgctgttggaactgtggcaaggaggggtgctggtggggtacaaggaggtgattcttgcaccctgattttctag

SEQ ID NO: 2727 - protein, 35 aa, homo sapiens [sequence omitted]

SEQ ID NO: 2728 - DNA, 108 bp, homo sapiens
atggggtgtcccttggccaagtgggcacccctgaccagggcagtgctgttggaactgtggcaaggaggggtgctggtggggtacaaggaggtgattcttgcaccctga

SEQ ID NO: 2729 - protein, 5 aa, homo sapiens
MKHRK

SEQ ID NO: 2730 - DNA, 18 bp, homo sapiens
atgaagcaccgaaaatga

SEQ ID NO: 2731 - protein, 41 aa, homo sapiens
MIELKGEMDKSTIIVRYFNSSHLVKSLVKSLCPFYRGKTEA

SEQ ID NO: 2732 - DNA, 126 bp, homo sapiens
atgatagaattgaaaggagaaatggacaaatccacaattatagtaagatatttcaacagttctcacttggtaaaatcacttgtaaaatcactctgcccattttacagaggaaaaactgaggcctaa

SEQ ID NO: 2733 - protein, 23 aa, homo sapiens
MPPGQPPAGRDWIVRGCPQSHAG

SEQ ID NO: 2734 - DNA, 72 bp, homo sapiens
atgccccctggacaaccacctgcaggaagggactggattgtgagggggtgtccccagtcccatgcaggttga

SEQ ID NO: 2735 - protein, 11 aa, homo sapiens
MQVEEEAGSQG

SEQ ID NO: 2736 - DNA, 36 bp, homo sapiens
atgcaggttgaggaggaagcagggtctcagggctga

SEQ ID NO: 2737 - protein, 14 aa, homo sapiens
MRQRRRAAVAVAGV

SEQ ID NO: 2738 - DNA, 45 bp, homo sapiens
atgaggcagcgtcgccgggcagcggtggcggtggcgggggtctag

SEQ ID NO: 2739 - protein, 237 aa, homo sapiens [sequence omitted]

SEQ ID NO: 2740 - DNA, 714 bp, homo sapiens
atggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggtaagcagggctgcagagggctgcagtcaggcgggcagacaggcagacacaaggaggagaaggatcagaaaactaggagcccgcgcagcagccggccggccttggcccaagctgcaggcaggctgaccttgtga

SEQ ID NO: 2741 - protein, 143 aa, homo sapiens
MPQSLGHRRRTGSLPAGPAARRLRPGHLQRGASAWLLPPFSGLRHRQGLWQRRRRRAATRGWPVPRAAPGARFRSPARASLRLGRCGPEGASPRFAAAPHAGLRQRRGLAGRRGGARVVLGRGGALPGPFREQQSLAGEGFPG

SEQ ID NO: 2742 - DNA, 432 bp, homo sapiens
atgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggtaa

SEQ ID NO: 2743 - protein, 30 aa, homo sapiens
MAAAAAARSNSGLARSPRSPRGAVSISRPR

SEQ ID NO: 2744 - DNA, 93 bp, homo sapiens
atggcagcggcggcggcggcgcgcagcaactcggggctggcccgttccccgcgcagcccccggggcgcggtttcgatctcccgcccgcgctag

SEQ ID NO: 2745 - protein, 169 aa, homo sapiens [sequence omitted]

SEQ ID NO: 2746 - DNA, 510 bp, homo sapiens
atggtggggtcacctgccttgtctggcagcatggtagaagggcatggcctgggcggggagcactgggccctggaatcaaggtccagaggcaaaggcagcaggtggatccagcgagccctagggactgcagccccgcccccagcccacccatcccgcccccagcccacccatcccatccccgcccacccatcccatccccgccatccccgccatccccgccatccccgccatccccgccatccccgccatccccgccatccccgccatccccgcccccagctccgccccagcccagcccctccatccccgccccgcccgcagccccgccccagccctgcctcccatcggcctggaggctccctggccttcctgccggggtggaaacgggtgtctgctaccggggttcgtgtggagcaggaagggggaaggcgacgaggtggaaaagaccgctgggcgccccgaggaggcggagctgctgggaggggcctccctccgcccgatcctgtttaa

SEQ ID NO: 2747 - protein, 25 aa, homo sapiens
MAWAGSTGPWNQGPEAKAAGGSSEP

SEQ ID NO: 2748 - DNA, 78 bp, homo sapiens
atggcctgggcggggagcactgggccctggaatcaaggtccagaggcaaaggcagcaggtggatccagcgagccctag

SEQ ID NO: 2749 - protein, 86 aa, homo sapiens
MTMSYPAGGPGRNLWQPPVPGDSDTKCSHCAGPGVEWPHTDQLTPAGRATGPPPWRRREASGATRCAPGPLTSLVGGGCRPGPPET

SEQ ID NO: 2750 - DNA, 261 bp, homo sapiens
atgacaatgtcctacccagcaggaggaccaggccggaacctttggcagccaccagttcctggagattccgacaccaagtgcagccactgtgcggggccgggtgtggagtggccccacaccgaccagctcacgccagctggcagagccactgggccccctccgtggaggaggagagaggcctcgggcgccacgcgctgtgccccagggccactcacttccttggtaggtgggggatgccggcctgggcctcccgagacttga

SEQ ID NO: 2751 - protein, 108 aa, homo sapiens
MPAWASRDLSPAPALAPRETCASERPRPPLPEPCTRAVRGPCCTPERASALSHSVSNPPPSSGPQNWPSTELRGTRGPWGLGRDWPARGPPAAIPRFIQDESRAVGTT

SEQ ID NO: 2752 - DNA, 327 bp, homo sapiens
atgccggcctgggcctcccgagacttgagccctgcccctgcccttgcccccagagagacctgtgccagcgagcgtcccaggcctcccctccctgagccttgcacccgggcggtgcgggggccctgctgcaccccagagcgggcatcagccctcagccactccgttagcaatcctccccccagctcagggcctcagaactggccatccacggagctcagaggcacccgagggccctggggcctgggtagggactggccagctcggggtcctccagcagccatacccaggttcatccaggatgaaagcagggcagtgggaaccacgtga

SEQ ID NO: 2753 - protein, 169 aa, homo sapiens [sequence omitted]

SEQ ID NO: 2754 - DNA, 510 bp, homo sapiens; identical to SEQ ID NO: 2746

SEQ ID NO: 2755 - protein, 25 aa, homo sapiens
MAWAGSTGPWNQGPEAKAAGGSSEP

SEQ ID NO: 2756 - DNA, 78 bp, homo sapiens; identical to SEQ ID NO: 2748

SEQ ID NO: 2757 - protein, 86 aa, homo sapiens; identical to SEQ ID NO: 2749

SEQ ID NO: 2758 - DNA, 261 bp, homo sapiens; identical to SEQ ID NO: 2750

SEQ ID NO: 2759 - protein, 108 aa, homo sapiens; identical to SEQ ID NO: 2751

SEQ ID NO: 2760 - DNA, 327 bp, homo sapiens; identical to SEQ ID NO: 2752

SEQ ID NO: 2761 - protein, 6 aa, homo sapiens
MDRLTT

SEQ ID NO: 2762 - DNA, 21 bp, homo sapiens
atggacagactcacaacctga

SEQ ID NO: 2763 - protein, 27 aa, homo sapiens
MAASPPPLPDPVYSPARPQAGPTLLLL

SEQ ID NO: 2764 - DNA, 84 bp, homo sapiens; identical to SEQ ID NO: 2620

SEQ ID NO: 2765 - protein, 12 aa, homo sapiens
MGNCVCLRACLA

SEQ ID NO: 2766 - DNA, 39 bp, homo sapiens; identical to SEQ ID NO: 2622

SEQ ID NO: 2767 - protein, 62 aa, homo sapiens [sequence omitted]

SEQ ID NO: 2768 - DNA, 189 bp, homo sapiens; identical to SEQ ID NO: 2624

SEQ ID NO: 2769 - protein, 190 aa, homo sapiens
MHGGARATPAPPRLRAMARPRPRPVSRQRPRPRPAHSVSSPGNGPARAPPIPSRLPATAPARAPPIPSRLLATAPPLPAPCPCPGHCPAPPPPCWARPRPRAASTPGWTRSRSATHAPPGPGPQLWRWARVREVVESEGPPRQGPAPSAQEKRRMARGAPPGCSLTPPPKSLGLRTPLRLCCIRLSLSDL

SEQ ID NO: 2770 - DNA, 573 bp, homo sapiens
atgcacggaggagcccgcgctacccctgccccgccccgtctccgggcaatggcccggccccgcccccgccccgtctcccggcaacggccccgcccgcgccccgcccattccgtctcgtctcccggcaacggccccgcccgcgccccgcccattccgtctcgtctcccggcaacggcccccgcccgcgccccgcccattccgtctcgtctcctggcaacggccccgcctcttccggccccatgcccttgtccgggccactgccccgcaccccccccgccatgctgggctcgaccccggccccgcgcggcctccacgcctggctggacgcgctcccgctcagccacccacgcgccgcctggcccgggacctcagctatggcggtgggcgcgcgtccgcgaagtcgtggagtccgaggggcccccgcggcaggggcctgcgccctcggcccaggagaagcggcgaatggcccgcggcgcccctcccggttgctcgctgacccccccgcccaagagtctggggctgcgaaccccgcttcgcctttgctgcatccgactcagcctttcagatctgtag

SEQ ID NO: 2771 - protein, 166 aa, homo sapiens
MPLSGPLPRTPPAMLGSTPAPRGLHAWLDALPLSHPRAAWPGTSAMAVGARPRSRGVRGAPAAGACALGPGEAANGPRRPSRLLADPPAQESGAANPASPLLHPTQPFRSVGSGTPVSDYRAGLTAHTRRSTPPDAHVPSGHPLGASPWCQAGALASEEVASALGT

SEQ ID NO: 2772 - DNA, 501 bp, homo sapiens
atgcccttgtccgggccactgccccgcaccccccccgccatgctgggctcgaccccggccccgcgcggcctccacgcctggctggacgcgctcccgctcagccacccacgcgccgcctggcccgggacctcagctatggcggtgggcgcgcgtccgcgaagtcgtggagtccgaggggcccccgcggcaggggcctgcgccctcggcccaggagaagcggcgaatggcccgcggcgcccctcccggttgctcgctgacccccccgcccaagagtctggggctgcgaaccccgcttcgcctttgctgcatccgactcagcctttcagatctgtaggatccgggactccagtgtccgactacagggcggggctcacggcccacacgcgccgcagtaccccgcccgatgcgcacgttccctctgggcaccccctgggagcgtccccgtggtgccaggctggcgcgctggcctctgaggaggtggcttctgctctaggcacctga

SEQ ID NO: 2773 - protein, 29 aa, homo sapiens
MRTFPLGTPWERPRGARLARWPLRRWLLL

SEQ ID NO: 2774 - DNA, 90 bp, homo sapiens
atgcgcacgttccctctgggcaccccctgggagcgtccccgtggtgccaggctggcgcgctggcctctgaggaggtggcttctgctctag

SEQ ID NO: 2775 - protein, 15 aa, homo sapiens
MGAASGWLLRGRALS

SEQ ID NO: 2776 - DNA, 48 bp, homo sapiens
atgggtgctgcctccgggtggctcctccgaggcagagccctgagctga

SEQ ID NO: 2777 - protein, 17 aa, homo sapiens
MQRHFKNRRVFLLSLFQ

SEQ ID NO: 2778 - DNA, 54 bp, homo sapiens
atgcagaggcactttaagaacaggagagtctttctgctgagcctctttcaataa

SEQ ID NO: 2779 - protein, 4 aa, homo sapiens
MNVL

SEQ ID NO: 2780 - DNA, 15 bp, homo sapiens
atgaatgttttatga

SEQ ID NO: 2781 - protein, 14 aa, homo sapiens
MFYDKKQVATKWKF

SEQ ID NO: 2782 - DNA, 45 bp, homo sapiens
atgttttatgataaaaaacaagtagcaacaaaatggaaattttaa

SEQ ID NO: 2783 - protein, 5 aa, homo sapiens
MIKNK

SEQ ID NO: 2784 - DNA, 18 bp, homo sapiens
atgataaaaaacaagtag

SEQ ID NO: 2785 - protein, 11 aa, homo sapiens
MLFIFSVRRLR

SEQ ID NO: 2786 - DNA, 36 bp, homo sapiens; identical to SEQ ID NO: 2602

SEQ ID NO: 2787 - protein, 29 aa, homo sapiens
MRGKRDILGGVMEIGYWNCTGDWIPGPYP

SEQ ID NO: 2788 - DNA, 90 bp, homo sapiens; identical to SEQ ID NO: 2604

SEQ ID NO: 2789 - protein, 34 aa, homo sapiens; identical to SEQ ID NO: 2605

SEQ ID NO: 2790 - DNA, 105 bp, homo sapiens; identical to SEQ ID NO: 2606

SEQ ID NO: 2791 - protein, 16 aa, homo sapiens
MAQKMQKQCIRKATTM

SEQ ID NO: 2792 - DNA, 51 bp, homo sapiens; identical to SEQ ID NO: 2608

SEQ ID NO: 2793 - protein, 24 aa, homo sapiens
MAWSQLTATSTSWVQAILRPQPPE

SEQ ID NO: 2794 - DNA, 75 bp, homo sapiens
atggcgtggtctcagctcactgcaacctccacttcctgggttcaagcgattcttcggcctcagcctcccgagtag

SEQ ID NO: 2795 - protein, 32 aa, homo sapiens
MRRKVLINMQFFVFFFFETEFHSRCPGWSAMA

SEQ ID NO: 2796 - DNA, 99 bp, homo sapiens
atgagaaggaaagttcttataaatatgcagttttttgttttttttttttttgagacagagtttcactctcgttgcccaggctggagtgcaatggcatga

SEQ ID NO: 2797 - protein, 39 aa, homo sapiens
MISAHCNLCLPGSSDSPASASLVVGILCMCHHAWLILYF

SEQ ID NO: 2798 - DNA, 120 bp, homo sapiens
atgatctcggctcactgcaacctctgcctcccaggttcaagcgattctcctgcctcagcctcactagtagtggggattctgtgcatgtgccaccacgcctggctaattttgtatttttag

SEQ ID NO: 2799 - protein, 37 aa, homo sapiens
MSHCSRPHKFAVFKVNLFVHIFIYTKIHIFNYIYLIY

SEQ ID NO: 2800 - DNA, 114 bp, homo sapiens
atgagccactgctcccggccacataaatttgcagttttcaaagtcaacctttttgtgcatatatttatatacacaaaaatacatatatttaattatatatatttaatatattaa

SEQ ID NO: 2801 - protein, 19 aa, homo sapiens
MISFQDVSLNDICKDAFSR

SEQ ID NO: 2802 - DNA, 60 bp, homo sapiens
atgatctcgtttcaagatgtttcccttaatgacatctgcaaagatgctttctcccgatga

SEQ ID NO: 2803 - protein, 23 aa, homo sapiens
MFPLMTSAKMLSPDEGTFRKPGY

SEQ ID NO: 2804 - DNA, 72 bp, homo sapiens
atgtttcccttaatgacatctgcaaagatgctttctcccgatgagggcacatttaggaagcctgggtattag

SEQ ID NO: 2805 - protein, 34 aa, homo sapiens
MRAHLGSLGIRMWIYLLFGGGTIPLTTDAEKRCL

SEQ ID NO: 2806 - DNA, 105 bp, homo sapiens
atgagggcacatttaggaagcctgggtattaggatgtggatatatcttctttttggcggagggaccatcccactcactacagatgctgagaaaaggtgcctgtga

SEQ ID NO: 2807 - protein, 40 aa, homo sapiens
MLRKGACEIGRTGGRSGFTSAGHDRNTELPCPLAPSCPLV

SEQ ID NO: 2808 - DNA, 123 bp, homo sapiens
atgctgagaaaaggtgcctgtgaaattggcaggactgggggcagaagtgggttcacgtcagcagggcacgacaggaacacagagctgccctgtcctcttgccccttcttgtcccctagtctga

SEQ ID NO: 2809 - protein, 13 aa, homo sapiens
MVAGACSPSYSGG

SEQ ID NO: 2810 - DNA, 42 bp, homo sapiens
atggtggcgggtgcctgtagtcccagctactcaggaggctga

SEQ ID NO: 2811 - protein, 72 aa, homo sapiens
MYSTREGRSKLIQPLQLQFHGADQWLMSLKLIIIMSLVCRKSTSKIFFFYEREVGISLVLRIATQLHIGSPQ

SEQ ID NO: 2812 - DNA, 219 bp, homo sapiens
atgtactctaccagagaaggtaggtccaagctgattcagccattacaacttcaattccatggagcagatcagtggctcatgtcactgaagttaattattattatgtctctggtctgcagaaagagcacctccaaaattttctttttttatgaaagagaagttggcataagtttagtcttaaggattgcaacccaattacatataggcagcccccaatga

SEQ ID NO: 2813 - protein, 9 aa, homo sapiens
MEQISGSCH

SEQ ID NO: 2814 - DNA, 30 bp, homo sapiens
atggagcagatcagtggctcatgtcactga

SEQ ID NO: 2815 - protein, 6 aa, homo sapiens
MKEKLA

SEQ ID NO: 2816 - DNA, 21 bp, homo sapiens
atgaaagagaagttggcataa

SEQ ID NO: 2817 - protein, 13 aa, homo sapiens
MVAGACSPSYSGG

SEQ ID NO: 2818 - DNA, 42 bp, homo sapiens; identical to SEQ ID NO: 2810

SEQ ID NO: 2819 - protein, 72 aa, homo sapiens; identical to SEQ ID NO: 2811

SEQ ID NO: 2820 - DNA, 219 bp, homo sapiens; identical to SEQ ID NO: 2812

SEQ ID NO: 2821 - protein, 9 aa, homo sapiens
MEQISGSCH

SEQ ID NO: 2822 - DNA, 30 bp, homo sapiens; identical to SEQ ID NO: 2814

SEQ ID NO: 2823 - protein, 6 aa, homo sapiens
MKEKLA

SEQ ID NO: 2824 - DNA, 21 bp, homo sapiens
atgaaagagaagttggcataa

SEQ ID NO: 2825 - protein, 6 aa, homo sapiens
MLWDLE

SEQ ID NO: 2826 - DNA, 21 bp, homo sapiens
atgctgtgggacctggagtaa

SEQ ID NO: 2827 - protein, 29 aa, homo sapiens
MVLNTLAFPSKIPLGTDFFSLVLKPVDPC

SEQ ID NO: 2828 - DNA, 90 bp, homo sapiens
atggtgcttaacacacttgcattcccttccaaaatccctttaggaacagacttcttcagtttagtcctaaagcctgtagatccatgctaa

SEQ ID NO: 2829 - protein, 46 aa, homo sapiens [sequence omitted]

SEQ ID NO: 2830 - DNA, 141 bp, homo sapiens
atgctaagtgatatgactttttttcacatcagattaagcaaaacactgatgatggtgactgtcgcttattgtgcagttaccatgttctggacaggcactgttgtaagggctctacctgcatcgacccatttttcctcatga

SEQ ID NO: 2831 - protein, 37 aa, homo sapiens
MTNYWCNYHAHFIDEHTEAQRGKGTYLGPLICHGTRI

SEQ ID NO: 2832 - DNA, 114 bp, homo sapiens
atgacaaactattggtgcaattatcatgcccatttcatagatgaacacacagaggcacagagaggtaaaggaacttacttagggccactcatctgtcatggaaccagaatctaa

SEQ ID NO: 2833 - protein, 17 aa, homo sapiens
MRACYPSPWVQSAWKSL

SEQ ID NO: 2834 - DNA, 54 bp, homo sapiens
atgagggcatgttatcctagcccgtgggttcagagtgcttggaagtctctttaa

SEQ ID NO: 2835 - protein, 63 aa, homo sapiens
MPAFILSFVCSFLHLSILSHKSFNIYLQIGERKDGSESPSGDGRGEAINSLYVPFTSLTASCI

SEQ ID NO: 2836 - DNA, 192 bp, homo sapiens
atgccggccttcattctttcctttgtttgttcattccttcatttgtccatactctcgcataagtcattcaacatctacctgcaaataggtgaaagaaaggatgggagtgagagtccatcaggggacgggagaggagaagcaataaactcactctatgttcctttcacctcactgactgcatcttgtatctga

SEQ ID NO: 2837 - protein, 14 aa, homo sapiens
MGVRVHQGTGEEKQ

SEQ ID NO: 2838 - DNA, 45 bp, homo sapiens
atgggagtgagagtccatcaggggacgggagaggagaagcaataa

SEQ ID NO: 2839 - protein, 6 aa, homo sapiens
MFLSPH

SEQ ID NO: 2840 - DNA, 21 bp, homo sapiens
atgttcctttcacctcactga

SEQ ID NO: 2841 - protein, 10 aa, homo sapiens
MAPFGLPRAQ

SEQ ID NO: 2842 - DNA, 33 bp, homo sapiens
atggccccatttggcctgcccagggctcaatga

SEQ ID NO: 2843 - protein, 151 aa, homo sapiens
MRGELGHASCCSLLVPHGPSRYLCLSSPGAGTEGTARLQLPVWWLLHMRKELPCDQRKHLGTWRGGVPKSHYLLCSLSLSPLQVPASGPARCPPHPCATAGWGSWGWDLLPVTNHIARDFQPTLSSATEDAARGRGGREAPKPVPGLRSRA

SEQ ID NO: 2844 - DNA, 456 bp, homo sapiens
atgaggggggagcttggccatgcaagttgctgtagcctccttgtcccgcatgggccctctaggtatctctgcctctccagtcctggggctggaacggagggcacagctaggctccagctccccgtgtggtggctcctgcatatgagaaaagagcttccctgtgatcaaaggaagcatctggggacctggaggggaggtgtccccaaatctcattacctcctttgctctctctctctttctcccctccaggtgccagcctctggccccgcccggtgcccccctcacccctgtgccacggccggctggggttcctggggatgggatttgcttcctgtcacaaatcacattgccagggatttccaaccgaccctgagctctgccaccgaggatgctgcccggggacggggtggcagagaggccccgaagcctgtgcctggcctgaggagcagggcttag

SEQ ID NO: 2845 - protein, 41 aa, homo sapiens
MQVAVASLSRMGPLGISASPVLGLERRAQLGSSSPCGGSCI

SEQ ID NO: 2846 - DNA, 126 bp, homo sapiens
atgcaagttgctgtagcctccttgtcccgcatgggccctctaggtatctctgcctctccagtcctggggctggaacggagggcacagctaggctccagctccccgtgtggtggctcctgcatatga

SEQ ID NO: 2847 - protein, 101 aa, homo sapiens
MGFASCHKSHCQGFPTDPELCHRGCCPGTGWQRGPEACAWPEEQGLAACEQGPHQVVFTVAKFRPPGPHLLWPCRLSPAAACLPAILLPGLPGLCLPCLLS

SEQ ID NO: 2848 - DNA, 306 bp, homo sapiens
atgggatttgcttcctgtcacaaatcacattgccagggatttccaaccgaccctgagctctgccaccgaggatgctgcccggggacggggtggcagagaggccccgaagcctgtgcctggcctgaggagcagggcttagctgcttgtgagcagggtccacaccaagtcgtgttcacagtggctaagttccgccccccaggccctcacctcctctggccttgccgcctgtcccctgctgccgcctgtctgcctgccatcctgctgcctggcctccctgggctctgcctcccgtgcctactgagctga

SEQ ID NO: 2849 - protein, 15 aa, homo sapiens
MGTNGNLDPATRRLH

SEQ ID NO: 2850 - DNA, 48 bp, homo sapiens
atgggcacaaatggaaacttagatcctgctacaagaaggttacattaa

SEQ ID NO: 2851 - protein, 10 aa, homo sapiens
MQVGVGVRGD

SEQ ID NO: 2852 - DNA, 33 bp, homo sapiens
atgcaggtgggggtgggagtgaggggggattaa

SEQ ID NO: 2853 - protein, 10 aa, homo sapiens
MGASCAAALR

SEQ ID NO: 2854 - DNA, 33 bp, homo sapiens
atgggagcatcatgcgcagcagcactccgataa

SEQ ID NO: 2855 - protein, 15 aa, homo sapiens
MRSSTPIILLYGRIA

SEQ ID NO: 2856 - DNA, 48 bp, homo sapiens
atgcgcagcagcactccgataattctgttgtatggcagaatagcgtaa

SEQ ID NO: 2857 - protein, 15 aa, homo sapiens
MGTNGNLDPATRRLH

SEQ ID NO: 2858 - DNA, 48 bp, homo sapiens; identical to SEQ ID NO: 2850

SEQ ID NO: 2859 - protein, 10 aa, homo sapiens
MQVGVGVRGD

SEQ ID NO: 2860 - DNA, 33 bp, homo sapiens; identical to SEQ ID NO: 2852

SEQ ID NO: 2861 - protein, 10 aa, homo sapiens
MGASCAAALR

SEQ ID NO: 2862 - DNA, 33 bp, homo sapiens; identical to SEQ ID NO: 2854

SEQ ID NO: 2863 - protein, 15 aa, homo sapiens
MRSSTPIILLYGRIA

SEQ ID NO: 2864 - DNA, 48 bp, homo sapiens; identical to SEQ ID NO: 2856

SEQ ID NO: 2865 - protein, 10 aa, homo sapiens
MAPFGLPRAQ

SEQ ID NO: 2866 - DNA, 33 bp, homo sapiens; identical to SEQ ID NO: 2842

SEQ ID NO: 2867 - protein, 151 aa, homo sapiens; identical to SEQ ID NO: 2843

SEQ ID NO: 2868 - DNA, 456 bp, homo sapiens; identical to SEQ ID NO: 2844

SEQ ID NO: 2869 - protein, 41 aa, homo sapiens; identical to SEQ ID NO: 2845

SEQ ID NO: 2870 - DNA, 126 bp, homo sapiens; identical to SEQ ID NO: 2846

SEQ ID NO: 2871 - protein, 101 aa, homo sapiens; identical to SEQ ID NO: 2847

SEQ ID NO: 2872 - DNA, 306 bp, homo sapiens; identical to SEQ ID NO: 2848

SEQ ID NO: 2873 - protein, 17 aa, homo sapiens
MLPGDGVAERPRSLCLA

SEQ ID NO: 2874 - DNA, 54 bp, homo sapiens
atgctgcccggggacggggtggcagagaggccccgaagcctgtgcctggcctga

SEQ ID NO: 2875 - protein, 55 aa, homo sapiens
MLGAEMRTQNQTCVWRRDVVGGVGWAQMCAAGPDPQLCNWGPLHGHSSGWAVVPA

SEQ ID NO: 2876 - DNA, 168 bp, homo sapiens
atgcttggagcagagatgaggactcagaatcagacctgtgtctggaggagggatgtggtgggtggggttggctgggcccaaatgtgtgctgcaggccctgatccccaactctgcaactggggacccctgcatggccacagctcaggctgggctgtggtgccagcatag

SEQ ID NO: 2877 - protein, 39 aa, homo sapiens [sequence omitted]

SEQ ID NO: 2878 - DNA, 120 bp, homo sapiens
atgtggtgggtggggttggctgggcccaaatgtgtgctgcaggccctgatccccaactctgcaactggggacccctgcatggccacagctcaggctgggctgtggtgccagcatagatag

SEQ ID NO: 2879 - protein, 13 aa, homo sapiens
MPTPGFRYQAGLT

SEQ ID NO: 2880 - DNA, 42 bp, homo sapiens
atgccaactcctggcttccggtatcaggctgggttgacctga

SEQ ID NO: 2881 - protein, 41 aa, homo sapiens
MRFVNYRDLQGWPLVNSDYYLFPHCHLGGPHAWRSQWPGLA

SEQ ID NO: 2882 - DNA, 126 bp, homo sapiens
atgaggtttgtgaactatcgggacctacagggttggcccttggtaaacagtgattattatctcttcccacactgccacttaggtggcccgcatgcctggcggtcccaatggcctggtctggcctga

SEQ ID NO: 2883 - protein, 16 aa, homo sapiens
MPGGPNGLVWPDLPLK

SEQ ID NO: 2884 - DNA, 51 bp, homo sapiens
atgcctggcggtcccaatggcctggtctggcctgacctgcctttgaaatga

SEQ ID NO: 2885 - protein, 9 aa, homo sapiens
MAWSGLTCL

SEQ ID NO: 2886 - DNA, 30 bp, homo sapiens
atggcctggtctggcctgacctgcctttga

SEQ ID NO: 2887 - protein, 5 aa, homo sapiens
MRRLK

SEQ ID NO: 2888 - DNA, 18 bp, homo sapiens
atgagacgcctgaaatga

SEQ ID NO: 2889 - protein, 10 aa, homo sapiens
MAPFGLPRAQ

SEQ ID NO: 2890 - DNA, 33 bp, homo sapiens; identical to SEQ ID NO: 2842

SEQ ID NO: 2891 - protein, 151 aa, homo sapiens; identical to SEQ ID NO: 2843

SEQ ID NO: 2892 - DNA, 456 bp, homo sapiens; identical to SEQ ID NO: 2844

SEQ ID NO: 2893 - protein, 41 aa, homo sapiens; identical to SEQ ID NO: 2845

SEQ ID NO: 2894 - DNA, 126 bp, homo sapiens; identical to SEQ ID NO: 2846

SEQ ID NO: 2895 - protein, 101 aa, homo sapiens; identical to SEQ ID NO: 2847

SEQ ID NO: 2896 - DNA, 306 bp, homo sapiens; identical to SEQ ID NO: 2848

SEQ ID NO: 2897 - protein, 15 aa, homo sapiens
MGTNGNLDPATRRLH

SEQ ID NO: 2898 - DNA, 48 bp, homo sapiens; identical to SEQ ID NO: 2850

SEQ ID NO: 2899 - protein, 10 aa, homo sapiens
MQVGVGVRGD

SEQ ID NO: 2900 - DNA, 33 bp, homo sapiens; identical to SEQ ID NO: 2852

SEQ ID NO: 2901 - protein, 10 aa, homo sapiens
MGASCAAALR

SEQ ID NO: 2902 - DNA, 33 bp, homo sapiens; identical to SEQ ID NO: 2854

SEQ ID NO: 2903 - protein, 15 aa, homo sapiens
MRSSTPIILLYGRIA

SEQ ID NO: 2904 - DNA, 48 bp, homo sapiens; identical to SEQ ID NO: 2856

SEQ ID NO: 2905 - protein, 45 aa, homo sapiens
MWAPPPHACCPVISDPWRWDVYHGSAQSPTVFTPATSGMILPSPS

SEQ ID NO: 2906 - DNA, 138 bp, homo sapiens
atgtgggctccacccccgcacgcctgctgccctgtcatctctgatccctggcggtgggatgtctaccatggctctgcccaatcccccactgtcttcacccctgccacatctggcatgattttaccgtccccttcctag

SEQ ID NO: 2907 - protein, 19 aa, homo sapiens
MSTMALPNPPLSSPLPHLA

SEQ ID NO: 2908 - DNA, 60 bp, homo sapiens
atgtctaccatggctctgcccaatcccccactgtcttcacccctgccacatctggcatga

SEQ ID NO: 2909 - protein, 44 aa, homo sapiens
MKPLLNNPSACPELIQSPMTIVLSTSRTHRSTFSVPENWTPFHS

SEQ ID NO: 2910 - DNA, 135 bp, homo sapiens
atgaagcctctcctgaataatccatcagcctgccctgagctcatccagtctccaatgacgattgtgctctccaccagcaggacacaccggagcactttctctgtccctgagaattggactccattccacagttag

SEQ ID NO: 2911 - protein, 7 aa, homo sapiens
MILRGLS

SEQ ID NO: 2912 - DNA, 24 bp, homo sapiens
atgattttaagaggtctgtcttga

SEQ ID NO: 2913 - protein, 45 aa, homo sapiens; identical to SEQ ID NO: 2905

SEQ ID NO: 2914 - DNA, 138 bp, homo sapiens; identical to SEQ ID NO: 2906

SEQ ID NO: 2915 - protein, 19 aa, homo sapiens
MSTMALPNPPLSSPLPHLA

SEQ ID NO: 2916 - DNA, 60 bp, homo sapiens; identical to SEQ ID NO: 2908

SEQ ID NO: 2917 - protein, 44 aa, homo sapiens; identical to SEQ ID NO: 2909

SEQ ID NO: 2918 - DNA, 135 bp, homo sapiens; identical to SEQ ID NO: 2910

SEQ ID NO: 2919 - protein, 7 aa, homo sapiens
MILRGLS

SEQ ID NO: 2920 - DNA, 24 bp, homo sapiens
atgattttaagaggtctgtcttga

SEQ ID NO: 2921 - protein, 73 aa, homo sapiens [sequence omitted]

SEQ ID NO: 2922 - DNA, 222 bp, homo sapiens; identical to SEQ ID NO: 2594

SEQ ID NO: 2923 - protein, 18 aa, homo sapiens
MQDKAKNKNCSGSRTHFQ

SEQ ID NO: 2924 - DNA, 57 bp, homo sapiens; identical to SEQ ID NO: 2596

SEQ ID NO: 2925 - protein, 25 aa, homo sapiens
MPGAGPTIYTASHLLLATASPMGQV

SEQ ID NO: 2926 - DNA, 78 bp, homo sapiens; identical to SEQ ID NO: 2598

SEQ ID NO: 2927 - protein, 38 aa, homo sapiens; identical to SEQ ID NO: 2599

SEQ ID NO: 2928 - DNA, 117 bp, homo sapiens; identical to SEQ ID NO: 2600

SEQ ID NO: 2929 - protein, 14 aa, homo sapiens
MCHRARLIFLFLFL

SEQ ID NO: 2930 - DNA, 45 bp, homo sapiens
atgtgccaccgtgccaggctaatatttttatttttatttttgtaa

SEQ ID NO: 2931 - protein, 20 aa, homo sapiens
MGSHFWAQAIFPQPPKVLGL

SEQ ID NO: 2932 - DNA, 63 bp, homo sapiens
atggggtctcacttctgggctcaagcaatctttcctcagcctcccaaagtgctgggattatag

SEQ ID NO: 2933 - protein, 5 aa, homo sapiens
MGKGI

SEQ ID NO: 2934 - DNA, 18 bp, homo sapiens
atgggtaaaggtatatga

SEQ ID NO: 2935 - protein, 51 aa, homo sapiens
MNLFYFAACNPIPMPNPICIQTNNIGDKFFYRKLHKPVTDYCVCKYTQTIL

SEQ ID NO: 2936 - DNA, 156 bp, homo sapiens
atgaatctcttttattttgctgcttgcaacccaattcccatgccaaacccaatttgtatccaaacaaacaatattggagacaagttcttctatagaaagcttcataagccagttactgactactgtgtctgtaaatatactcaaactattttgtag

SEQ ID NO: 2937 - protein, 6 aa, homo sapiens
MPLIIL

SEQ ID NO: 2938 - DNA, 21 bp, homo sapiens
atgcccctaataattttataa

SEQ ID NO: 2939 - protein, 9 aa, homo sapiens
MNSQLIHEC

SEQ ID NO: 2940 - DNA, 30 bp, homo sapiens
atgaacagccaactcatacatgaatgttag

SEQ ID NO: 2941 - protein, 9 aa, homo sapiens
MNVRETFCR

SEQ ID NO: 2942 - DNA, 30 bp, homo sapiens
atgaatgttagagaaactttttgtaggtga

SEQ ID NO: 2943 - protein, 13 aa, homo sapiens
MLEKLFVGDNMHK

SEQ ID NO: 2944 - DNA, 42 bp, homo sapiens
atgttagagaaactttttgtaggtgataatatgcataaatag

SEQ ID NO: 2945 - protein, 6 aa, homo sapiens
MPLIIL

SEQ ID NO: 2946 - DNA, 21 bp, homo sapiens
atgcccctaataattttataa

SEQ ID NO: 2947 - protein, 9 aa, homo sapiens
MNSQLIHEC

SEQ ID NO: 2948 - DNA, 30 bp, homo sapiens; identical to SEQ ID NO: 2940

SEQ ID NO: 2949 - protein, 9 aa, homo sapiens
MNVRETFCR

SEQ ID NO: 2950 - DNA, 30 bp, homo sapiens; identical to SEQ ID NO: 2942

SEQ ID NO: 2951 - protein, 13 aa, homo sapiens
MLEKLFVGDNMHK

SEQ ID NO: 2952 - DNA, 42 bp, homo sapiens; identical to SEQ ID NO: 2944

SEQ ID NO: 2953 - protein, 36 aa, homo sapiens
MSQRAGLAEKCLSGLRHLPRSFTDTLFGVWDKLVNT

SEQ ID NO: 2954 - DNA, 111 bp, homo sapiens
atgagccagcgtgctggccttgctgagaaatgtttgagtggactgaggcatttgccaagaagtttcacagatactttatttggagtgtgggacaaactggttaatacttaa

SEQ ID NO: 2955 - protein, 24 aa, homo sapiens
MFEWTEAFAKKFHRYFIWSVGQTG

SEQ ID NO: 2956 - DNA, 75 bp, homo sapiens
atgtttgagtggactgaggcatttgccaagaagtttcacagatactttatttggagtgtgggacaaactggttaa

SEQ ID NO: 2957 - protein, 22 aa, homo sapiens
MTLWLSVATDFLFMTIFLIHST

SEQ ID NO: 2958 - DNA, 69 bp, homo sapiens
atgactttgtggctgtcagtggcaactgactttctctttatgaccatctttctcatacacagcacataa

SEQ ID NO: 2959 - protein, 4 aa, homo sapiens
MLHI

SEQ ID NO: 2960 - DNA, 15 bp, homo sapiens
atgttgcacatttga

SEQ ID NO: 2961 - protein, 21 aa, homo sapiens
MQNQTRNSPDLTRLHQHRGKF

SEQ ID NO: 2962 - DNA, 66 bp, homo sapiens
atgcaaaatcaaacaagaaactccccagacctcactagactacatcagcatagaggaaagttctga

SEQ ID NO: 2963 - protein, 11 aa, homo sapiens
MKAKCFITDAT

SEQ ID NO: 2964 - DNA, 36 bp, homo sapiens
atgaaagcaaagtgctttatcactgatgctacctaa

SEQ ID NO: 2965 - protein, 51 aa, homo sapiens
MLPNSCHSTLLPGLCTFSNYFISCVYQVGPNIRAIFIDEEPKPGKEVLFPN

SEQ ID NO: 2966 - DNA, 156 bp, homo sapiens
atgctacctaatagttgccacagcaccctgctccctggtttatgcacattctcgaattattttatctcatgcgtctaccaagtaggtcctaacataagggcaatttttatagatgaggaaccaaagccaggaaaggaagtcctatttccaaattag

SEQ ID NO: 2967 - protein, 16 aa, homo sapiens
MHILELFYLMRLPSRS

SEQ ID NO: 2968 - DNA, 51 bp, homo sapiens
atgcacattctcgaattattttatctcatgcgtctaccaagtaggtcctaa

SEQ ID NO: 2969 - protein, 5 aa, homo sapiens
MHREK

SEQ ID NO: 2970 - DNA, 18 bp, homo sapiens
atgcatagagaaaaatag

SEQ ID NO: 2971 - protein, 7 aa, homo sapiens
MNTCLEL

SEQ ID NO: 2972 - DNA, 24 bp, homo sapiens
atgaatacatgtctggaactctga

SEQ ID NO: 2973 - protein, 31 aa, homo sapiens
MSGTLRPIRKSISSVSHDSIGRCQEYRLSLF

SEQ ID NO: 2974 - DNA, 96 bp, homo sapiens
atgtctggaactctgaggcccatcagaaagtcaatttcctctgtttcacatgattctataggtagatgtcaggaatacagactcagtttgttttag

SEQ ID NO: 2975 - protein, 29 aa, homo sapiens
MSGIQTQFVLGLCVLCIYILFYNWISENQ

SEQ ID NO: 2976 - DNA, 90 bp, homo sapiens
atgtcaggaatacagactcagtttgttttaggtctttgtgtgttatgcatttatattttattttataattggatcagtgagaatcaataa

SEQ ID NO: 2977 - protein, 5 aa, homo sapiens
MHREK

SEQ ID NO: 2978 - DNA, 18 bp, homo sapiens
atgcatagagaaaaatag

SEQ ID NO: 2979 - protein, 7 aa, homo sapiens
MNTCLEL

SEQ ID NO: 2980 - DNA, 24 bp, homo sapiens
atgaatacatgtctggaactctga

SEQ ID NO: 2981 - protein, 31 aa, homo sapiens; identical to SEQ ID NO: 2973

SEQ ID NO: 2982 - DNA, 96 bp, homo sapiens; identical to SEQ ID NO: 2974

SEQ ID NO: 2983 - protein, 29 aa, homo sapiens
MSGIQTQFVLGLCVLCIYILFYNWISENQ

SEQ ID NO: 2984 - DNA, 90 bp, homo sapiens; identical to SEQ ID NO: 2976

SEQ ID NO: 2985 - protein, 5 aa, homo sapiens
MHREK

SEQ ID NO: 2986 - DNA, 18 bp, homo sapiens
atgcatagagaaaaatag

SEQ ID NO: 2987 - protein, 7 aa, homo sapiens
MNTCLEL

SEQ ID NO: 2988 - DNA, 24 bp, homo sapiens
atgaatacatgtctggaactctga

SEQ ID NO: 2989 - protein, 31 aa, homo sapiens; identical to SEQ ID NO: 2973

SEQ ID NO: 2990 - DNA, 96 bp, homo sapiens; identical to SEQ ID NO: 2974

SEQ ID NO: 2991 - protein, 29 aa, homo sapiens
MSGIQTQFVLGLCVLCIYILFYNWISENQ

SEQ ID NO: 2992 - DNA, 90 bp, homo sapiens; identical to SEQ ID NO: 2976

SEQ ID NO: 2993 - protein, 169 aa, homo sapiens [sequence omitted]

SEQ ID NO: 2994 - DNA, 510 bp, homo sapiens; identical to SEQ ID NO: 2746

SEQ ID NO: 2995 - protein, 25 aa, homo sapiens
MAWAGSTGPWNQGPEAKAAGGSSEP

SEQ ID NO: 2996 - DNA, 78 bp, homo sapiens; identical to SEQ ID NO: 2748

SEQ ID NO: 2997 - protein, 86 aa, homo sapiens; identical to SEQ ID NO: 2749

SEQ ID NO: 2998 - DNA, 261 bp, homo sapiens; identical to SEQ ID NO: 2750

SEQ ID NO: 2999 - protein, 108 aa, homo sapiens; identical to SEQ ID NO: 2751

SEQ ID NO: 3000 - DNA, 327 bp, homo sapiens; identical to SEQ ID NO: 2752

SEQ ID NO: 3001 - protein, 9 aa, homo sapiens
MIYTIEYIL

SEQ ID NO: 3002 - DNA, 30 bp, homo sapiens
atgatatatactatagaatatatattataa

SEQ ID NO: 3003 - protein, 12 aa, homo sapiens
MAFCFISISFPC

SEQ ID NO: 3004 - DNA, 39 bp, homo sapiens
atggcattctgctttataagcatttcttttccctgctaa

SEQ ID NO: 3005 - protein, 4 aa, homo sapiens
MYYV

SEQ ID NO: 3006 - DNA, 15 bp, homo sapiens
atgtattatgtttag

SEQ ID NO: 3007 - protein, 10 aa, homo sapiens
MFRRAEVLFG

SEQ ID NO: 3008 - DNA, 33 bp, homo sapiens
atgtttagaagggctgaagtgttatttggatga

SEQ ID NO: 3009 - protein, 4 aa, homo sapiens
MHRN

SEQ ID NO: 3010 - DNA, 15 bp, homo sapiens
atgcatcgaaattga

SEQ ID NO: 3011 - protein, 36 aa, homo sapiens
MPFSDLKHSLYLYLHDPSCSVPRFSSKDKNVNKAIF

SEQ ID NO: 3012 - DNA, 111 bp, homo sapiens
atgcccttttctgacttaaaacattccttgtacctttatttacacgatccaagttgcagtgtgcctagattttcctccaaggacaaaaatgtgaataaagcaatattttag

SEQ ID NO: 3013 - protein, 10 aa, homo sapiens
MCIIMCGRLV

SEQ ID NO: 3014 - DNA, 33 bp, homo sapiens
atgtgcatcataatgtgtgggagacttgtataa

SEQ ID NO: 3015 - protein, 44 aa, homo sapiens
MLPPPRRHLSTIFSFFPQHMLFVSEEAACTWHCIKFIRQTWPLN

SEQ ID NO: 3016 - DNA, 135 bp, homo sapiens
atgttaccacctccaaggaggcacctttccactattttctcattttttccccaacacatgttatttgttagtgaggaagctgcgtgcacgtggcattgtataaagtttattagacagacgtggcccttaaactag

SEQ ID NO: 3017 - protein, 4 aa, homo sapiens
MHRN

SEQ ID NO: 3018 - DNA, 15 bp, homo sapiens
atgcatcgaaattga

SEQ ID NO: 3019 - protein, 36 aa, homo sapiens; identical to SEQ ID NO: 3011

SEQ ID NO: 3020 - DNA, 111 bp, homo sapiens; identical to SEQ ID NO: 3012

SEQ ID NO: 3021 - protein, 10 aa, homo sapiens
MCIIMCGRLV

SEQ ID NO: 3022 - DNA, 33 bp, homo sapiens; identical to SEQ ID NO: 3014

SEQ ID NO: 3023 - protein, 44 aa, homo sapiens; identical to SEQ ID NO: 3015

SEQ ID NO: 3024 - DNA, 135 bp, homo sapiens; identical to SEQ ID NO: 3016

SEQ ID NO: 3025 - protein, 4 aa, homo sapiens
MHRN

SEQ ID NO: 3026 - DNA, 15 bp, homo sapiens
atgcatcgaaattga

SEQ ID NO: 3027 - protein, 36 aa, homo sapiens; identical to SEQ ID NO: 3011

SEQ ID NO: 3028 - DNA, 111 bp, homo sapiens; identical to SEQ ID NO: 3012

SEQ ID NO: 3029 - protein, 10 aa, homo sapiens
MCIIMCGRLV

SEQ ID NO: 3030 - DNA, 33 bp, homo sapiens; identical to SEQ ID NO: 3014

SEQ ID NO: 3031 - protein, 44 aa, homo sapiens; identical to SEQ ID NO: 3015

SEQ ID NO: 3032 - DNA, 135 bp, homo sapiens; identical to SEQ ID NO: 3016

SEQ ID NO: 3033 - protein, 33 aa, homo sapiens
MRFTFTSRCLALFLLLNVSKTKVFKAMLMKNAE

SEQ ID NO: 3034 - DNA, 102 bp, homo sapiens
atgaggttcacatttacaagccggtgcttggcactgtttcttcttctaaatgtaagtaaaacaaaagtattcaaagccatgctaatgaagaatgctgaataa

SEQ ID NO: 3035 - protein, 50 aa, homo sapiens [sequence omitted]

SEQ ID NO: 3036 - DNA, 153 bp, homo sapiens
atgctgaataaggaggaatgttttgagtgtgatttaattagtatttgcaagggtaggcattggtctccagaagccgaaactaagttcctcaaagccattattttgcttaatattttgttaacaaatctctcctctgaactgtctctaatttaa

SEQ ID NO: 3037 - protein, 4 aa, homo sapiens
MFSC

SEQ ID NO: 3038 - DNA, 15 bp, homo sapiens
atgttttcatgttga

SEQ ID NO: 3039 - protein, 9 aa, homo sapiens
MLKKLCFES

SEQ ID NO: 3040 - DNA, 30 bp, homo sapiens
atgttgaaaaaactatgttttgaatcttag

SEQ ID NO: 3041 - protein, 18 aa, homo sapiens
MGNQILPTNEKQNFLSTH

SEQ ID NO: 3042 - DNA, 57 bp, homo sapiens
atggggaaccaaattcttcctacaaatgagaaacagaacttcttgtctacacattaa

SEQ ID NO: 3043 - protein, 16 aa, homo sapiens
MRNRTSCLHIKMTLET

SEQ ID NO: 3044 - DNA, 51 bp, homo sapiens
atgagaaacagaacttcttgtctacacattaaaatgactttggaaacttag

SEQ ID NO: 3045 - protein, 12 aa, homo sapiens
MSRSGSRPFSTK

SEQ ID NO: 3046 - DNA, 39 bp, homo sapiens
atgtcaagatctggcagcagacctttttcaaccaagtga

SEQ ID NO: 3047 - protein, 98 aa, homo sapiens
MRPRHLFFYFYFFLRVPQGLETTKSDIFRVICLNSFILRKISILSSTTGIPLRHTSLSSFFSAGSFQRVSSWLLSVCYSLLTWEPLPRPTRKYMFIIQ

SEQ ID NO: 3048 - DNA, 297 bp, homo sapiens
atgaggcccaggcacttgtttttttatttttattttttcctaagggtgccccagggtttagaaacaactaagtcagatatttttagagtaatttgtcttaactctttcatcttgcgtaaaatttccattctgtcatccacaaccggaattccactccgtcataccagtctctcctcgtttttttctgctggctcttttcagcgtgtttcatcgtggctgctgtctgtctgttacagccttctcacgtgggagcccctgccccgccccacgagaaaatacatgtttatcattcagtaa

SEQ ID NO: 3049 - protein, 40 aa, homo sapiens; identical to SEQ ID NO: 2721

SEQ ID NO: 3050 - DNA, 123 bp, homo sapiens; identical to SEQ ID NO: 2722

SEQ ID NO: 3051 - protein, 56 aa, homo sapiens; identical to SEQ ID NO: 2723

SEQ ID NO: 3052 - DNA, 171 bp, homo sapiens; identical to SEQ ID NO: 2724

SEQ ID NO: 3053 - protein, 71 aa, homo sapiens [sequence omitted]

SEQ ID NO: 3054 - DNA, 216 bp, homo sapiens; identical to SEQ ID NO: 2726

SEQ ID NO: 3055 - protein, 35 aa, homo sapiens [sequence omitted]

SEQ ID NO: 3056 - DNA, 108 bp, homo sapiens; identical to SEQ ID NO: 2728

SEQ ID NO: 3057 - protein, 8 aa, homo sapiens
MGFSLIAE

SEQ ID NO: 3058 - DNA, 27 bp, homo sapiens
atgggcttctcgttgatcgcagaatga

SEQ ID NO: 3059 - protein, 15 aa, homo sapiens
MKFKLRNMFLKSFRF

SEQ ID NO: 3060 - DNA, 48 bp, homo sapiens
atgaagttcaaacttcgtaacatgtttttgaagagttttagattttag

SEQ ID NO: 3061 - protein, 9 aa, homo sapiens
MQCRSPLFL

SEQ ID NO: 3062 - DNA, 30 bp, homo sapiens
atgcaatgtcgctctcccctatttctctag

SEQ ID NO: 3063 - protein, 10 aa, homo sapiens
MSLSPISLAL

SEQ ID NO: 3064 - DNA, 33 bp, homo sapiens
atgtcgctctcccctatttctctagcactttga

SEQ ID NO: 3065 - protein, 4 aa, homo sapiens
MHRN

SEQ ID NO: 3066 - DNA, 15 bp, homo sapiens
atgcatcgaaattga

SEQ ID NO: 3067 - protein, 36 aa, homo sapiens; identical to SEQ ID NO: 3011

SEQ ID NO: 3068 - DNA, 111 bp, homo sapiens; identical to SEQ ID NO: 3012

SEQ ID NO: 3069 - protein, 10 aa, homo sapiens
MCIIMCGRLV

SEQ ID NO: 3070 - DNA, 33 bp, homo sapiens; identical to SEQ ID NO: 3014

SEQ ID NO: 3071 - protein, 44 aa, homo sapiens; identical to SEQ ID NO: 3015

SEQ ID NO: 3072 - DNA, 135 bp, homo sapiens; identical to SEQ ID NO: 3016

SEQ ID NO: 3073 - protein, 33 aa, homo sapiens; identical to SEQ ID NO: 3033

SEQ ID NO: 3074 - DNA, 102 bp, homo sapiens; identical to SEQ ID NO: 3034

SEQ ID NO: 3075 - protein, 50 aa, homo sapiens [sequence omitted]

SEQ ID NO: 3076 - DNA, 153 bp, homo sapiens; identical to SEQ ID NO: 3036

SEQ ID NO: 3077 - protein, 4 aa, homo sapiens
MFSC

SEQ ID NO: 3078 - DNA, 15 bp, homo sapiens
atgttttcatgttga

SEQ ID NO: 3079 - protein, 9 aa, homo sapiens
MLKKLCFES

SEQ ID NO: 3080 - DNA, 30 bp, homo sapiens; identical to SEQ ID NO: 3040

SEQ ID NO: 3081 - protein, 5 aa, homo sapiens
MHREK

SEQ ID NO: 3082 - DNA, 18 bp, homo sapiens
atgcatagagaaaaatag

SEQ ID NO: 3083 - protein, 7 aa, homo sapiens
MNTCLEL

SEQ ID NO: 3084 - DNA, 24 bp, homo sapiens
atgaatacatgtctggaactctga

SEQ ID NO: 3085 - protein, 31 aa, homo sapiens; identical to SEQ ID NO: 2973

SEQ ID NO: 3086 - DNA, 96 bp, homo sapiens; identical to SEQ ID NO: 2974

SEQ ID NO: 3087 - protein, 29 aa, homo sapiens
MSGIQTQFVLGLCVLCIYILFYNWISENQ

SEQ ID NO: 3088 - DNA, 90 bp, homo sapiens; identical to SEQ ID NO: 2976

SEQ ID NO: 3089 - protein, 7 aa, homo sapiens
MNLLLII

SEQ ID NO: 3090 - DNA, 24 bp, homo sapiens
atgaacttactgctcattatttaa

SEQ ID NO: 3091 - protein, 19 aa, homo sapiens
MQGVVAHMVILVDLLLLHK

SEQ ID NO: 3092 - DNA, 60 bp, homo sapiens
atgcagggggtcgtggctcatatggtgatcttggtggacctattattactacacaagtaa

SEQ ID NO: 3093 - protein, 26 aa, homo sapiens
MIIPPFCIFFNSEGFNKNTHLGLRLC

SEQ ID NO: 3094 - DNA, 81 bp, homo sapiens
atgattattcctcctttctgtatattttttaattcagaaggttttaacaaaaatacacatttaggattgaggttatgttaa

SEQ ID NO: 3095 - protein, 26 aa, homo sapiens
MLMGFSELGFQLFESCQVISAINKSS

SEQ ID NO: 3096 - DNA, 81 bp, homo sapiens
atgttaatgggctttagtgagctgggttttcagctgtttgagtcttgtcaagtgatcagtgctattaataaaagtagttaa

SEQ ID NO: 3097 - protein, 187 aa, homo sapiens [sequence omitted]

SEQ ID NO: 3098 - DNA, 564 bp, homo sapiens; identical to SEQ ID NO: 2674

SEQ ID NO: 3099 - protein, 146 aa, homo sapiens; identical to SEQ ID NO: 339

SEQ ID NO: 3100 - DNA, 441 bp, homo sapiens; identical to SEQ ID NO: 340

SEQ ID NO: 3101 - protein, 83 aa, homo sapiens; identical to SEQ ID NO: 341

SEQ ID NO: 3102 - DNA, 252 bp, homo sapiens; identical to SEQ ID NO: 342

SEQ ID NO: 3103 - protein, 8 aa, homo sapiens
MGTESADL

SEQ ID NO: 3104 - DNA, 27 bp, homo sapiens
atgggcaccgagtcggcggatctctga

SEQ ID NO: 3105 - protein, 24 aa, homo sapiens
MGVTSVSFTDVLLCLSEGLAHTRT

SEQ ID NO: 3106 - DNA, 75 bp, homo sapiens; identical to SEQ ID NO: 2482

SEQ ID NO: 3107 - protein, 17 aa, homo sapiens
MFSYAYQKAWHILGLNK

SEQ ID NO: 3108 - DNA, 54 bp, homo sapiens; identical to SEQ ID NO: 2484

SEQ ID NO: 3109 - protein, 9 aa, homo sapiens
MPIRRPGTY

SEQ ID NO: 3110 - DNA, 30 bp, homo sapiens; identical to SEQ ID NO: 2486

SEQ ID NO: 3111 - protein, 25 aa, homo sapiens
MRTGNLNFYVNECVICFLVLLNHGA

SEQ ID NO: 3112 - DNA, 78 bp, homo sapiens; identical to SEQ ID NO: 2488

SEQ ID NO: 3113 - protein, 13 aa, homo sapiens
MPLHSSLGNPSQK

SEQ ID NO: 3114 - DNA, 42 bp, homo sapiens; identical to SEQ ID NO: 2498

SEQ ID NO: 3115 - protein, 4 aa, homo sapiens
MHNH

SEQ ID NO: 3116 - DNA, 15 bp, homo sapiens
atgcataaccattag

SEQ ID NO: 3117 - protein, 17 aa, homo sapiens
MNTMEYYITIKMNEEVL

SEQ ID NO: 3118 - DNA, 54 bp, homo sapiens; identical to SEQ ID NO: 2502

SEQ ID NO: 3119 - protein, 54 aa, homo sapiens [sequence omitted]

SEQ ID NO: 3120 - DNA, 165 bp, homo sapiens; identical to SEQ ID NO: 2504

SEQ ID NO: 3121 - protein, 4 aa, homo sapiens
MLPG

SEQ ID NO: 3122 - DNA, 15 bp, homo sapiens
atgctcccaggttga

SEQ ID NO: 3123 - protein, 14 aa, homo sapiens
MVRTIMIPPGLFSL

SEQ ID NO: 3124 - DNA, 45 bp, homo sapiens
atggtgagaacgatcatgattcctccaggccttttctccctatga

SEQ ID NO: 3125 - protein, 13 aa, homo sapiens
MKGKIGYDYFMVF

SEQ ID NO: 3126 - DNA, 42 bp, homo sapiens
atgaaaggtaagattgggtacgattattttatggtattttag

SEQ ID NO: 3127 - protein, 21 aa, homo sapiens
MLYFHILFPRVRFCFKKNVRL

SEQ ID NO: 3128 - DNA, 66 bp, homo sapiens
atgctgtattttcatattctgtttcctcgggttagattttgttttaagaaaaatgtgaggctttga

SEQ ID NO: 3129 - protein, 10 aa, homo sapiens
MFLNKCKNNF

SEQ ID NO: 3130 - DNA, 33 bp, homo sapiens
atgtttctaaacaagtgtaaaaataatttttaa

SEQ ID NO: 3131 - protein, 19 aa, homo sapiens
MLLKNSASINENYNLHTKN

SEQ ID NO: 3132 - DNA, 60 bp, homo sapiens
atgcttttgaaaaattcagcaagtatcaatgaaaactataatttgcatactaagaattga

SEQ ID NO: 3133 - protein, 16 aa, homo sapiens
MKTIICILRIDVIIFR

SEQ ID NO: 3134 - DNA, 51 bp, homo sapiens
atgaaaactataatttgcatactaagaattgacgttataatatttcggtaa

SEQ ID NO: 3135 - protein, 23 aa, homo sapiens
MLLKSYFLILQICRVNNEKCRTD

SEQ ID NO: 3136 - DNA, 72 bp, homo sapiens
atgcttttaaaatcatattttcttatattacaaatatgtagggtaaacaatgaaaaatgtagaactgattaa

SEQ ID NO: 3137 - protein, 106 aa, homo sapiens
MEYKMSLKMWRNWNLRTLLARKQTGAAIVEKVGWFFKKLNIELLYNPANSTLRYMSPKTESRGSTICTLMFIAALFTIAKRWKQSKYPLTDEWINKRWYIHTMEYH

SEQ ID NO: 3138 - DNA, 321 bp, homo sapiens
atggaatataaaatgtcgttgaagatgtggagaaattggaaccttcgtaccttgctggcaagaaagcaaactggtgcagccattgttgaaaaagttgggtggttcttcaaaaagttaaacatagaattactgtataatccagcaaattccactcttaggtatatgtcccccaaaactgaaagcaggggctcaactatttgtacactcatgtttatagcagcattattcacaatagccaaaaggtggaaacaatctaaatatccgctaacagatgaatggataaacaaaaggtggtatatacatacgatggaatatcattga

SEQ ID NO: 3139 - protein, 20 aa, homo sapiens
MDKQKVVYTYDGISLSSKTE

SEQ ID NO: 3140 - DNA, 63 bp, homo sapiens
atggataaacaaaaggtggtatatacatacgatggaatatcattgagcagcaaaacagaatga

SEQ ID NO: 3141 - protein, 5 aa, homo sapiens
MLQHG

SEQ ID NO: 3142 - DNA, 18 bp, homo sapiens
atgctacaacatggatga

SEQ ID NO: 3143 - protein, 10 aa, homo sapiens
MDECQRHCAN

SEQ ID NO: 3144 - DNA, 33 bp, homo sapiens
atggatgaatgtcaaagacattgtgctaactga

SEQ ID NO: 3145 - protein, 4 aa, homo sapiens
MLSL

SEQ ID NO: 3146 - DNA, 15 bp, homo sapiens
atgctttctctttga

SEQ ID NO: 3147 - protein, 9 aa, homo sapiens
MINLISVYF

SEQ ID NO: 3148 - DNA, 30 bp, homo sapiens
atgattaatttaatctcagtttatttttaa

SEQ ID NO: 3149 - protein, 10 aa, homo sapiens
MGSLELCAVC

SEQ ID NO: 3150 - DNA, 33 bp, homo sapiens
atgggtagccttgaattatgtgccgtttgctga

SEQ ID NO: 3151 - protein, 8 aa, homo sapiens
MCRLLKGL

SEQ ID NO: 3152 - DNA, 27 bp, homo sapiens
atgtgccgtttgctgaaaggtctttag

SEQ ID NO: 3153 - protein, 28 aa, homo sapiens
MYVCVCVCVCVCVRERERERDRERERKS

SEQ ID NO: 3154 - DNA, 87 bp, homo sapiens
atgtatgtatgtgtgtgtgtgtgtgtgtgtgtgtgtgtgagagagagagagagagagagagacagagagagagagagaaagagttag

SEQ ID NO: 3155 - protein, 11 aa, homo sapiens
MYVCVCVCVCV

SEQ ID NO: 3156 - DNA, 36 bp, homo sapiens
atgtatgtgtgtgtgtgtgtgtgtgtgtgtgtgtga

SEQ ID NO: 3157 - protein, 28 aa, homo sapiens
MCVCVCVCVCERERERERQREREKELGG

SEQ ID NO: 3158 - DNA, 87 bp, homo sapiens
atgtgtgtgtgtgtgtgtgtgtgtgtgtgtgagagagagagagagagagagagacagagagagagagagaaagagttaggaggttga

SEQ ID NO: 3159 - protein, 27 aa, homo sapiens
MWKSIDMESPRWRNADLLGEMQRDRGV

SEQ ID NO: 3160 - DNA, 84 bp, homo sapiens
atgtggaaatcaatagacatggagagccctaggtggagaaacgctgacctgctgggtgaaatgcagagagacaggggtgtgtga

SEQ ID NO: 3161 - protein, 4 aa, homo sapiens
MIQI

SEQ ID NO: 3162 - DNA, 15 bp, homo sapiens
atgatccagatctaa

SEQ ID NO: 3163 - protein, 20 aa, homo sapiens
MCDNFFITQNVKAIIIFHYP

SEQ ID NO: 3164 - DNA, 63 bp, homo sapiens
atgtgtgacaattttttcattacccagaatgttaaagcaatcataatatttcattatccttaa

SEQ ID NO: 3165 - protein, 5 aa, homo sapiens
MLKQS

SEQ ID NO: 3166 - DNA, 18 bp, homo sapiens
atgttaaagcaatcataa

SEQ ID NO: 3167 - protein, 9 aa, homo sapiens
MKIRGTIGK

SEQ ID NO: 3168 - DNA, 30 bp, homo sapiens
atgaaaataagagggactataggaaaatga

SEQ ID NO: 3169 - protein, 82 aa, homo sapiens [sequence omitted]

SEQ ID NO: 3170 - DNA, 249 bp, homo sapiens
atggatacggggtcccgggaggcagccttcaccagggacctgcccaggaaaccagcagatgcccaggtaagcccccaggacacctctcgggtctctggtctgcagttcctcgtctggcctcaggagcaaggagttgtccagctcccggagaaggaggaggctggtcctgcgagtggggtgctgggcagggcgccccccaaggttcctctctccacccagccctctctgggcttggctgggatgaggtga

SEQ ID NO: 3171 - protein, 100 aa, homo sapiens
MDDASLLWGEGGGAACLFHGRKTELLLGPGTGARDFLGLTVHFCLSGSCECVRQTERDGFRDGGAPRSEGGRESWAPGGGWTPGSSGRKAVLLTQRGLRQ

SEQ ID NO: 3172 - DNA, 303 bp, homo sapiens
atggatgatgcctccctgctctggggtgagggtggaggggcagcctgtctcttccatggacgcaaaaccgagctactgctggggccagggacaggcgctcgagactttctggggctcactgtccacttctgcctttctggatcgtgtgagtgtgtgagacagacagagagagatggattcagggatggaggggcgccgaggtcagaagggggcagggagtcctgggcccctgggggtggctggacaccaggcagcagtggcaggaaggctgtcctgctcacacagagagggctccggcagtag

SEQ ID NO: 3173 - protein, 50 aa, homo sapiens [sequence omitted]

SEQ ID NO: 3174 - DNA, 153 bp, homo sapiens
atgatgcctccctgctctggggtgagggtggaggggcagcctgtctcttccatggacgcaaaaccgagctactgctggggccagggacaggcgctcgagactttctggggctcactgtccacttctgcctttctggatcgtgtgagtgtgtga

SEQ ID NO: 3175 - protein, 94 aa, homo sapiens
MDSGMEGRRGQKGAGSPGPLGVAGHQAAVAGRLSCSHREGSGSRLQGRSYTASELPSLHRSGVSFYRGGVPGSWNCMQTACLGNILLYMPIWTC

SEQ ID NO: 3176 - DNA, 285 bp, homo sapiens
atggattcagggatggaggggcgccgaggtcagaagggggcagggagtcctgggcccctgggggtggctggacaccaggcagcagtggcaggaaggctgtcctgctcacacagagagggctccggcagtagactccagggaagaagttacactgcctctgagctgccttctctacatcgcagtggggtcagcttctaccggggcggcgtcccggggtcttggaactgcatgcagactgcctgcttgggaaacatacttctttatatgcccatatggacctgctaa

SEQ ID NO: 3177 - protein, 4 aa, homo sapiens
MWKS

SEQ ID NO: 3178 - DNA, 15 bp, homo sapiens
atgtggaagtcctga

SEQ ID NO: 3179 - protein, 5 aa, homo sapiens
MQTIS

SEQ ID NO: 3180 - DNA, 18 bp, homo sapiens
atgcagactatttcctaa

SEQ ID NO: 3181 - protein, 10 aa, homo sapiens
MYSGGQRKTG

SEQ ID NO: 3182 - DNA, 33 bp, homo sapiens
atgtattctggagggcaaagaaaaacagggtga

SEQ ID NO: 3183 - protein, 8 aa, homo sapiens
MFTVIWGE

SEQ ID NO: 3184 - DNA, 27 bp, homo sapiens
atgtttacagttatttggggggagtaa

SEQ ID NO: 3185 - protein, 9 aa, homo sapiens
MCLLAYFIT

SEQ ID NO: 3186 - DNA, 30 bp, homo sapiens
atgtgtcttttagcttatttcataacctga

SEQ ID NO: 3187 - protein, 11 aa, homo sapiens
MQVRRIKIVHN

SEQ ID NO: 3188 - DNA, 36 bp, homo sapiens
atgcaggttagaagaattaaaatagttcataattaa

SEQ ID NO: 3189 - protein, 13 aa, homo sapiens
MKLQFFECAGCWN

SEQ ID NO: 3190 - DNA, 42 bp, homo sapiens
atgaaactgcagttctttgaatgtgcaggttgctggaattag

SEQ ID NO: 3191 - protein, 36 aa, homo sapiens [sequence omitted]

SEQ ID NO: 3192 - DNA, 111 bp, homo sapiens
atgtgcaggttgctggaattagatgctacatatattttgaacacacatacttattttaatattttagttttagacaacgtattcaaagtacttgagaagaatatgcaatga

SEQ ID NO: 3193 - protein, 19 aa, homo sapiens
MQAARSLVPQWVPWCPGKA

SEQ ID NO: 3194 - DNA, 60 bp, homo sapiens
atgcaggcagccaggtcgctggtcccacagtgggtcccttggtgccctggcaaggcctga

SEQ ID NO: 3195 - protein, 32 aa, homo sapiens
MVQLPPLDSYQLATTGLADTHLGNDLTTPGSI

SEQ ID NO: 3196 - DNA, 99 bp, homo sapiens
atggtccagttaccccccttggacagttaccaactagcgaccacaggcctggccgacacacatctgggcaatgacctcacaacccctgggagcatctag

SEQ ID NO: 3197 - protein, 82 aa, homo sapiens
MTSQPLGASRHNQFCGWRLEKAGGQPRAGSPSWALQQFLIYCSGVLARAVRKHEGGTARFLHVTPGVQAGAGTPALPEPPGG

SEQ ID NO: 3198 - DNA, 249 bp, homo sapiens
atgacctcacaacccctgggagcatctaggcacaaccagttttgtgggtggcggttggagaaagctgggggccagcccagggcaggatctccttcctgggctctgcagcagtttctcatctactgcagtggggttctggccagagcagtcagaaagcatgaaggaggcactgctcgcttcctccacgtgactcctggggtgcaagctggggcagggaccccggctctgccagaacccccagggggctag

SEQ ID NO: 3199 - protein, 10 aa, homo sapiens
MKEALLASST

SEQ ID NO: 3200 - DNA, 33 bp, homo sapiens
atgaaggaggcactgctcgcttcctccacgtga

SEQ ID NO: 3201 - protein, 22 aa, homo sapiens
MVKEKRREVERAREKLGVMMTD

SEQ ID NO: 3202 - DNA, 69 bp, homo sapiens
atggtaaaagagaaaaggagagaggttgagcgagcgagagagaagctaggtgtgatgatgacagactag

SEQ ID NO: 3203 - protein, 12 aa, homo sapiens
MIPFLKEGRGRV

SEQ ID NO: 3204 - DNA, 39 bp, homo sapiens
atgattccatttttaaaggaggggagggggagagtctag

SEQ ID NO: 3205 - protein, 31 aa, homo sapiens
MEISKKIFSIFTKCVEASPVSSWLWLLCHSL

SEQ ID NO: 3206 - DNA, 96 bp, homo sapiens
atggaaatatctaaaaaaatatttagcatttttactaagtgcgttgaggcctctccagtgtcctcctggctgtggctgctttgtcattctctttga

SEQ ID NO: 3207 - protein, 12 aa, homo sapiens
MKNRKKKEKKHL

SEQ ID NO: 3208 - DNA, 39 bp, homo sapiens
atgaaaaacagaaagaaaaaggagaagaaacatttgtaa

SEQ ID NO: 3209 - protein, 32 aa, homo sapiens
MLFFIISNVFTMTHPQKYYCQKLYSKVITQLH

SEQ ID NO: 3210 - DNA, 99 bp, homo sapiens
atgcttttctttatcatcagcaacgttttcaccatgacccatccccaaaaatactattgtcagaaactgtactctaaagtgattacacagttgcactga

SEQ ID NO: 3211 - protein, 18 aa, homo sapiens
MLLLVHFKVASIRGYLFS

SEQ ID NO: 3212 - DNA, 57 bp, homo sapiens
atgcttcttttggtgcattttaaggtggctagtataagaggatatctcttcagttaa

SEQ ID NO: 3213 - protein, 18 aa, homo sapiens
MKRGDYIYNFSYALKYIH

SEQ ID NO: 3214 - DNA, 57 bp, homo sapiens
atgaagagaggggattatatttataacttttcatatgcattgaaatatatacattag

SEQ ID NO: 3215 - protein, 18 aa, homo sapiens
MPPYNYGSDYVIYSYKHA

SEQ ID NO: 3216 - DNA, 57 bp, homo sapiens
atgcctccatataactatggctcagactatgtcatatacagctataagcatgcttga

SEQ ID NO: 3217 - protein, 12 aa, homo sapiens
MLQTLQKVLGKQ

SEQ ID NO: 3218 - DNA, 39 bp, homo sapiens
atgcttcagacactacagaaggtattgggtaaacaatga

SEQ ID NO: 3219 - protein, 26 aa, homo sapiens
MMNLCHCSLTSKPRGNDSCKQHNTMR

SEQ ID NO: 3220 - DNA, 81 bp, homo sapiens
atgatgaatttgtgccattgtagcctcacatccaagcccaggggaaatgacagctgtaaacaacacaacacaatgcgataa

SEQ ID NO: 3221 - protein, 24 aa, homo sapiens
MTAVNNTTQCDKCYENRIYIRHYT

SEQ ID NO: 3222 - DNA, 75 bp, homo sapiens
atgacagctgtaaacaacacaacacaatgcgataagtgctatgaaaatagaatatatataaggcactacacataa

SEQ ID NO: 3223 - protein, 6 aa, homo sapiens
MKIEYI

SEQ ID NO: 3224 - DNA, 21 bp, homo sapiens
atgaaaatagaatatatataa

SEQ ID NO: 3225 - protein, 8 aa, homo sapiens
MSCACRRL

SEQ ID NO: 3226 - DNA, 27 bp, homo sapiens
atgtcatgtgcatgccgcagactgtga

SEQ ID NO: 3227 - protein, 10 aa, homo sapiens
MCMPQTVSMS

SEQ ID NO: 3228 - DNA, 33 bp, homo sapiens
atgtgcatgccgcagactgtgagtatgagctga

SEQ ID NO: 3229 - protein, 21 aa, homo sapiens
MLRGSFLAAFFAPSKEDSGTD

SEQ ID NO: 3230 - DNA, 66 bp, homo sapiens
atgctccggggttcttttttggctgccttttttgccccttctaaagaggatagtgggactgactag

SEQ ID NO: 3231 - protein, 28 aa, homo sapiens
MCIMNLGLHAKKPREGILAEPGITLTNL

SEQ ID NO: 3232 - DNA, 87 bp, homo sapiens
atgtgtataatgaatttggggctgcatgcaaagaaaccgagagagggaattcttgcagagccgggaatcaccctgacgaatctctga

SEQ ID NO: 3233 - protein, 4 aa, homo sapiens
MWKS

SEQ ID NO: 3234 - DNA, 15 bp, homo sapiens
atgtggaagtcctga

SEQ ID NO: 3235 - protein, 5 aa, homo sapiens
MQTIS

SEQ ID NO: 3236 - DNA, 18 bp, homo sapiens
atgcagactatttcctaa

SEQ ID NO: 3237 - protein, 10 aa, homo sapiens
MYSGGQRKTG

SEQ ID NO: 3238 - DNA, 33 bp, homo sapiens; identical to SEQ ID NO: 3182

SEQ ID NO: 3239 - protein, 8 aa, homo sapiens
MFTVIWGE

SEQ ID NO: 3240 - DNA, 27 bp, homo sapiens
atgtttacagttatttggggggagtaa

SEQ ID NO: 3241 - protein, 92 aa, homo sapiens [sequence omitted]

SEQ ID NO: 3242 - DNA, 279 bp, homo sapiens
atgaggaaaccacagtggcagctggccccagagaaggccaggcagggctggccctcccctacccggaggctgctggagccctcggggcccggggatctgaggccccaggagctaggggcggtcgctgtggtgaggggatgggtcttggcaggaaggcagcccatgcctgggaggcgggaggcagcacagctcagtttggggaaggcaagctccaaggccggagagcgtggggtgcgggggtctaggaagggtgagctctgtgaagcacctgacctttga

SEQ ID NO: 3243 - protein, 35 aa, homo sapiens
MGLGRKAAHAWEAGGSTAQFGEGKLQGRRAWGAGV

SEQ ID NO: 3244 - DNA, 108 bp, homo sapiens
atgggtcttggcaggaaggcagcccatgcctgggaggcgggaggcagcacagctcagtttggggaaggcaagctccaaggccggagagcgtggggtgcgggggtctag

SEQ ID NO: 3245 - protein, 45 aa, homo sapiens
MGPLGRFWGLWGVGFLAFLERKEKNTYKEVEEPQGPPLSALAPCW

SEQ ID NO: 3246 - DNA, 138 bp, homo sapiens
atggggcccttggggaggttttggggcttgtggggtgttggtttcttggcctttttagagagaaaagaaaaaaatacttacaaggaagttgaggagcctcagggacctcccttgtcagccctcgccccatgctggtga

SEQ ID NO: 3247 - protein, 77 aa, homo sapiens
MLVRPQGSEGKGLEDLPVSGSCCLREQSRTGGCPGPQGSPTSCPKDGPSSGTSQEHELWACSFTFARKGVDHTLGKE

SEQ ID NO: 3248 - DNA, 234 bp, homo sapiens
atgctggtgagaccccagggttcagaggggaaggggctagaggatctgccagtgagtgggagctgctgcctgagggagcagagcagaacaggggggtgcccgggtccacaggggtccccgacgtcctgcccgaaggatggacctagttccggcacgtcccaagaacacgaattgtgggcctgttccttcacatttgcaagaaaaggtgttgatcacacccttggcaaagaatga

SEQ ID NO: 3249 - protein, 7 aa, homo sapiens [sequence omitted]

SEQ ID NO: 3250 - DNA, 24 bp, homo sapiens
atggcgaaactctgtctctactaa

SEQ ID NO: 3251 - protein, 27 aa, homo sapiens
MEVAMSQDCAIAPQPGQQNETLSQKIK

SEQ ID NO: 3252 - DNA, 84 bp, homo sapiens
atggaggttgcaatgagccaagattgtgccattgcaccccagcctgggcaacagaatgagactctttctcaaaaaataaaataa

SEQ ID NO: 3253 - protein, 7 aa, homo sapiens
MRLFLKK

SEQ ID NO: 3254 - DNA, 24 bp, homo sapiens
atgagactctttctcaaaaaataa

SEQ ID NO: 3255 - protein, 31 aa, homo sapiens
MISSSRLHPQDARLVQHMHINKRNPLHKQSQ

SEQ ID NO: 3256 - DNA, 96 bp, homo sapiens
atgatctcatcaagtcggcttcatccccaagatgcaaggctggttcaacatatgcatatcaataaacgtaatccattacataaacagagccaatga

SEQ ID NO: 3257 - protein, 17 aa, homo sapiens
MITIRYFYECKLKHPSA

SEQ ID NO: 3258 - DNA, 54 bp, homo sapiens
atgataaccattagatatttttacgagtgtaaactgaagcatccctctgcctag

SEQ ID NO: 3259 - protein, 8 aa, homo sapiens
MWSYGLPN

SEQ ID NO: 3260 - DNA, 27 bp, homo sapiens
atgtggtcctacggtcttccaaattaa

SEQ ID NO: 3261 - protein, 5 aa, homo sapiens
MHQSQ

SEQ ID NO: 3262 - DNA, 18 bp, homo sapiens
atgcaccagagtcaatga

SEQ ID NO: 3263 - protein, 26 aa, homo sapiens
MKRVSCYSQYSSTPFQVDVKFLLVRT

SEQ ID NO: 3264 - DNA, 81 bp, homo sapiens
atgaagagagtcagctgctactcccagtattcttccactcctttccaagtagatgtaaagttccttttggtgaggacctaa

SEQ ID NO: 3265 - protein, 9 aa, homo sapiens
MPTITCMLY

SEQ ID NO: 3266 - DNA, 30 bp, homo sapiens
atgcctacaataacatgtatgctttactga

SEQ ID NO: 3267 - protein, 7 aa, homo sapiens
MYALLTM

SEQ ID NO: 3268 - DNA, 24 bp, homo sapiens
atgtatgctttactgaccatgtag

SEQ ID NO: 3269 - protein, 15 aa, homo sapiens
MILIPQNLEAKRSSI

SEQ ID NO: 3270 - DNA, 48 bp, homo sapiens
atgatcctaatacctcagaatttggaagccaaaaggtcctccatttag

SEQ ID NO: 3271 - protein, 4 aa, homo sapiens
MKKQ

SEQ ID NO: 3272 - DNA, 15 bp, homo sapiens
atgaaaaagcagtga

SEQ ID NO: 3273 - protein, 5 aa, homo sapiens
MHPGK

SEQ ID NO: 3274 - DNA, 18 bp, homo sapiens
atgcaccctggtaaatag

SEQ ID NO: 3275 - protein, 6 aa, homo sapiens
MLLQCL

SEQ ID NO: 3276 - DNA, 21 bp, homo sapiens
atgttgttgcagtgcctctga

SEQ ID NO: 3277 - protein, 20 aa, homo sapiens
MYWVGQNLLKYLNSWLLGFL

SEQ ID NO: 3278 - DNA, 63 bp, homo sapiens
atgtattgggtggggcagaatttgcttaaatatttaaatagttggttattgggatttttgtga

SEQ ID NO: 3279 - protein, 26 aa, homo sapiens
MRWNMKIEFILFTKTRSFFGIAGESE

SEQ ID NO: 3280 - DNA, 81 bp, homo sapiens
atgaggtggaatatgaaaatagaatttattttatttactaaaaccagatccttctttgggattgcaggtgagagtgagtga

SEQ ID NO: 3281 - protein, 13 aa, homo sapiens
MLPFLALFLFCFK

SEQ ID NO: 3282 - DNA, 42 bp, homo sapiens
atgttgccttttttagccctctttttattttgttttaagtga

SEQ ID NO: 3283 - protein, 42 aa, homo sapiens
MTDTEQIKFMVRSYVGNSHYHSQDTFAQEGTPSQLVKLLGQK

SEQ ID NO: 3284 - DNA, 129 bp, homo sapiens
atgactgatactgagcaaattaagtttatggtcagaagttatgtaggaaactcccattaccattcccaagatacttttgcccaggagggcaccccatcccagcttgtaaaattgctgggacaaaaatga

SEQ ID NO: 3285 - protein, 16 aa, homo sapiens
MIIVEEVLLLALKFLL

SEQ ID NO: 3286 - DNA, 51 bp, homo sapiens
atgattatcgtagaggaagttttgctgctggctttaaaatttttattatga

SEQ ID NO: 3287 - protein, 7 aa, homo sapiens
MYTRTEL

SEQ ID NO: 3288 - DNA, 24 bp, homo sapiens
atgtataccaggactgagttgtag

SEQ ID NO: 3289 - protein, 10 aa, homo sapiens
MLHLGVLLSC

SEQ ID NO: 3290 - DNA, 33 bp, homo sapiens; identical to SEQ ID NO: 252

SEQ ID NO: 3291 - protein, 8 aa, homo sapiens
MISKHPSS

SEQ ID NO: 3292 - DNA, 27 bp, homo sapiens
atgatctctaagcatccatccagctga

SEQ ID NO: 3293 - protein, 117 aa, homo sapiens; identical to SEQ ID NO: 255

SEQ ID NO: 3294 - DNA, 354 bp, homo sapiens; identical to SEQ ID NO: 256

SEQ ID NO: 3295 - protein, 4 aa, homo sapiens
MVFK

SEQ ID NO: 3296 - DNA, 15 bp, homo sapiens
atggttttcaaataa

SEQ ID NO: 3297 - protein, 15 aa, homo sapiens
MESCSRPVARAGGQW

SEQ ID NO: 3298 - DNA, 48 bp, homo sapiens
atggagtcttgctcccggcctgtcgcccgggctggagggcagtggtaa

SEQ ID NO: 3299 - protein, 7 aa, homo sapiens
MRATMPG

SEQ ID NO: 3300 - DNA, 24 bp, homo sapiens
atgcgcgccacaatgcctggctaa

SEQ ID NO: 3301 - protein, 62 aa, homo sapiens
MGFWTELASLYLLFLKSYCCPYAWYSLEQISSHTRSSLRERRWTLGVVPVVWSCWTVSLWSG

SEQ ID NO: 3302 - DNA, 189 bp, homo sapiens
atgggtttttggacagaactggcttctctttatttgttgtttttaaaatcatactgctgtccttatgcatggtactccttggaacagataagcagccatacaagaagctctttgagagagagaaggtggactctgggggtcgtgccggttgtttggagttgttggactgttagcttgtggagtgggtga

SEQ ID NO: 3303 - protein, 8 aa, homo sapiens
MHGTPWNR

SEQ ID NO: 3304 - DNA, 27 bp, homo sapiens
atgcatggtactccttggaacagataa

SEQ ID NO: 3305 - protein, 22 aa, homo sapiens
MGTHFPNAVFPGRAGAFLLLYS

SEQ ID NO: 3306 - DNA, 69 bp, homo sapiens
atgggcactcacttccccaatgcagtgtttcctgggagagcaggagcattcttactgctgtattcgtga

SEQ ID NO: 3307 - protein, 23 aa, homo sapiens
MQCFLGEQEHSYCCIREHSYCRV

SEQ ID NO: 3308 - DNA, 72 bp, homo sapiens
atgcagtgtttcctgggagagcaggagcattcttactgctgtattcgtgagcattcttactgcagggtgtga

SEQ ID NO: 3309 - protein, 43 aa, homo sapiens
MAVSLIVKPRCQEEQGNPSFLFRSFRGPLKLVGSKDKSGTRRS

SEQ ID NO: 3310 - DNA, 132 bp, homo sapiens
atggcagtcagtctcattgtaaaaccaagatgccaggaggaacagggaaacccctccttcttgttcagaagcttccgtggtccccttaaattggtagggtccaaggataaatctggtacaaggcgttcataa

SEQ ID NO: 3311 - protein, 19 aa, homo sapiens
MPGGTGKPLLLVQKLPWSP

SEQ ID NO: 3312 - DNA, 60 bp, homo sapiens
atgccaggaggaacagggaaacccctccttcttgttcagaagcttccgtggtccccttaa

SEQ ID NO: 3313 - protein, 9 aa, homo sapiens
MQYRSILSE

SEQ ID NO: 3314 - DNA, 30 bp, homo sapiens
atgcagtatcggtctatattgagtgaatag

SEQ ID NO: 3315 - protein, 8 aa, homo sapiens
MISFSFYL

SEQ ID NO: 3316 - DNA, 27 bp, homo sapiens
atgatttccttttcattttatttgtag

SEQ ID NO: 3317 - protein, 22 aa, homo sapiens
MLHAYIYHWINTRKSLNKGIFF

SEQ ID NO: 3318 - DNA, 69 bp, homo sapiens
atgctccatgcttacatatatcactggatcaatacaagaaaaagtttaaataaaggcatttttttttaa

SEQ ID NO: 3319 - protein, 13 aa, homo sapiens
MLTYITGSIQEKV

SEQ ID NO: 3320 - DNA, 42 bp, homo sapiens
atgcttacatatatcactggatcaatacaagaaaaagtttaa

SEQ ID NO: 3321 - protein, 9 aa, homo sapiens
MQYRSILSE

SEQ ID NO: 3322 - DNA, 30 bp, homo sapiens; identical to SEQ ID NO: 3314

SEQ ID NO: 3323 - protein, 8 aa, homo sapiens
MISFSFYL

SEQ ID NO: 3324 - DNA, 27 bp, homo sapiens
atgatttccttttcattttatttgtag

SEQ ID NO: 3325 - protein, 22 aa, homo sapiens
MLHAYIYHWINTRKSLNKGIFF

SEQ ID NO: 3326 - DNA, 69 bp, homo sapiens; identical to SEQ ID NO: 3318

SEQ ID NO: 3327 - protein, 13 aa, homo sapiens
MLTYITGSIQEKV

SEQ ID NO: 3328 - DNA, 42 bp, homo sapiens; identical to SEQ ID NO: 3320

SEQ ID NO: 3329 - protein, 4 aa, homo sapiens
MCQH

SEQ ID NO: 3330 - DNA, 15 bp, homo sapiens
atgtgccagcattag

SEQ ID NO: 3331 - protein, 4 aa, homo sapiens
MECP

SEQ ID NO: 3332 - DNA, 15 bp, homo sapiens
atggaatgtccttaa

SEQ ID NO: 3333 - protein, 10 aa, homo sapiens
MSLNSNGGAE

SEQ ID NO: 3334 - DNA, 33 bp, homo sapiens
atgtccttaaattctaatggaggagctgagtga

SEQ ID NO: 3335 - protein, 18 aa, homo sapiens
MEELSEQIHHIMWVRVKC

SEQ ID NO: 3336 - DNA, 57 bp, homo sapiens
atggaggagctgagtgaacaaatacatcatataatgtgggtcagggttaaatgctag

SEQ ID NO: 3337 - protein, 4 aa, homo sapiens
MCQH

SEQ ID NO: 3338 - DNA, 15 bp, homo sapiens
atgtgccagcattag

SEQ ID NO: 3339 - protein, 4 aa, homo sapiens
MECP

SEQ ID NO: 3340 - DNA, 15 bp, homo sapiens
atggaatgtccttaa

SEQ ID NO: 3341 - protein, 10 aa, homo sapiens
MSLNSNGGAE

SEQ ID NO: 3342 - DNA, 33 bp, homo sapiens; identical to SEQ ID NO: 3334

SEQ ID NO: 3343 - protein, 18 aa, homo sapiens
MEELSEQIHHIMWVRVKC

SEQ ID NO: 3344 - DNA, 57 bp, homo sapiens; identical to SEQ ID NO: 3336

SEQ ID NO: 3345 - protein, 5 aa, homo sapiens
MINCN

SEQ ID NO: 3346 - DNA, 18 bp, homo sapiens
atgataaactgtaattag

SEQ ID NO: 3347 - protein, 51 aa, homo sapiens
MWTVKYLRAKPLTSLSISIRLAAHLEHRSSMLPRAGLLAHHSQDSSGQGLC

SEQ ID NO: 3348 - DNA, 156 bp, homo sapiens
atgtggacagtgaagtatttgcgtgcaaagcccctcacctctctgagcatttccatcaggctcgctgctcacctggagcacaggtcatctatgctgccccgggcaggactcctcgcccatcacagccaagactcctcaggtcaaggcctctgctga

SEQ ID NO: 3349 - protein, 45 aa, homo sapiens [sequence omitted]

SEQ ID NO: 3350 - DNA, 138 bp, homo sapiens
atgctgacctctgttcttttacagcttcctcatcgggatgcacagcaagtcggattccccaagcagaagctgggcagcccacctggaagaggaggccaggcaggtgctgcaggtcgggctcaccatgacacagtgtga

SEQ ID NO: 3351 - protein, 130 aa, homo sapiens [sequence omitted]

SEQ ID NO: 3352 - DNA, 393 bp, homo sapiens
atgcacagcaagtcggattccccaagcagaagctgggcagcccacctggaagaggaggccaggcaggtgctgcaggtcgggctcaccatgacacagtgtgagacctcgggctacaacacaggacccgggcgctgctctgacccctcgtgtcttgtgttgcagccggagggacgcaggtccgcagcagagcctgctccgcttgtcctgagggactcgacacaggggactgcacagagaccatgggaaagtccaggctctggtgggcaggtgggtggggtgttgggagagaggccgacccggaccaccccaggtgtcacccattcagcccccttttttgtcctagtttcgtctctccgtacacagcttggctcacctctggcccagtgcaggtag

SEQ ID NO: 3353 - protein, 9 aa, homo sapiens
MILPPQYPE

SEQ ID NO: 3354 - DNA, 30 bp, homo sapiens
atgatcctcccacctcagtatcctgagtag

SEQ ID NO: 3355 - protein, 27 aa, homo sapiens
MLPNLALNSQPQANLPPCSPKVLGLQV

SEQ ID NO: 3356 - DNA, 84 bp, homo sapiens
atgttgcccaacctggccttgaactcccagcctcaagcaaacctcccaccttgttctcccaaagtgctgggactacaggtgtga

SEQ ID NO: 3357 - protein, 5 aa, homo sapiens
MQRYK

SEQ ID NO: 3358 - DNA, 18 bp, homo sapiens
atgcaaagatataaatag

SEQ ID NO: 3359 - protein, 34 aa, homo sapiens
MILPDKIDYKTMSIIREKEEYFTIKRRSIYQKEM

SEQ ID NO: 3360 - DNA, 105 bp, homo sapiens
atgatattaccagacaaaatagactataagacaatgagtattatcagagagaaagaagaatatttcaccataaaaaggaggtcaatatatcagaaagaaatgtag

SEQ ID NO: 3361 - protein, 28 aa, homo sapiens
MGGQGQLIHRPWFGGGAQEHSSLFLLGC

SEQ ID NO: 3362 - DNA, 87 bp, homo sapiens
atgggtgggcaaggccaactgatacacagaccatggtttgggggtggtgctcaagaacatagctccctcttccttctggggtgctga

SEQ ID NO: 3363 - protein, 9 aa, homo sapiens
MVWGWCSRT

SEQ ID NO: 3364 - DNA, 30 bp, homo sapiens
atggtttgggggtggtgctcaagaacatag

SEQ ID NO: 3365 - protein, 19 aa, homo sapiens
MCLRLPWALHTCTCTCGGE

SEQ ID NO: 3366 - DNA, 60 bp, homo sapiens
atgtgcctgaggctgccctgggcactgcacacatgcacgtgcacatgtgggggtgagtag

SEQ ID NO: 3367 - protein, 7 aa, homo sapiens
MHVHMWG

SEQ ID NO: 3368 - DNA, 24 bp, homo sapiens
atgcacgtgcacatgtgggggtga

SEQ ID NO: 3369 - protein, 31 aa, homo sapiens [sequence omitted]

SEQ ID NO: 3370 - DNA, 96 bp, homo sapiens
atgttaaaacttgggtggaaaaatagtaaaatcactgatgctttacaaaaagcttacagaggcataagtagtttacaaataaataacttgttttaa

SEQ ID NO: 3371 - protein, 9 aa, homo sapiens
MLYKKLTEA

SEQ ID NO: 3372 - DNA, 30 bp, homo sapiens
atgctttacaaaaagcttacagaggcataa

SEQ ID NO: 3373 - protein, 4 aa, homo sapiens
MRQC

SEQ ID NO: 3374 - DNA, 15 bp, homo sapiens
atgagacaatgttga

SEQ ID NO: 3375 - protein, 13 aa, homo sapiens
MLKIKPIAADHPH

SEQ ID NO: 3376 - DNA, 42 bp, homo sapiens
atgttgaagataaagcccatagcagcagaccatccacattga

SEQ ID NO: 3377 - protein, 60 aa, homo sapiens [sequence omitted]

SEQ ID NO: 3378 - DNA, 183 bp, homo sapiens
atgtcattttcagagagaggggtttttaaggagcaatactacagcggaggagctgacatctttttttttccccatccgggagggggggcgcggttggaggggagggaggaaaaagaaggggagggggggaaatatcagctccgtaattatccgcgcattcggttctcaccatgtgacggctag

SEQ ID NO: 3379 - protein, 29 aa, homo sapiens
MGFENGLDDSDGRDVSGVKLSAGGARRVE

SEQ ID NO: 3380 - DNA, 90 bp, homo sapiens
atgggatttgaaaatggccttgatgattcagacggccgtgacgtcagcggggtcaagttgtcggcaggcggagcgcgcagagtggagtaa

SEQ ID NO: 3381 - protein, 29 aa, homo sapiens
MALMIQTAVTSAGSSCRQAERAEWSNSAI

SEQ ID NO: 3382 - DNA, 90 bp, homo sapiens
atggccttgatgattcagacggccgtgacgtcagcggggtcaagttgtcggcaggcggagcgcgcagagtggagtaacagcgccatctag

SEQ ID NO: 3383 - protein, 54 aa, homo sapiens
MRERGRERGNPGLKTVKFKLKGRDTNQVLLPTLHLPFPYPRTRLPLLTLGMGVG

SEQ ID NO: 3384 - DNA, 165 bp, homo sapiens
atgcgggagagagggagagagcgaggcaacccggggctcaaaacagtcaaattcaaattaaaaggtcgagacacgaatcaggtacttctccccactcttcatctcccctttccatatccccggacccgactcccacttcttaccttggggatgggagtggggtga

SEQ ID NO: 3385 - protein, 17 aa, homo sapiens
MINPCINFAFFSKIFYK

SEQ ID NO: 3386 - DNA, 54 bp, homo sapiens
atgattaatccatgtataaatttcgcttttttttctaaaattttctacaaataa

SEQ ID NO: 3387 - protein, 8 aa, homo sapiens
MYKFRFFF

SEQ ID NO: 3388 - DNA, 27 bp, homo sapiens
atgtataaatttcgcttttttttctaa

SEQ ID NO: 3389 - protein, 7 aa, homo sapiens
MAIANIC

SEQ ID NO: 3390 - DNA, 24 bp, homo sapiens
atggcaattgctaatatttgttga

SEQ ID NO: 3391 - protein, 6 aa, homo sapiens
MSQALC

SEQ ID NO: 3392 - DNA, 21 bp, homo sapiens
atgagccaggcattatgctaa

SEQ ID NO: 3393 - protein, 9 aa, homo sapiens
MKSLSMPMS

SEQ ID NO: 3394 - DNA, 30 bp, homo sapiens
atgaagtctttgtccatgcccatgtcctga

SEQ ID NO: 3395 - protein, 23 aa, homo sapiens
MVLPRFSSRVFMVLVLHLSLNPS

SEQ ID NO: 3396 - DNA, 72 bp, homo sapiens
atggtattgcctaggttttcttctagggtttttatggttttagtcttacatttaagtcttaatccatcttga

SEQ ID NO: 3397 - protein, 31 aa, homo sapiens
MASQFSQHRLLNKGSFPHFLFLSGLSKIRWL

SEQ ID NO: 3398 - DNA, 96 bp, homo sapiens
atggctagccagttttcccaacaccgtttattaaataagggatcctttccccatttcttgtttttgtcaggtttgtcaaagatcagatggttgtag

SEQ ID NO: 3399 - protein, 9 aa, homo sapiens
MVVDVWCYF

SEQ ID NO: 3400 - DNA, 30 bp, homo sapiens
atggttgtagatgtgtggtgttatttctga

SEQ ID NO: 3401 - protein, 9 aa, homo sapiens
MILPPQYPE

SEQ ID NO: 3402 - DNA, 30 bp, homo sapiens; identical to SEQ ID NO: 3354

SEQ ID NO: 3403 - protein, 27 aa, homo sapiens
MLPNLALNSQPQANLPPCSPKVLGLQV

SEQ ID NO: 3404 - DNA, 84 bp, homo sapiens; identical to SEQ ID NO: 3356

SEQ ID NO: 3405 - protein, 5 aa, homo sapiens
MQRYK

SEQ ID NO: 3406 - DNA, 18 bp, homo sapiens
atgcaaagatataaatag

SEQ ID NO: 3407 - protein, 34 aa, homo sapiens; identical to SEQ ID NO: 3359

SEQ ID NO: 3408 - DNA, 105 bp, homo sapiens; identical to SEQ ID NO: 3360

SEQ ID NO: 3409 - protein, 20 aa, homo sapiens
MFYICFDFPCTVHELEMIWQ

SEQ ID NO: 3410 - DNA, 63 bp, homo sapiens
atgttttacatctgctttgattttccctgtacagtacatgaactagagatgatatggcaataa

SEQ ID NO: 3411 - protein, 10 aa, homo sapiens
MAINFPVNTH

SEQ ID NO: 3412 - DNA, 33 bp, homo sapiens
atggcaataaattttcctgtgaatacacactaa

SEQ ID NO: 3413 - protein, 6 aa, homo sapiens
MRQHIS

SEQ ID NO: 3414 - DNA, 21 bp, homo sapiens
atgaggcaacacattagttga

SEQ ID NO: 3415 - protein, 16 aa, homo sapiens
MSSNPDISDSLQNIDS

SEQ ID NO: 3416 - DNA, 51 bp, homo sapiens
atgtcaagcaatccagatatttctgattccctccaaaacatagactcttga

SEQ ID NO: 3417 - protein, 9 aa, homo sapiens
MILPPQYPE

SEQ ID NO: 3418 - DNA, 30 bp, homo sapiens; identical to SEQ ID NO: 3354

SEQ ID NO: 3419 - protein, 27 aa, homo sapiens
MLPNLALNSQPQANLPPCSPKVLGLQV

SEQ ID NO: 3420 - DNA, 84 bp, homo sapiens; identical to SEQ ID NO: 3356

SEQ ID NO: 3421 - protein, 5 aa, homo sapiens
MQRYK

SEQ ID NO: 3422 - DNA, 18 bp, homo sapiens
atgcaaagatataaatag

SEQ ID NO: 3423 - protein, 34 aa, homo sapiens; identical to SEQ ID NO: 3359

SEQ ID NO: 3424 - DNA, 105 bp, homo sapiens; identical to SEQ ID NO: 3360

SEQ ID NO: 3425 - protein, 6 aa, homo sapiens
MAQRIK

SEQ ID NO: 3426 - DNA, 21 bp, homo sapiens
atggcacaaagaataaaatga

SEQ ID NO: 3427 - protein, 26 aa, homo sapiens
MNDFSEVPHLSPLVPVRTGLNQLIRK

SEQ ID NO: 3428 - DNA, 81 bp, homo sapiens
atgaatgacttctcagaagtcccacatttatcaccactagttcctgtaagaactggtttgaaccaattaataaggaaatga

SEQ ID NO: 3429 - protein, 11 aa, homo sapiens
MTSQKSHIYHH

SEQ ID NO: 3430 - DNA, 36 bp, homo sapiens
atgacttctcagaagtcccacatttatcaccactag

SEQ ID NO: 3431 - protein, 9 aa, homo sapiens
MTYACVIPS

SEQ ID NO: 3432 - DNA, 30 bp, homo sapiens
atgacttatgcttgtgtcatccctagttaa

SEQ ID NO: 3433 - protein, 13 aa, homo sapiens
MGVHYFILLNCRD

SEQ ID NO: 3434 - DNA, 42 bp, homo sapiens
atgggtgttcactatttcattctcctcaactgtagagattag

SEQ ID NO: 3435 - protein, 18 aa, homo sapiens
MNHLTQYSAYNRLSNNKM

SEQ ID NO: 3436 - DNA, 57 bp, homo sapiens
atgaatcacttaacacagtactcagcatataataggctttcaaacaacaagatgtag

SEQ ID NO: 3437 - protein, 18 aa, homo sapiens
MTQSMKYRNMAGCGGSCL

SEQ ID NO: 3438 - DNA, 57 bp, homo sapiens
atgactcagtctatgaagtatagaaatatggcagggtgtggtggttcatgcctgtaa

SEQ ID NO: 3439 - protein, 48 aa, homo sapiens
MPVILALWEAKAGGSPDIMSSRPACPTWCNPISTKKLQKLARRGDVCL

SEQ ID NO: 3440 - DNA, 147 bp, homo sapiens
atgcctgtaatcctagcactttgggaagccaaggcgggtggatcacctgatatcatgagttcgagaccagcctgcccaacatggtgtaaccccatctctactaaaaaattacaaaaattagcaaggcgtggtgatgtgtgcctgtaa

SEQ ID NO: 3441 - protein, 31 aa, homo sapiens [sequence omitted]

SEQ ID NO: 3442 - DNA, 96 bp, homo sapiens; identical to SEQ ID NO: 3370

SEQ ID NO: 3443 - protein, 9 aa, homo sapiens
MLYKKLTEA

SEQ ID NO: 3444 - DNA, 30 bp, homo sapiens; identical to SEQ ID NO: 3372

SEQ ID NO: 3445 - protein, 4 aa, homo sapiens
MRQC

SEQ ID NO: 3446 - DNA, 15 bp, homo sapiens
atgagacaatgttga

SEQ ID NO: 3447 - protein, 13 aa, homo sapiens
MLKIKPIAADHPH

SEQ ID NO: 3448 - DNA, 42 bp, homo sapiens; identical to SEQ ID NO: 3376

SEQ ID NO: 3449 - protein, 120 aa, homo sapiens
MVGFSFVPDLFLGAVFSFIQRGFSPFCALGSSYLPLKCRPNDLSFLTSYQNPTGFLHTLCPYKTLFKSLYNHICHIVEIYLFHCLSPSLDQELTEDQYQAALMYLSLNEWNYECTLLSLS

SEQ ID NO: 3450 - DNA, 363 bp, homo sapiens
atggtgggcttctcattcgttccagatttattcctgggagcagtgttttcttttatccaaagaggcttttctcccttctgtgccctgggaagctcctacctacctttaaagtgccgcccaaatgacctgtcctttcttacctcttatcagaatccaacagggttcctccacactctgtgcccctacaagactttgttcaaatccctgtataatcacatttgccacattgttgaaatttatctttttcactgtctgtctccatcgctagaccaggagctcacagaggaccagtaccaggcagcactcatgtatctcagtctgaatgaatggaattatgaatgcaccctgctctctttgtcttaa

SEQ ID NO: 3451 - protein, 48 aa, homo sapiens
MTCPFLPLIRIQQGSSTLCAPTRLCSNPCIITFATLLKFIFFTVCLHR

SEQ ID NO: 3452 - DNA, 147 bp, homo sapiens
atgacctgtcctttcttacctcttatcagaatccaacagggttcctccacactctgtgcccctacaagactttgttcaaatccctgtataatcacatttgccacattgttgaaatttatctttttcactgtctgtctccatcgctag

SEQ ID NO: 3453 - protein, 46 aa, homo sapiens
MNGIMNAPCSLCLNPTQGSRPGSVPSPFPGLSQPLTPGYECLPSLK

SEQ ID NO: 3454 - DNA, 141 bp, homo sapiens
atgaatggaattatgaatgcaccctgctctctttgtcttaatcctacccaaggttccaggcctggctcagtcccgagccccttccctggactttctcagccactcactccaggctatgagtgtctcccttctctgaaatga

SEQ ID NO: 3455 - protein, 39 aa, homo sapiens
MHPALFVLILPKVPGLAQSRAPSLDFLSHSLQAMSVSLL

SEQ ID NO: 3456 - DNA, 120 bp, homo sapiens
atgcaccctgctctctttgtcttaatcctacccaaggttccaggcctggctcagtcccgagccccttccctggactttctcagccactcactccaggctatgagtgtctcccttctctga

SEQ ID NO: 3457 - protein, 120 aa, homo sapiens; identical to SEQ ID NO: 3449

SEQ ID NO: 3458 - DNA, 363 bp, homo sapiens; identical to SEQ ID NO: 3450

SEQ ID NO: 3459 - protein, 48 aa, homo sapiens; identical to SEQ ID NO: 3451

SEQ ID NO: 3460 - DNA, 147 bp, homo sapiens; identical to SEQ ID NO: 3452

SEQ ID NO: 3461 - protein, 46 aa, homo sapiens; identical to SEQ ID NO: 3453

SEQ ID NO: 3462 - DNA, 141 bp, homo sapiens; identical to SEQ ID NO: 3454

SEQ ID NO: 3463 - protein, 39 aa, homo sapiens; identical to SEQ ID NO: 3455

SEQ ID NO: 3464 - DNA, 120 bp, homo sapiens; identical to SEQ ID NO: 3456

SEQ ID NO: 3465 - protein, 120 aa, homo sapiens; identical to SEQ ID NO: 3449

SEQ ID NO: 3466 - DNA, 363 bp, homo sapiens; identical to SEQ ID NO: 3450

SEQ ID NO: 3467 - protein, 48 aa, homo sapiens; identical to SEQ ID NO: 3451

SEQ ID NO: 3468 - DNA, 147 bp, homo sapiens; identical to SEQ ID NO: 3452

SEQ ID NO: 3469 - protein, 46 aa, homo sapiens; identical to SEQ ID NO: 3453

SEQ ID NO: 3470 - DNA, 141 bp, homo sapiens; identical to SEQ ID NO: 3454

SEQ ID NO: 3471 - protein, 39 aa, homo sapiens; identical to SEQ ID NO: 3455

SEQ ID NO: 3472 - DNA, 120 bp, homo sapiens; identical to SEQ ID NO: 3456

SEQ ID NO: 3473 - protein, 44 aa, homo sapiens
MCSLEVSSCSINVSFEYYLILSVVNCILFHTSICGILQLLSVSY

SEQ ID NO: 3474 - DNA, 135 bp, homo sapiens
atgtgttccctggaagttagtagttgctcaataaatgttagctttgagtattaccttattttatcagttgtaaattgcatactttttcacacttccatctgtggaattttacagttattgtcagtaagttattga

SEQ ID NO: 3475 - protein, 12 aa, homo sapiens
MLALSITLFYQL

SEQ ID NO: 3476 - DNA, 39 bp, homo sapiens
atgttagctttgagtattaccttattttatcagttgtaa

SEQ ID NO: 3477 - protein, 16 aa, homo sapiens
MKEIIITVFNKTVAEN

SEQ ID NO: 3478 - DNA, 51 bp, homo sapiens
atgaaagagattattattactgtgttcaacaaaactgttgctgagaactag

SEQ ID NO: 3479 - protein, 26 aa, homo sapiens
MHINQEATVKVVIKTYPERNRIIIKQ

SEQ ID NO: 3480 - DNA, 81 bp, homo sapiens
atgcatataaatcaagaagcaacagtcaaggtggtgataaaaacataccctgaaagaaacagaattatcataaagcaatga

SEQ ID NO: 3481 - protein, 58 aa, homo sapiens
MGRRRRLQGRQDPGSSVSPRAKEKVGLGRPLHMCLLQAKIYIFRFQSVLPKGQVEKYI

SEQ ID NO: 3482 - DNA, 177 bp, homo sapiens
atggggaggaggagacggttgcaggggagacaggacccaggcagcagcgtgtctccaagagctaaggagaaggtggggctggggcggcctttgcacatgtgcctgttacaggctaagatttatatttttcgtttccaaagtgtgctccccaaagggcaagtagagaaatacatatag

SEQ ID NO: 3483 - protein, 10 aa, homo sapiens
MVQPFDHSML

SEQ ID NO: 3484 - DNA, 33 bp, homo sapiens
atggtacagccctttgaccacagtatgttatag

SEQ ID NO: 3485 - protein, 19 aa, homo sapiens
MFTKNTFTSLAPPSLITVF

SEQ ID NO: 3486 - DNA, 60 bp, homo sapiens
atgttcacgaaaaacactttcactagcttagctcctccatccctgattactgtgttctga

SEQ ID NO: 3487 - protein, 16 aa, homo sapiens
MGENSRGILSLSWKEK

SEQ ID NO: 3488 - DNA, 51 bp, homo sapiens
atgggggaaaacagcaggggaattctcagcctatcttggaaagagaagtag

SEQ ID NO: 3489 - protein, 16 aa, homo sapiens
MQSIKVSLQGPSQGKK

SEQ ID NO: 3490 - DNA, 51 bp, homo sapiens
atgcagtccataaaggttagtctccaggggcccagtcagggcaaaaaatga

SEQ ID NO: 3491 - protein, 34 aa, homo sapiens
MRGKICACTCTCVRACAHVFVEGSKEQMEKKQLD

SEQ ID NO: 3492 - DNA, 105 bp, homo sapiens
atgagagggaagatctgtgcgtgtacgtgtacatgtgtgcgtgcatgtgcacatgtctttgttgagggaagcaaggaacaaatggagaaaaaacagcttgactga

SEQ ID NO: 3493 - protein, 10 aa, homo sapiens
MCACMCTCLC

SEQ ID NO: 3494 - DNA, 33 bp, homo sapiens
atgtgtgcgtgcatgtgcacatgtctttgttga

SEQ ID NO: 3495 - protein, 22 aa, homo sapiens
MSLLREARNKWRKNSLTDKYSQ

SEQ ID NO: 3496 - DNA, 69 bp, homo sapiens
atgtctttgttgagggaagcaaggaacaaatggagaaaaaacagcttgactgacaaatatagccaataa

SEQ ID NO: 3497 - protein, 16 aa, homo sapiens
MQSIKVSLQGPSQGKK

SEQ ID NO: 3498 - DNA, 51 bp, homo sapiens; identical to SEQ ID NO: 3490

SEQ ID NO: 3499 - protein, 34 aa, homo sapiens; identical to SEQ ID NO: 3491

SEQ ID NO: 3500 - DNA, 105 bp, homo sapiens; identical to SEQ ID NO: 3492

SEQ ID NO: 3501 - protein, 10 aa, homo sapiens
MCACMCTCLC

SEQ ID NO: 3502 - DNA, 33 bp, homo sapiens; identical to SEQ ID NO: 3494

SEQ ID NO: 3503 - protein, 22 aa, homo sapiens
MSLLREARNKWRKNSLTDKYSQ

SEQ ID NO: 3504 - DNA, 69 bp, homo sapiens; identical to SEQ ID NO: 3496

SEQ ID NO: 3505 - protein, 51 aa, homo sapiens
MPYLCNIIKFICHAGHSILRSHINLHKVNSLQCIVLWILTNGWARCSGSGL

SEQ ID NO: 3506 - DNA, 156 bp, homo sapiens
atgccatacctttgtaatataattaagttcatttgtcatgccggccattctatcctaagatcccacattaatttgcataaagttaactctctgcagtgtattgttctgtggattttgacaaatggatgggccaggtgcagtggctcaggcctgtaa

SEQ ID NO: 3507 - protein, 6 aa, homo sapiens
MPAILS

SEQ ID NO: 3508 - DNA, 21 bp, homo sapiens
atgccggccattctatcctaa

SEQ ID NO: 3509 - protein, 24 aa, homo sapiens
MDGPGAVAQACNPSTLGGRGGRIT

SEQ ID NO: 3510 - DNA, 75 bp, homo sapiens
atggatgggccaggtgcagtggctcaggcctgtaatcccagcactttgggaggtcgaggtgggaggatcacttga

SEQ ID NO: 3511 - protein, 41 aa, homo sapiens
MGQVQWLRPVIPALWEVEVGGSLETRTSREIGSYASTATRP

SEQ ID NO: 3512 - DNA, 126 bp, homo sapiens
atgggccaggtgcagtggctcaggcctgtaatcccagcactttgggaggtcgaggtgggaggatcacttgagaccaggacttcaagagaaataggtagttatgcatctactgccacaagaccctaa

SEQ ID NO: 3513 - protein, 51 aa, homo sapiens; identical to SEQ ID NO: 3505

SEQ ID NO: 3514 - DNA, 156 bp, homo sapiens; identical to SEQ ID NO: 3506

SEQ ID NO: 3515 - protein, 6 aa, homo sapiens
MPAILS

SEQ ID NO: 3516 - DNA, 21 bp, homo sapiens
atgccggccattctatcctaa

SEQ ID NO: 3517 - protein, 24 aa, homo sapiens
MDGPGAVAQACNPSTLGGRGGRIT

SEQ ID NO: 3518 - DNA, 75 bp, homo sapiens; identical to SEQ ID NO: 3510

SEQ ID NO: 3519 - protein, 41 aa, homo sapiens; identical to SEQ ID NO: 3511

SEQ ID NO: 3520 - DNA, 126 bp, homo sapiens; identical to SEQ ID NO: 3512

SEQ ID NO: 3521 - protein, 51 aa, homo sapiens; identical to SEQ ID NO: 3505

SEQ ID NO: 3522 - DNA, 156 bp, homo sapiens; identical to SEQ ID NO: 3506

SEQ ID NO: 3523 - protein, 6 aa, homo sapiens
MPAILS

SEQ ID NO: 3524 - DNA, 21 bp, homo sapiens
atgccggccattctatcctaa

SEQ ID NO: 3525 - protein, 24 aa, homo sapiens
MDGPGAVAQACNPSTLGGRGGRIT

SEQ ID NO: 3526 - DNA, 75 bp, homo sapiens; identical to SEQ ID NO: 3510

SEQ ID NO: 3527 - protein, 41 aa, homo sapiens; identical to SEQ ID NO: 3511

SEQ ID NO: 3528 - DNA, 126 bp, homo sapiens; identical to SEQ ID NO: 3512

SEQ ID NO: 3529 - protein, 4 aa, homo sapiens
MRKK

SEQ ID NO: 3530 - DNA, 15 bp, homo sapiens
atgaggaagaaataa

SEQ ID NO: 3531 - protein, 10 aa, homo sapiens
MRKFITTRQS

SEQ ID NO: 3532 - DNA, 33 bp, homo sapiens
atgaggaaattcatcactactagacagtcttag

SEQ ID NO: 3533 - protein, 30 aa, homo sapiens
MFDQGSPTSGNKKMIITIMKTHKIMNSLID

SEQ ID NO: 3534 - DNA, 93 bp, homo sapiens
atgttcgatcaaggtagtcctacatctggaaacaaaaagatgataatcactatcatgaaaacacataaaattatgaactcattgatagactag

SEQ ID NO: 3535 - protein, 14 aa, homo sapiens
MENKKYDPTICCLK

SEQ ID NO: 3536 - DNA, 45 bp, homo sapiens
atggagaataagaaatatgacccaactatatgctgtcttaaataa

SEQ ID NO: 3537 - protein, 4 aa, homo sapiens
MRKK

SEQ ID NO: 3538 - DNA, 15 bp, homo sapiens
atgaggaagaaataa

SEQ ID NO: 3539 - protein, 10 aa, homo sapiens
MRKFITTRQS

SEQ ID NO: 3540 - DNA, 33 bp, homo sapiens; identical to SEQ ID NO: 3532

SEQ ID NO: 3541 - protein, 30 aa, homo sapiens; identical to SEQ ID NO: 3533

SEQ ID NO: 3542 - DNA, 93 bp, homo sapiens; identical to SEQ ID NO: 3534

SEQ ID NO: 3543 - protein, 14 aa, homo sapiens
MENKKYDPTICCLK

SEQ ID NO: 3544 - DNA, 45 bp, homo sapiens; identical to SEQ ID NO: 3536

SEQ ID NO: 3545 - protein, 30 aa, homo sapiens
MGICIISALMWPEIGGLVSPSLLLVAKQQS

SEQ ID NO: 3546 - DNA, 93 bp, homo sapiens
atgggtatttgcataatcagtgctttgatgtggccagaaatcggaggtttggtctccccaagtctgctattggtagcgaagcaacaaagctag

SEQ ID NO: 3547 - protein, 12 aa, homo sapiens
MIKLKECPKKEG

SEQ ID NO: 3548 - DNA, 39 bp, homo sapiens
atgattaaacttaaggaatgtccaaaaaaggagggatga

SEQ ID NO: 3549 - protein, 87 aa, homo sapiens
MSKKGGMKDQLSHHSTDTPRPPPPPPCFLLFSAVSFPKRLVWGMVHLPWGRPTWHRVGIGRGPLGPRRGQVCRSGSPCPQRVFPSPV

SEQ ID NO: 3550 - DNA, 264 bp, homo sapiens
atgtccaaaaaaggagggatgaaagaccagctttctcatcactccacggacacaccccgccccccgcccccccccccatgcttcttattattctctgcagtttcttttccaaagcgcttggtttgggggatggtgcatctcccttggggccgccccacgtggcaccgagtgggcatcggcaggggtcccctagggccaaggaggggccaggtctgcaggagcggttctccttgcccccaacgcgtttttccttccccagtttga

SEQ ID NO: 3551 - protein, 77 aa, homo sapiens
MLLIILCSFFSKALGLGDGASPLGPPHVAPSGHRQGSPRAKEGPGLQERFSLPPTRFSFPSLIFPAGMGFILWRTLK

SEQ ID NO: 3552 - DNA, 234 bp, homo sapiens
atgcttcttattattctctgcagtttcttttccaaagcgcttggtttgggggatggtgcatctcccttggggccgccccacgtggcaccgagtgggcatcggcaggggtcccctagggccaaggaggggccaggtctgcaggagcggttctccttgcccccaacgcgtttttccttccccagtttgatttttccagccgggatggggttcatcttatggaggacgttgaagtga

SEQ ID NO: 3553 - protein, 30 aa, homo sapiens; identical to SEQ ID NO: 3545

SEQ ID NO: 3554 - DNA, 93 bp, homo sapiens; identical to SEQ ID NO: 3546

SEQ ID NO: 3555 - protein, 12 aa, homo sapiens
MIKLKECPKKEG

SEQ ID NO: 3556 - DNA, 39 bp, homo sapiens; identical to SEQ ID NO: 3548

SEQ ID NO: 3557 - protein, 87 aa, homo sapiens; identical to SEQ ID NO: 3549

SEQ ID NO: 3558 - DNA, 264 bp, homo sapiens; identical to SEQ ID NO: 3550

SEQ ID NO: 3559 - protein, 77 aa, homo sapiens; identical to SEQ ID NO: 3551

SEQ ID NO: 3560 - DNA, 234 bp, homo sapiens; identical to SEQ ID NO: 3552

SEQ ID NO: 3561 - protein, 30 aa, homo sapiens; identical to SEQ ID NO: 3545

SEQ ID NO: 3562 - DNA, 93 bp, homo sapiens; identical to SEQ ID NO: 3546

SEQ ID NO: 3563 - protein, 12 aa, homo sapiens
MIKLKECPKKEG

SEQ ID NO: 3564 - DNA, 39 bp, homo sapiens; identical to SEQ ID NO: 3548

SEQ ID NO: 3565 - protein, 87 aa, homo sapiens; identical to SEQ ID NO: 3549

SEQ ID NO: 3566 - DNA, 264 bp, homo sapiens; identical to SEQ ID NO: 3550

SEQ ID NO: 3567 - protein, 77 aa, homo sapiens; identical to SEQ ID NO: 3551

SEQ ID NO: 3568 - DNA, 234 bp, homo sapiens; identical to SEQ ID NO: 3552

SEQ ID NO: 3569 - protein, 30 aa, homo sapiens; identical to SEQ ID NO: 3545

SEQ ID NO: 3570 - DNA, 93 bp, homo sapiens; identical to SEQ ID NO: 3546

SEQ ID NO: 3571 - protein, 12 aa, homo sapiens
MIKLKECPKKEG

SEQ ID NO: 3572 - DNA, 39 bp, homo sapiens; identical to SEQ ID NO: 3548

SEQ ID NO: 3573 - protein, 87 aa, homo sapiens; identical to SEQ ID NO: 3549

SEQ ID NO: 3574 - DNA, 264 bp, homo sapiens; identical to SEQ ID NO: 3550

SEQ ID NO: 3575 - protein, 77 aa, homo sapiens; identical to SEQ ID NO: 3551

SEQ ID NO: 3576 - DNA, 234 bp, homo sapiens; identical to SEQ ID NO: 3552

SEQ ID NO: 3577 - protein, 10 aa, homo sapiens
MLNVRFTLLR

SEQ ID NO: 3578 - DNA, 33 bp, homo sapiens
atgttaaatgtacgctttacgctgttaagataa

SEQ ID NO: 3579 - protein, 6 aa, homo sapiens
MYALRC

SEQ ID NO: 3580 - DNA, 21 bp, homo sapiens
atgtacgctttacgctgttaa

SEQ ID NO: 3581 - protein, 19 aa, homo sapiens
MHVEIILSNLATCLFTSCG

SEQ ID NO: 3582 - DNA, 60 bp, homo sapiens
atgcatgttgaaatcatattaagtaacctggccacttgcctatttacttcttgtggctaa

SEQ ID NO: 3583 - protein, 5 aa, homo sapiens
MLKSY

SEQ ID NO: 3584 - DNA, 18 bp, homo sapiens
atgttgaaatcatattaa

SEQ ID NO: 3585 - protein, 7 aa, homo sapiens
MYFNKVL

SEQ ID NO: 3586 - DNA, 24 bp, homo sapiens
atgtattttaataaagttttataa

SEQ ID NO: 3587 - protein, 35 aa, homo sapiens
MGQAQWLMPVIPALCEAKVGRSLEPRSSKPAWPKW

SEQ ID NO: 3588 - DNA, 108 bp, homo sapiens
atgggccaggcacagtggctcatgcctgtaatcccagcactctgtgaggccaaggtgggcagatcactggagcccaggagttcaaaaccagcctggccaaaatggtaa

SEQ ID NO: 3589 - protein, 7 aa, homo sapiens [sequence omitted]

SEQ ID NO: 3590 - DNA, 24 bp, homo sapiens
atggtaaaaccccgtctctactaa

SEQ ID NO: 3591 - protein, 14 aa, homo sapiens
MPVIPATQEAEAGE

SEQ ID NO: 3592 - DNA, 45 bp, homo sapiens
atgcctgtaatcccagctactcaggaggctgaggcaggagaatga

SEQ ID NO: 3593 - protein, 69 aa, homo sapiens [sequence omitted]

SEQ ID NO: 3594 - DNA, 210 bp, homo sapiens
atgatgtggccaggacgaggaactgtagatggaggaggaggggaaagccaggccaatattttggatttttacaaaagggaaactttcatattaagtgctccctcctcacctccaagcccacaattcgtctccagcagcagacagggctgttacccagtctggggccacgcaggacccccagggcaggcctgccttgaccctgggagctga

SEQ ID NO: 3595 - protein, 21 aa, homo sapiens
MEEEGKARPIFWIFTKGKLSY

SEQ ID NO: 3596 - DNA, 66 bp, homo sapiens
atggaggaggaggggaaagccaggccaatattttggatttttacaaaagggaaactttcatattaa

SEQ ID NO: 3597 - protein, 21 aa, homo sapiens
MQGGASSVKQSCPWVHLTAKK

SEQ ID NO: 3598 - DNA, 66 bp, homo sapiens
atgcagggaggagcctcctctgttaaacagagctgtccctgggtccatttaacagccaaaaaatag

SEQ ID NO: 3599 - protein, 33 aa, homo sapiens
MLFSPAAYNFLLPKIWGTKFKLYYYHLAASNIY

SEQ ID NO: 3600 - DNA, 102 bp, homo sapiens
atgttgttttcaccagctgcctataacttcttattaccaaaaatttgggggacaaagtttaagctgtattactatcatttagcagcatccaacatttattga

SEQ ID NO: 3601 - protein, 30 aa, homo sapiens; identical to SEQ ID NO: 3545

SEQ ID NO: 3602 - DNA, 93 bp, homo sapiens; identical to SEQ ID NO: 3546

SEQ ID NO: 3603 - protein, 12 aa, homo sapiens
MIKLKECPKKEG

SEQ ID NO: 3604 - DNA, 39 bp, homo sapiens; identical to SEQ ID NO: 3548

SEQ ID NO: 3605 - protein, 87 aa, homo sapiens; identical to SEQ ID NO: 3549

SEQ ID NO: 3606 - DNA, 264 bp, homo sapiens; identical to SEQ ID NO: 3550

SEQ ID NO: 3607 - protein, 77 aa, homo sapiens; identical to SEQ ID NO: 3551

SEQ ID NO: 3608 - DNA, 234 bp, homo sapiens; identical to SEQ ID NO: 3552

SEQ ID NO: 3609 - protein, 13 aa, homo sapiens
MLPFLALFLFCFK

SEQ ID NO: 3610 - DNA, 42 bp, homo sapiens; identical to SEQ ID NO: 3282

SEQ ID NO: 3611 - protein, 42 aa, homo sapiens; identical to SEQ ID NO: 3283

SEQ ID NO: 3612 - DNA, 129 bp, homo sapiens; identical to SEQ ID NO: 3284

SEQ ID NO: 3613 - protein, 16 aa, homo sapiens
MIIVEEVLLLALKFLL

SEQ ID NO: 3614 - DNA, 51 bp, homo sapiens; identical to SEQ ID NO: 3286

SEQ ID NO: 3615 - protein, 7 aa, homo sapiens
MYTRTEL

SEQ ID NO: 3616 - DNA, 24 bp, homo sapiens
atgtataccaggactgagttgtag

SEQ ID NO: 3617 - protein, 4 aa, homo sapiens
MFIG

SEQ ID NO: 3618 - DNA, 15 bp, homo sapiens
atgttcattggatga

SEQ ID NO: 3619 - protein, 53 aa, homo sapiens
MSQASSPGALTSCVRHLAFHRSQHFQEYLPSGSGTVAHACIPSTLGAQGWMIT

SEQ ID NO: 3620 - DNA, 162 bp, homo sapiens
atgagccaagcatcaagtccaggagcactcacctcctgtgtgaggcatcttgcttttcacagatctcagcattttcaagaatatttaccttctgggtcaggcacagtggctcacgcctgtattcccagcactttgggagcccaaggctggatgatcacttga

SEQ ID NO: 3621 - protein, 4 aa, homo sapiens
MPSP

SEQ ID NO: 3622 - DNA, 15 bp, homo sapiens
atgccatctccttaa

SEQ ID NO: 3623 - protein, 6 aa, homo sapiens
MLFQYL

SEQ ID NO: 3624 - DNA, 21 bp, homo sapiens
atgctttttcagtacttatag

SEQ ID NO: 3625 - protein, 35 aa, homo sapiens
MGLNREPRNKPMHLWSIIIQHRCQDHTVGKRQFLQ

SEQ ID NO: 3626 - DNA, 108 bp, homo sapiens
atgggactgaatagagaacccagaaataaacctatgcatttatggtcaattattattcaacacagatgccaagatcacacagtgggaaaaagacagtttcttcaataa

SEQ ID NO: 3627 - protein, 35 aa, homo sapiens
MVNYYSTQMPRSHSGKKTVSSINYFSETKNPHVEE

SEQ ID NO: 3628 - DNA, 108 bp, homo sapiens
atggtcaattattattcaacacagatgccaagatcacacagtgggaaaaagacagtttcttcaataaattatttttcagaaactaaaaatccacatgtagaagaatga

SEQ ID NO: 3629 - protein, 17 aa, homo sapiens
MRPSFRTVPKNQHTHKN

SEQ ID NO: 3630 - DNA, 54 bp, homo sapiens
atgagaccctcatttcgtactgtacccaaaaatcaacacacacacaaaaattaa

SEQ ID NO: 3631 - protein, 20 aa, homo sapiens
MTLVWAKIFYMTLKAWITNT

SEQ ID NO: 3632 - DNA, 63 bp, homo sapiens
atgacattggtttgggcaaagattttttatatgactctgaaagcatggataacaaacacataa

SEQ ID NO: 3633 - protein, 90 aa, homo sapiens
MGGRESSESGVEEALVFEGVHVCWALTQGGCIGSQRESPSIWSCGLGDRALVQLPCHCHLPVPAALGRLEPPGFPAPPPSPQCHCHDGCE

SEQ ID NO: 3634 - DNA, 273 bp, homo sapiens
atgggtggccgcgagtcttctgaatctggagtggaggaagccctggtgtttgagggtgtgcatgtatgctgggcactcacccaaggaggctgcattgggagccagagggagtcgcctagtatctggtcttgtgggttgggggatcgtgccctagttcagctcccttgtcactgccatcttccagtgcctgctgccttgggccgccttgaacctccagggtttccagctcctcctccttcaccccagtgccactgccatgatggatgtgagtga

SEQ ID NO: 3635 - protein, 30 aa, homo sapiens
MYAGHSPKEAALGARGSRLVSGLVGWGIVP

SEQ ID NO: 3636 - DNA, 93 bp, homo sapiens
atgtatgctgggcactcacccaaggaggctgcattgggagccagagggagtcgcctagtatctggtcttgtgggttgggggatcgtgccctag

SEQ ID NO: 3637 - protein, 17 aa, homo sapiens
MLGTHPRRLHWEPEGVA

SEQ ID NO: 3638 - DNA, 54 bp, homo sapiens
atgctgggcactcacccaaggaggctgcattgggagccagagggagtcgcctag

SEQ ID NO: 3639 - protein, 61 aa, homo sapiens
MMDVSELGESARYLRQGYQEMTKVHTIPWDGKWRQRGRGHSHRDALMDSDQELGGVAPAQG

SEQ ID NO: 3640 - DNA, 186 bp, homo sapiens
atgatggatgtgagtgaacttggggagtctgcccgctacctccgccagggctaccaggagatgacgaaggtgcacactatcccatgggacggtaagtggagacagagggggaggggtcatagccacagagatgcccttatggactcagaccaggaattgggaggggtggcaccagctcagggctga

SEQ ID NO: 3641 - protein, 10 aa, homo sapiens
MKFLFNLANK

SEQ ID NO: 3642 - DNA, 33 bp, homo sapiens
atgaaatttttattcaacctggcaaataaatga

SEQ ID NO: 3643 - protein, 38 aa, homo sapiens
MMTFMFLSRIKCWKNEQLHLMTSFAIVFNQSDFGLSQA

SEQ ID NO: 3644 - DNA, 117 bp, homo sapiens
atgatgacattcatgttcttaagtagaataaaatgctggaaaaatgaacagctccaccttatgaccagttttgctatagtttttaaccagtcagattttggcttaagccaagcttaa

SEQ ID NO: 3645 - protein, 4 aa, homo sapiens
MLEK

SEQ ID NO: 3646 - DNA, 15 bp, homo sapiens
atgctggaaaaatga

SEQ ID NO: 3647 - protein, 6 aa, homo sapiens
MNSSTL

SEQ ID NO: 3648 - DNA, 21 bp, homo sapiens
atgaacagctccaccttatga

SEQ ID NO: 3649 - protein, 45 aa, homo sapiens [sequence omitted]

SEQ ID NO: 3650 - DNA, 138 bp, homo sapiens
atgagcaggatggtgtctgtatggccccagcaccaaaatgtgtttagcaagaagcgatgtgctgaatacccactcatagtaggtcctgcagtgggtgaagaagtcacaaagatgggcaataacaagcccctgccctga

SEQ ID NO: 3651 - protein, 8 aa, homo sapiens
MAPAPKCV

SEQ ID NO: 3652 - DNA, 27 bp, homo sapiens
atggccccagcaccaaaatgtgtttag

SEQ ID NO: 3653 - protein, 13 aa, homo sapiens
MCLARSDVLNTHS

SEQ ID NO: 3654 - DNA, 42 bp, homo sapiens
atgtgtttagcaagaagcgatgtgctgaatacccactcatag

SEQ ID NO: 3655 - protein, 9 aa, homo sapiens
MLSAGREDM

SEQ ID NO: 3656 - DNA, 30 bp, homo sapiens
atgctgtctgctgggagagaagacatgtag

SEQ ID NO: 3657 - protein, 8 aa, homo sapiens
MLSSITND

SEQ ID NO: 3658 - DNA, 27 bp, homo sapiens
atgctgagttccatcaccaacgattag

SEQ ID NO: 3659 - protein, 19 aa, homo sapiens
MIQKVWTRLRNMPSFPFFI

SEQ ID NO: 3660 - DNA, 60 bp, homo sapiens
atgattcagaaggtctggactaggctgaggaacatgccctcttttcccttttttatctaa

SEQ ID NO: 3661 - protein, 12 aa, homo sapiens
MYLCYLNQGEHR

SEQ ID NO: 3662 - DNA, 39 bp, homo sapiens
atgtatctctgctatctgaaccaaggtgagcacagataa

SEQ ID NO: 3663 - protein, 16 aa, homo sapiens
MFIVHYFLKVKFYLIF

SEQ ID NO: 3664 - DNA, 51 bp, homo sapiens
atgttcatagtacattactttttaaaagtcaagttctacttaattttctaa

SEQ ID NO: 3665 - protein, 42 aa, homo sapiens
MTQPGSASLSQIIAFLGTGGQPDAKRGIKVVSLRVEVSRSKM

SEQ ID NO: 3666 - DNA, 129 bp, homo sapiens
atgacacagccgggctctgcctctctatctcaaatcattgccttcttagggactgggggccaacctgatgcaaagagaggcataaaggtggtgagcctgagagttgaggtctcacgaagtaaaatgtga

SEQ ID NO: 3667 - protein, 5 aa, homo sapiens
MQREA

SEQ ID NO: 3668 - DNA, 18 bp, homo sapiens
atgcaaagagaggcataa

SEQ ID NO: 3669 - protein, 12 aa, homo sapiens
MRLPREHTANTA

SEQ ID NO: 3670 - DNA, 39 bp, homo sapiens
atgaggctgccaagagagcacactgctaacactgcctga

SEQ ID NO: 3671 - protein, 54 aa, homo sapiens [sequence omitted]

SEQ ID NO: 3672 - DNA, 165 bp, homo sapiens
atggatgggagcaggggggcagggacccaaaggagggaaatggctgtgggtggtgtgaaggccccccagccctcaggaaggtggggcaagagaccactgagcacaagggatcttgcccacctcctctttgactctgtggattatccatccatctgctcactgtga

SEQ ID NO: 3673 - protein, 37 aa, homo sapiens
MFQRRTASGPEPVTRATRLWNSRKNSTLTATSLAAGA

SEQ ID NO: 3674 - DNA, 114 bp, homo sapiens
atgttccagagacggacggcaagcggtcccgaaccagttacacgcgctaccagactctggaactcgagaaagaattccactttaaccgctacctcactcgccgcaggcgcatag

SEQ ID NO: 3675 - protein, 13 aa, homo sapiens
MRDRSRSGSRTAG

SEQ ID NO: 3676 - DNA, 42 bp, homo sapiens
atgagagacagatcaagatctggttccagaaccgcaggatga

SEQ ID NO: 3677 - protein, 15 aa, homo sapiens
MKWKKDSKMKSKEAL

SEQ ID NO: 3678 - DNA, 48 bp, homo sapiens
atgaagtggaagaaagattccaaaatgaaaagcaaagaggctctttag

SEQ ID NO: 3679 - protein, 103 aa, homo sapiens
MNDLHMKGEHRPRAPTVALCFPNLISTTSSPQNPGTSPACACCMPSQAGSPSLLASSTSGVSWHWTPASGPRGPLLSHSPCHEFLCPPDPLLLSNYLLTLGPS

SEQ ID NO: 3680 - DNA, 312 bp, homo sapiens
atgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctga

SEQ ID NO: 3681 - protein, 31 aa, homo sapiens
MGTFCPQSSSHSNCFVGLAKFQRERKQRHSP

SEQ ID NO: 3682 - DNA, 96 bp, homo sapiens
atgggcaccttctgtccccagtcctcttcccattcaaattgctttgtgggactggctaagtttcaaagggaaagaaaacaaaggcacagtccatag

SEQ ID NO: 3683 - protein, 70 aa, homo sapiens
MCVCVVCLWACMYVRGLSVFTRVFTRVCMCACGVCVHTRVSCMCMWSVCAYACVCTQVCGVGAVSPHSLL

SEQ ID NO: 3684 - DNA, 213 bp, homo sapiens
atgtgtgtctgcgtggtatgtttgtgggcatgcatgtacgtgcgtggcttgtctgtgttcacacgtgtgttcacacgtgtgtgcatgtgtgcctgtggggtgtgcgttcacacgcgcgtatcatgcatgtgcatgtggagtgtgtgcgcctatgcctgtgtgtgcacacaggtgtgtggggtgggagctgtctctccgcactctctcctttag

SEQ ID NO: 3685 - protein, 143 aa, homo sapiens
MFVGMHVRAWLVCVHTCVHTCVHVCLWGVRSHARIMHVHVECVRLCLCVHTGVWGGSCLSALSPLAFLTLCQDTLRSHSPGRTALRPYRIPQGANPGNPATPGVRTAVTWEGSAAFLPPPSSTSLHLASGLSMPALVPLSLVT

SEQ ID NO: 3686 - DNA, 432 bp, homo sapiens
atgtttgtgggcatgcatgtacgtgcgtggcttgtctgtgttcacacgtgtgttcacacgtgtgtgcatgtgtgcctgtggggtgtgcgttcacacgcgcgtatcatgcatgtgcatgtggagtgtgtgcgcctatgcctgtgtgtgcacacaggtgtgtggggtgggagctgtctctccgcactctctcctttagccttcctgactctctgccaggacaccctacgctcccactctccaggaagaacagcactgagaccctacagaataccccagggagcgaacccggggaatcctgccacccctggagtgaggacagctgtcacctgggagggcagtgctgcttttctcccccctccgtccagcaccagcctccacctggccagtggcctttctatgcctgcgctggttcctctttcactggtgacatga

SEQ ID NO: 3687 - protein, 190 aa, homo sapiens [sequence omitted]

SEQ ID NO: 3688 - DNA, 573 bp, homo sapiens
atgcctgtgtgtgcacacaggtgtgtggggtgggagctgtctctccgcactctctcctttagccttcctgactctctgccaggacaccctacgctcccactctccaggaagaacagcactgagaccctacagaataccccagggagcgaacccggggaatcctgccacccctggagtgaggacagctgtcacctgggagggcagtgctgcttttctcccccctccgtccagcaccagcctccacctggccagtggcctttctatgcctgcgctggttcctctttcactggtgacatgagggcgagtcaccagctccatctgggacaggcctcccagcgaactcctggccccttcccctcccaaccccctgccctggcaagctcagagcacagacatgagccaggtagggggggtctcagcctcactccatactgcccaccacggaactgcctggcaggaaagaggcctcggatgcccccagctctttacgagtctcgggccactagtgctgactctcacgggaaccctgggagactagaagagctgttatcaccaccagcatctgacaagtaa

SEQ ID NO: 3689 - protein, 62 aa, homo sapiens
MFLTVIQHCLSSTYALASHLSYINDNFVFFLHTLFPLSFFFFPNYFSLCLSYRDFFSLVILG

SEQ ID NO: 3690 - DNA, 189 bp, homo sapiens
atgtttcttactgtaatacaacactgcttgtcttccacatatgcattagcttctcatctctcatatattaatgataattttgtcttcttcctgcatactttatttcctctaagtttttttttttttcctaattatttcagtctctgtctttcatatagagatttcttcagtctggtgattcttggctag

SEQ ID NO: 3691 - protein, 13 aa, homo sapiens
MIILSSSCILYFL

SEQ ID NO: 3692 - DNA, 42 bp, homo sapiens
atgataattttgtcttcttcctgcatactttatttcctctaa

SEQ ID NO: 3693 - protein, 31 aa, homo sapiens
MGFQRVDLRLCAHDRGLSNVRFTAGRASWTT

SEQ ID NO: 3694 - DNA, 96 bp, homo sapiens
atggggttccaaagagtggatctaaggctctgtgctcatgataggggtttgtcaaatgttcgcttcactgctgggagagccagctggaccacttag

SEQ ID NO: 3695 - protein, 21 aa, homo sapiens
MIGVCQMFASLLGEPAGPLSQ

SEQ ID NO: 3696 - DNA, 66 bp, homo sapiens
atgataggggtttgtcaaatgttcgcttcactgctgggagagccagctggaccacttagtcagtga

SEQ ID NO: 3697 - protein, 8 aa, homo sapiens
MLSSITND

SEQ ID NO: 3698 - DNA, 27 bp, homo sapiens
atgctgagttccatcaccaacgattag

SEQ ID NO: 3699 - protein, 19 aa, homo sapiens
MIQKVWTRLRNMPSFPFFI

SEQ ID NO: 3700 - DNA, 60 bp, homo sapiens; identical to SEQ ID NO: 3660

SEQ ID NO: 3701 - protein, 12 aa, homo sapiens
MYLCYLNQGEHR

SEQ ID NO: 3702 - DNA, 39 bp, homo sapiens; identical to SEQ ID NO: 3662

SEQ ID NO: 3703 - protein, 16 aa, homo sapiens
MFIVHYFLKVKFYLIF

SEQ ID NO: 3704 - DNA, 51 bp, homo sapiens; identical to SEQ ID NO: 3664

SEQ ID NO: 3705 - protein, 5 aa, homo sapiens
MVSIS

SEQ ID NO: 3706 - DNA, 18 bp, homo sapiens
atggtctcgatctcctga

SEQ ID NO: 3707 - protein, 32 aa, homo sapiens
MSHCAQPRIHFLLTTHGTPTKTNHILGHKENV

SEQ ID NO: 3708 - DNA, 99 bp, homo sapiens
atgagccactgcgcccagccgagaattcactttcttttaactactcatggaacacctacaaaaactaaccatattttaggtcacaaagaaaatgtttaa

SEQ ID NO: 3709 - protein, 10 aa, homo sapiens
MEHLQKLTIF

SEQ ID NO: 3710 - DNA, 33 bp, homo sapiens
atggaacacctacaaaaactaaccatattttag

SEQ ID NO: 3711 - protein, 15 aa, homo sapiens
MFKNHKCNEFFKSQN

SEQ ID NO: 3712 - DNA, 48 bp, homo sapiens
atgtttaaaaatcacaaatgcaatgaattttttaaatcacaaaattag

SEQ ID NO: 3713 - protein, 13 aa, homo sapiens
MSVLVFIKLDNRK

SEQ ID NO: 3714 - DNA, 42 bp, homo sapiens
atgagtgtattggtcttcataaagctagataaccgaaagtaa

SEQ ID NO: 3715 - protein, 18 aa, homo sapiens
MKDYSRETVKTRKVRNTY

SEQ ID NO: 3716 - DNA, 57 bp, homo sapiens
atgaaagactacagccgagagacagtaaaaaccagaaaggtcaggaatacttattga

SEQ ID NO: 3717 - protein, 9 aa, homo sapiens
MIKGGMREN

SEQ ID NO: 3718 - DNA, 30 bp, homo sapiens
atgattaaaggtgggatgagagaaaattaa

SEQ ID NO: 3719 - protein, 5 aa, homo sapiens
MTHTC

SEQ ID NO: 3720 - DNA, 18 bp, homo sapiens
atgacacacacatgctaa

SEQ ID NO: 3721 - protein, 10 aa, homo sapiens
MFLNKCKNNF

SEQ ID NO: 3722 - DNA, 33 bp, homo sapiens; identical to SEQ ID NO: 3130

SEQ ID NO: 3723 - protein, 19 aa, homo sapiens
MLLKNSASINENYNLHTKN

SEQ ID NO: 3724 - DNA, 60 bp, homo sapiens; identical to SEQ ID NO: 3132

SEQ ID NO: 3725 - protein, 16 aa, homo sapiens
MKTIICILRIDVIIFR

SEQ ID NO: 3726 - DNA, 51 bp, homo sapiens; identical to SEQ ID NO: 3134

SEQ ID NO: 3727 - protein, 23 aa, homo sapiens
MLLKSYFLILQICRVNNEKCRTD

SEQ ID NO: 3728 - DNA, 72 bp, homo sapiens; identical to SEQ ID NO: 3136

SEQ ID NO: 3729 - protein, 103 aa, homo sapiens
MGLRAFRGARPCIGLPATALLSLRPPRRRPPAPPSGSWRGALPAATGARAGAFPRPRRPSPRARGGYGGRGSERGSVAILFRGDSRQRVGRMGEPCAGPRLSG

SEQ ID NO: 3730 - DNA, 312 bp, homo sapiens
atgggcttgcgcgctttccgcggcgcccgcccctgcatcggcctcccggcgaccgcgctgctttccctcaggccgccgcggcggcgcccgcccgcgcctccatccgggtcctggcgcggtgctctcccggcagcgacgggcgcgagggccggggcattcccacggccgcgacggccctctccgcgagcgcgaggtgggtatggcggacgcggcagcgagcgcgggtccgtcgccattttatttcgcggagactcgcggcagcgggtgggcagaatgggagagccgtgcgccggcccgcgcctgtccggctaa

SEQ ID NO: 3731 - protein, 136 aa, homo sapiens [sequence omitted]

SEQ ID NO: 3732 - DNA, 411 bp, homo sapiens; identical to SEQ ID NO: 2

SEQ ID NO: 3733 - protein, 5 aa, homo sapiens
MKEGR

SEQ ID NO: 3734 - DNA, 18 bp, homo sapiens
atgaaggagggaaggtag

SEQ ID NO: 3735 - protein, 13 aa, homo sapiens
MPLLPAAKCSLPS

SEQ ID NO: 3736 - DNA, 42 bp, homo sapiens; identical to SEQ ID NO: 8

SEQ ID NO: 3737 - protein, 34 aa, homo sapiens
MGPLIQGFHRPAGADGVRDLTMAPARSCCVLSEA

SEQ ID NO: 3738 - DNA, 105 bp, homo sapiens
atgggacccttgatacaaggctttcatagaccagccggtgctgatggggtccgggacttgacgatggcgcctgctcgttcctgttgtgttctatctgaggcatga

SEQ ID NO: 3739 - protein, 5 aa, homo sapiens
MGSGT

SEQ ID NO: 3740 - DNA, 18 bp, homo sapiens
atggggtccgggacttga

SEQ ID NO: 3741 - protein, 20 aa, homo sapiens
MIFFRFWEVESTGQRLHLTH

SEQ ID NO: 3742 - DNA, 63 bp, homo sapiens
atgattttctttcgtttttgggaggtagagagcacggggcagaggttgcacctgacacattag

SEQ ID NO: 3743 - protein, 23 aa, homo sapiens
MGVTVPPCLPLLYLDKDLLYPDF

SEQ ID NO: 3744 - DNA, 72 bp, homo sapiens
atgggggttactgtgcccccctgtctacccctgctttatcttgataaggacttgctttatcctgatttctaa

SEQ ID NO: 3745 - protein, 63 aa, homo sapiens [sequence omitted]

SEQ ID NO: 3746 - DNA, 192 bp, homo sapiens
atgcccggcaccgtggctgctcccctgtcctttcttatcgaaggccagctgctgctgggtcctggtgtcgtggactcagccctggatctgagtcagggcactgggctcccatcctggctgggccgtagaatcactggtgggcacttgaataagccccttcctctctccgggtctcagtttacccatctgtaa

SEQ ID NO: 3747 - protein, 21 aa, homo sapiens
MKSSIYFLSSLQCRERKTKRK

SEQ ID NO: 3748 - DNA, 66 bp, homo sapiens
atgaaaagctccatctatttcttgagttccttgcaatgccgagaaagaaagacaaagagaaaatga

SEQ ID NO: 3749 - protein, 65 aa, homo sapiens [sequence omitted]

SEQ ID NO: 3750 - DNA, 198 bp, homo sapiens
atgccgagaaagaaagacaaagagaaaatgaagccacagtacactgttgctgccgggttctcagaactgggatttttgtttgctttcaaagagggttttttttttctagggaaagagtcatggaatttgaccagagatgattgtttgaggggccaagagccagccagagcccacggacatgcagcatggaaggtgtag

SEQ ID NO: 3751 - protein, 6 aa, homo sapiens
MEFDQR

SEQ ID NO: 3752 - DNA, 21 bp, homo sapiens
atggaatttgaccagagatga

SEQ ID NO: 3753 - protein, 63 aa, homo sapiens [sequence omitted]

SEQ ID NO: 3754 - DNA, 192 bp, homo sapiens; identical to SEQ ID NO: 3746

SEQ ID NO: 3755 - protein, 21 aa, homo sapiens
MKSSIYFLSSLQCRERKTKRK

SEQ ID NO: 3756 - DNA, 66 bp, homo sapiens; identical to SEQ ID NO: 3748

SEQ ID NO: 3757 - protein, 65 aa, homo sapiens [sequence omitted]

SEQ ID NO: 3758 - DNA, 198 bp, homo sapiens; identical to SEQ ID NO: 3750

SEQ ID NO: 3759 - protein, 6 aa, homo sapiens
MEFDQR

SEQ ID NO: 3760 - DNA, 21 bp, homo sapiens
atggaatttgaccagagatga

SEQ ID NO: 3761 - protein, 26 aa, homo sapiens
MHLLCPCCRKEPADWPLSAAHSTGWL

SEQ ID NO: 3762 - DNA, 81 bp, homo sapiens
atgcacctattgtgtccctgctgcagaaaggagcctgccgattggccactgtctgcagcacatagcactggctggttataa

SEQ ID NO: 3763 - protein, 50 aa, homo sapiens
MTAFFLQGGWRESGEGGGVSSTVKAAQIFFLSLSLPLHRLFLFHALSHFA

SEQ ID NO: 3764 - DNA, 153 bp, homo sapiens
atgactgcattctttttgcaaggggggtggagggagagcggggaaggagggggtgtcagctcaactgtaaaagctgcacagattttttttctttctctctctctgcctctccatagattgtttctgtttcatgccctgtctcatttcgcatag

SEQ ID NO: 3765 - protein, 8 aa, homo sapiens
MPCLISHS

SEQ ID NO: 3766 - DNA, 27 bp, homo sapiens
atgccctgtctcatttcgcatagctaa

SEQ ID NO: 3767 - protein, 24 aa, homo sapiens
MLIKIPCLNLKNNDSAVIRNLVRV

SEQ ID NO: 3768 - DNA, 75 bp, homo sapiens
atgctaattaagatcccttgtcttaacctgaaaaataatgactcggctgtaattagaaatctggtgagagtttaa

SEQ ID NO: 3769 - protein, 25 aa, homo sapiens
MVCERISVCLGRKLFDLQKSQKTSR

SEQ ID NO: 3770 - DNA, 78 bp, homo sapiens
atggtttgtgaaagaatatctgtgtgcttagggaggaaactttttgatctgcagaaaagccagaagacatctaggtaa

SEQ ID NO: 3771 - protein, 24 aa, homo sapiens
MFTFVEVQNVLTIVCLFFVCLFKS

SEQ ID NO: 3772 - DNA, 75 bp, homo sapiens
atgttcacttttgtagaagttcaaaatgtactgacgattgtttgcttattttttgtttgtttgtttaaatcttaa

SEQ ID NO: 3773 - protein, 7 aa, homo sapiens
MLLWKEY

SEQ ID NO: 3774 - DNA, 24 bp, homo sapiens
atgttgctttggaaggaatattaa

SEQ ID NO: 3775 - protein, 6 aa, homo sapiens
MRPLCT

SEQ ID NO: 3776 - DNA, 21 bp, homo sapiens
atgaggcccctttgcacatga

SEQ ID NO: 3777 - protein, 17 aa, homo sapiens
MLLLDSSCLIFLLLWLF

SEQ ID NO: 3778 - DNA, 54 bp, homo sapiens
atgctcctcctagacagcagttgtctgatatttctccttttgtggttgttttag

SEQ ID NO: 3779 - protein, 42 aa, homo sapiens [sequence omitted]

SEQ ID NO: 3780 - DNA, 129 bp, homo sapiens
atggatatgaaaagtgaagaaagtgatcataggagaaaaccatttcaggtaaaaataaaaaacaaagagcaaataagatttactgtttttaaagaaaaacaacattcttttgactgtgttttgttataa

SEQ ID NO: 3781 - protein, 13 aa, homo sapiens
MSVTVEILLMVFI

SEQ ID NO: 3782 - DNA, 42 bp, homo sapiens
atgagtgtaactgttgaaattttattgatggttttcatttga

SEQ ID NO: 3783 - protein, 57 aa, homo sapiens
MCAMTYLCEKFLVVNWAVCVPLNICLCIHTLKIGAIRFTRKLYRKRKKLYFLICCTI

SEQ ID NO: 3784 - DNA, 174 bp, homo sapiens
atgtgtgctatgacctacctttgtgaaaaatttcttgtggtcaattgggcagtttgtgtcccattgaatatatgtctgtgtatccatacgcttaagataggtgcaatacggtttactagaaagctttataggaaaagaaaaaaattatattttcttatttgttgtaccatataa

SEQ ID NO: 3785 - protein, 103 aa, homo sapiens; identical to SEQ ID NO: 3729

SEQ ID NO: 3786 - DNA, 312 bp, homo sapiens; identical to SEQ ID NO: 3730

SEQ ID NO: 3787 - protein, 136 aa, homo sapiens [sequence omitted]

SEQ ID NO: 3788 - DNA, 411 bp, homo sapiens; identical to SEQ ID NO: 2

SEQ ID NO: 3789 - protein, 5 aa, homo sapiens
MKEGR

SEQ ID NO: 3790 - DNA, 18 bp, homo sapiens
atgaaggagggaaggtag

SEQ ID NO: 3791 - protein, 13 aa, homo sapiens
MPLLPAAKCSLPS

SEQ ID NO: 3792 - DNA, 42 bp, homo sapiens; identical to SEQ ID NO: 8

SEQ ID NO: 3793 - protein, 301 aa, homo sapiens; identical to SEQ ID NO: 33

SEQ ID NO: 3794 - DNA, 906 bp, homo sapiens; identical to SEQ ID NO: 34

SEQ ID NO: 3795 - protein, 41 aa, homo sapiens; identical to SEQ ID NO: 35

SEQ ID NO: 3796 - DNA, 126 bp, homo sapiens; identical to SEQ ID NO: 36

SEQ ID NO: 3797 - protein, 50 aa, homo sapiens [sequence omitted]

SEQ ID NO: 3798 - DNA, 153 bp, homo sapiens; identical to SEQ ID NO: 38

SEQ ID NO: 3799 - protein, 13 aa, homo sapiens
MGAGAGRIVAGRD

SEQ ID NO: 3800 - DNA, 42 bp, homo sapiens; identical to SEQ ID NO: 40

SEQ ID NO: 3801 - protein, 103 aa, homo sapiens; identical to SEQ ID NO: 3729

SEQ ID NO: 3802 - DNA, 312 bp, homo sapiens; identical to SEQ ID NO: 3730

SEQ ID NO: 3803 - protein, 136 aa, homo sapiens [sequence omitted]

SEQ ID NO: 3804 - DNA, 411 bp, homo sapiens; identical to SEQ ID NO: 2

SEQ ID NO: 3805 - protein, 5 aa, homo sapiens
MKEGR

SEQ ID NO: 3806 - DNA, 18 bp, homo sapiens
atgaaggagggaaggtag

SEQ ID NO: 3807 - protein, 13 aa, homo sapiens
MPLLPAAKCSLPS

SEQ ID NO: 3808 - DNA, 42 bp, homo sapiens; identical to SEQ ID NO: 8

SEQ ID NO: 3809 - protein, 59 aa, homo sapiens [sequence omitted]

SEQ ID NO: 3810 - DNA, 180 bp, homo sapiens
atgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctag

SEQ ID NO: 3811 - protein, 9 aa, homo sapiens
MDSQETSGK

SEQ ID NO: 3812 - DNA, 30 bp, homo sapiens
atggatagccaagagaccagtggaaagtga

SEQ ID NO: 3813 - protein, 7 aa, homo sapiens
MQKGCVV

SEQ ID NO: 3814 - DNA, 24 bp, homo sapiens
atgcagaaaggatgtgtggtataa

SEQ ID NO: 3815 - protein, 14 aa, homo sapiens
MCGIMERADMGSDF

SEQ ID NO: 3816 - DNA, 45 bp, homo sapiens
atgtgtggtataatggaaagagcagatatgggttcagatttttaa

SEQ ID NO: 3817 - protein, 54 aa, homo sapiens
MKLTDSVLRSFRVAKVFRENSDKINCFDFSPNGETVISSSDDDSIVLYDCQEGK

SEQ ID NO: 3818 - DNA, 165 bp, homo sapiens
atgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaagtga

SEQ ID NO: 3819 - protein, 69 aa, homo sapiens
MTARRASECGGGPGPESQCLPPVAQHRSLGLPSVPTSAPSLFCTRSCQGRLHPAAVQETFYFFLLKKKR

SEQ ID NO: 3820 - DNA, 210 bp, homo sapiens
atgactgccaggagggcaagtgagtgcggcggaggccctgggcccgagtctcagtgcctccctccggtggcccagcacaggtccctcggcctgccctccgtcccgacttcagcccccagcctattttgcacgcgttcctgccagggccgcctccaccccgcagccgtccaggagaccttttatttttttcttcttaaaaaaaaaagataa

SEQ ID NO: 3821 - protein, 21 aa, homo sapiens
MSSVSFERYASLAKPHLDLDL

SEQ ID NO: 3822 - DNA, 66 bp, homo sapiens
atgtcttcggtctcctttgagcgctatgcatcacttgccaaaccccaccttgaccttgacctttaa

SEQ ID NO: 3823 - protein, 106 aa, homo sapiens
MHHLPNPTLTLTFKRPVRPPWAHQVAFSAPQAVKGAGLLRPRRRTAGAAFLPPSAASALSCALSTVTSIPPWHSAHPLPLSFPRPFCRQTAWVALLSCQDLFVVPL

SEQ ID NO: 3824 - DNA, 321 bp, homo sapiens
atgcatcacttgccaaaccccaccttgaccttgacctttaaacgcccggtccgcccaccctgggcccaccaggtagcgttttcagctcctcaggctgtcaaaggtgctggtctgctccggcctcgacgcaggactgcaggggctgcttttctgcctccttcggcagcgtcagctctctcttgtgctctctccactgtgacctcgattccgccctggcactccgcccatcccctgcccctcagcttcccgcggcctttctgccgtcagaccgcgtgggttgcacttcttagctgtcaggatttatttgttgtgcccctttga

SEQ ID NO: 3825 - protein, 25 aa, homo sapiens
MAARGAAWRGGHVVRSSARASLSDL

SEQ ID NO: 3826 - DNA, 78 bp, homo sapiens
atggcggcgcggggggcggcctggcggggcggtcacgtggtgaggagtagcgcgcgagcctccttaagtgatctctaa

SEQ ID NO: 3827 - protein, 70 aa, homo sapiens [sequence omitted]

SEQ ID NO: 3828 - DNA, 213 bp, homo sapiens
atgccttggctgctgtttggcggagccggcggcagcctctgcgggatgcccgccggcgattatcggcgccgagagcgggccggcggcgggttcgacagcgcggcgcgggtgggggcccgggtaccggactcggccgcagcccagcccccaccggggactcggagcagggaggggcgcgagcggcgcagctcgggacgtggcggcagctcctag

SEQ ID NO: 3829 - protein, 80 aa, homo sapiens [sequence omitted]

SEQ ID NO: 3830 - DNA, 243 bp, homo sapiens
atggccctggctgaggtagtagtttgtgctgttggtcgggttgtgacattgcccgctgtggagataactgcgcaagctactgccttgctagtgctggtgatgctcagcgccgcggaggacaatggctgggaatcccctttgttttccggggcgctgcctggggacagcccgcgaagcctcggcgcccggccggcgcggccaccacggaaaccgttagtttcacattttcctagaaggaattga

SEQ ID NO: 3831 - protein, 31 aa, homo sapiens
MAGNPLCFPGRCLGTAREASAPGRRGHHGNR

SEQ ID NO: 3832 - DNA, 96 bp, homo sapiens
atggctgggaatcccctttgttttccggggcgctgcctggggacagcccgcgaagcctcggcgcccggccggcgcggccaccacggaaaccgttag

SEQ ID NO: 3833 - protein, 34 aa, homo sapiens; identical to SEQ ID NO: 3737

SEQ ID NO: 3834 - DNA, 105 bp, homo sapiens; identical to SEQ ID NO: 3738

SEQ ID NO: 3835 - protein, 5 aa, homo sapiens
MGSGT

SEQ ID NO: 3836 - DNA, 18 bp, homo sapiens
atggggtccgggacttga

SEQ ID NO: 3837 - protein, 20 aa, homo sapiens
MIFFRFWEVESTGQRLHLTH

SEQ ID NO: 3838 - DNA, 63 bp, homo sapiens; identical to SEQ ID NO: 3742

SEQ ID NO: 3839 - protein, 23 aa, homo sapiens
MGVTVPPCLPLLYLDKDLLYPDF

SEQ ID NO: 3840 - DNA, 72 bp, homo sapiens; identical to SEQ ID NO: 3744

SEQ ID NO: 3841 - protein, 24 aa, homo sapiens
MTQASRGRGAHAARPSPHRHSSMV

SEQ ID NO: 3842 - DNA, 75 bp, homo sapiens
atgacgcaggcctctcgggggcggggagcacatgcagcccgtccctctccacatcgtcactcttctatggtttag

SEQ ID NO: 3843 - protein, 76 aa, homo sapiens
MQPVPLHIVTLLWFRSFSRTLLPGSELAQAVTSSCRTFYLSISVLGFETRGCLLTLLCNKFGIICHSEGFVIFYPF

SEQ ID NO: 3844 - DNA, 231 bp, homo sapiens
atgcagcccgtccctctccacatcgtcactcttctatggtttagaagtttcagtcgcacactcctacccgggtcggagttagctcaagcggttacctcctcatgccggactttctatctgtccatctctgtgctggggttcgagacccgcgggtgcttactgacccttttatgcaataaattcggtataatctgtcactctgaaggctttgttattttttatcccttttaa

SEQ ID NO: 3845 - protein, 25 aa, homo sapiens
MPDFLSVHLCAGVRDPRVLTDPFMQ

SEQ ID NO: 3846 - DNA, 78 bp, homo sapiens
atgccggactttctatctgtccatctctgtgctggggttcgagacccgcgggtgcttactgacccttttatgcaataa

SEQ ID NO: 3847 - protein, 59 aa, homo sapiens
MEAGHWSYRACVTSLYCQVGRMGTKKCLCSSRDTPGSSETPQLRTAECVMDFVPSRTEV

SEQ ID NO: 3848 - DNA, 180 bp, homo sapiens
atggaggctggccactggtcttacagggcgtgcgtgaccagcctgtactgccaggtaggacgcatggggacaaaaaaatgcttgtgcagttcacgagacacacctggaagctccgagaccccacaacttcggaccgcggagtgcgttatggatttcgtcccaagtaggacggaagtttaa

SEQ ID NO: 3849 - protein, 11 aa, homo sapiens
MRPGSFFFFFF

SEQ ID NO: 3850 - DNA, 36 bp, homo sapiens
atgagacccggaagttttttttttttttttttttaa

SEQ ID NO: 3851 - protein, 5 aa, homo sapiens
MAEIE

SEQ ID NO: 3852 - DNA, 18 bp, homo sapiens
atggcagagatagaataa

SEQ ID NO: 3853 - protein, 13 aa, homo sapiens
MATVTLWRALLRH

SEQ ID NO: 3854 - DNA, 42 bp, homo sapiens
atggcgacggtcacgttgtggcgagccttgctgcgtcattag

SEQ ID NO: 3855 - protein, 140 aa, homo sapiens
MQIAGRTKEGEPGTPGGAGGCGGGGRARGRRGARGRAPAGGGLRGACGRARLGAQSVDVRVRARAPPWSAGCCAPGPVSRRVGAGLGTREAVGRTERLRRGWPRRTRTRSRGARPARHPHWGLGAGQAAPGAEGAPLPSA

SEQ ID NO: 3856 - DNA, 423 bp, homo sapiens
atgcaaatagcgggaagaacaaaggaaggggagcccgggacccccgggggcgcaggtgggtgtgggggcggcggccgggcgcgggggcggcggggcgcgcggggccgagcgcccgcgggaggcgggctgcgtggggcgtgcggccgcgcgaggctcggggcgcagagtgtggacgtccgagtgcgcgcccgtgcgccgccgtggagcgctggctgctgcgctcccggccccgtctcgcggcgcgtcggagccggcctggggacgcgggaagccgtggggcgcacagagcggctccggcgaggctggccgcggcgcacacgcacacgcagccgtggggctcggcccgctaggcatccgcactggggtctgggggcgggccaggcggcgccgggggccgagggcgcgccactgcccagcgcctag

SEQ ID NO: 3857 - protein, 64 aa, homo sapiens [sequence omitted]

SEQ ID NO: 3858 - DNA, 195 bp, homo sapiens
atggcgactcaggcgcactccctcagctacgcagggtgcaacttcttgcgccaacgtctggtcctgtctaccctgagcgggcgccccgtcaaaatccgaaagattcgggccagagacgacaacccgggcctccgaggtaacttggtgtgggcggcgcgcggcgtgggcgcgggggctgaggggagaccgagctga

SEQ ID NO: 3859 - protein, 145 aa, homo sapiens [sequence omitted]

SEQ ID NO: 3860 - DNA, 438 bp, homo sapiens
atgccgtgggggcccgcgcggtgttggttgggcggctcggcgtccggcgagcgcgtcggggagggcaggtggcgcgtcgcctccaaagccggaggggcaggcacagtgggggaggcggggtcggggcccgaggggagcgctcagctgcaagctgcgctcggcgtctccggggcgctggtagtaaacagctgcacgttttccagctttacgtgtagcaacaaatccctggcgtcgccccttcgcgtcccttcggcccctcttgccctcgccataaacctctcaaaggagaaaaacagtttgttggaccgaaatatggtgaatgagccgggggagagacattgggagagaaaagtaccttgggttggttctctgccctgtctcaaagcagttctcagaagcagctgcccccttggacaccggctgttcctgtcgccatga

SEQ ID NO: 3861 - protein, 52 aa, homo sapiens
MSRGRDIGREKYLGLVLCPVSKQFSEAAAPLDTGCSCRHDFSAALTLVLGCG

SEQ ID NO: 3862 - DNA, 159 bp, homo sapiens
atgagccgggggagagacattgggagagaaaagtaccttgggttggttctctgccctgtctcaaagcagttctcagaagcagctgcccccttggacaccggctgttcctgtcgccatgatttctcggctgccctcacacttgtccttgggtgtggataa

SEQ ID NO: 3863 - protein, 39 aa, homo sapiens [sequence omitted]

SEQ ID NO: 3864 - DNA, 120 bp, homo sapiens
atgatttctcggctgccctcacacttgtccttgggtgtggataaagaaatttttaaaattctgtgtttgttttcagccgtgactgtgattgatgtgcgcaggacaggagctttgagatag

SEQ ID NO: 3865 - protein, 15 aa, homo sapiens
MLFLHFFSSKYIAIS

SEQ ID NO: 3866 - DNA, 48 bp, homo sapiens
atgttatttctccatttttttagttccaaatatatagccatctcttga

SEQ ID NO: 3867 - protein, 17 aa, homo sapiens
MCGWGMPASVIKSSFRQ

SEQ ID NO: 3868 - DNA, 54 bp, homo sapiens
atgtgtggttggggaatgccagcttctgttataaagtctagttttaggcaataa

SEQ ID NO: 3869 - protein, 10 aa, homo sapiens
MRKTFLYIYK

SEQ ID NO: 3870 - DNA, 33 bp, homo sapiens
atgagaaaaacctttttatatatttataaatag

SEQ ID NO: 3871 - protein, 4 aa, homo sapiens
MFFH

SEQ ID NO: 3872 - DNA, 15 bp, homo sapiens
atgttctttcactga

SEQ ID NO: 3873 - protein, 77 aa, homo sapiens
MHRGPSSEAPQLPQIASEWSQREEGWVLVTPARRRPMVTEMGVLGKSGSDLSRSRREGGMNSSRGLSWLFGHSQISP

SEQ ID NO: 3874 - DNA, 234 bp, homo sapiens
atgcatcgcggcccctcctccgaggcccctcagcttccgcagatcgcctcagagtggtcccagcgagaagagggctgggtcttagtcacgccagcgaggaggcgaccaatggtgactgagatgggcgtgctggggaagtcgggctcagacctcagcaggtcgcggagagaagggggaatgaactcttcgagaggactgtcatggctgttcggccattctcagatttccccttga

SEQ ID NO: 3875 - protein, 36 aa, homo sapiens
MAVRPFSDFPLRQESWSSGHGKRYNQGSRAVLKIDP

SEQ ID NO: 3876 - DNA, 111 bp, homo sapiens
atggctgttcggccattctcagatttccccttgagacaggaaagctggtcgtcaggccatggaaagcgctacaatcagggctctagagctgtgcttaagatagacccttga

SEQ ID NO: 3877 - protein, 14 aa, homo sapiens
MESATIRALELCLR

SEQ ID NO: 3878 - DNA, 45 bp, homo sapiens
atggaaagcgctacaatcagggctctagagctgtgcttaagatag

SEQ ID NO: 3879 - protein, 5 aa, homo sapiens
MLGSE

SEQ ID NO: 3880 - DNA, 18 bp, homo sapiens
atgttagggtcggaatga

SEQ ID NO: 3881 - protein, 30 aa, homo sapiens
MFGLSRLLSACVGERGTRRNERTGACLHGN

SEQ ID NO: 3882 - DNA, 93 bp, homo sapiens
atgtttgggctaagccgcctcctttccgcctgcgttggagagagaggtaccagaaggaatgaaaggactggggcttgtctccatggcaactga

SEQ ID NO: 3883 - protein, 35 aa, homo sapiens
MKGLGLVSMATERKRWVINPSPPSCGEGGEVGAGK

SEQ ID NO: 3884 - DNA, 108 bp, homo sapiens
atgaaaggactggggcttgtctccatggcaactgaaagaaagaggtgggttataaatccttcgccaccctcctgtggcgaaggaggggaagtgggagccgggaagtag

SEQ ID NO: 3885 - protein, 5 aa, homo sapiens
MHWGP

SEQ ID NO: 3886 - DNA, 18 bp, homo sapiens
atgcattgggggccatag

SEQ ID NO: 3887 - protein, 24 aa, homo sapiens
MDFFFNHLPFSFGEKNWSPPGLRP

SEQ ID NO: 3888 - DNA, 75 bp, homo sapiens
atggattttttttttaatcatcttcctttctcttttggagagaaaaattggtcacctccaggactgagaccctga

SEQ ID NO: 3889 - protein, 13 aa, homo sapiens
MFLLPPPPSSGLL

SEQ ID NO: 3890 - DNA, 42 bp, homo sapiens
atgttccttcttccccctcccccaagctcaggtctcctttag

SEQ ID NO: 3891 - protein, 29 aa, homo sapiens
MLCSCDAILGSPVGLVEAQRRHLSRETLG

SEQ ID NO: 3892 - DNA, 90 bp, homo sapiens
atgctctgcagctgtgatgctatcctgggttccccagtggggctggtggaagcccagaggcggcatctgagcagggagacactggggtaa

SEQ ID NO: 3893 - protein, 17 aa, homo sapiens
MLSWVPQWGWWKPRGGI

SEQ ID NO: 3894 - DNA, 54 bp, homo sapiens
atgctatcctgggttccccagtggggctggtggaagcccagaggcggcatctga

SEQ ID NO: 3895 - protein, 11 aa, homo sapiens
MWYMRDLLHCQ

SEQ ID NO: 3896 - DNA, 36 bp, homo sapiens
atgtggtatatgcgtgatttgcttcattgtcagtga

SEQ ID NO: 3897 - protein, 13 aa, homo sapiens
MFLLPPPPSSGLL

SEQ ID NO: 3898 - DNA, 42 bp, homo sapiens; identical to SEQ ID NO: 3890

SEQ ID NO: 3899 - protein, 29 aa, homo sapiens
MLCSCDAILGSPVGLVEAQRRHLSRETLG

SEQ ID NO: 3900 - DNA, 90 bp, homo sapiens; identical to SEQ ID NO: 3892

SEQ ID NO: 3901 - protein, 17 aa, homo sapiens
MLSWVPQWGWWKPRGGI

SEQ ID NO: 3902 - DNA, 54 bp, homo sapiens; identical to SEQ ID NO: 3894

SEQ ID NO: 3903 - protein, 11 aa, homo sapiens
MWYMRDLLHCQ

SEQ ID NO: 3904 - DNA, 36 bp, homo sapiens; identical to SEQ ID NO: 3896

SEQ ID NO: 3905 - protein, 5 aa, homo sapiens
MGGGE

SEQ ID NO: 3906 - DNA, 18 bp, homo sapiens
atggggggtggcgaatag

SEQ ID NO: 3907 - protein, 7 aa, homo sapiens
MSCLMNC

SEQ ID NO: 3908 - DNA, 24 bp, homo sapiens
atgtcttgtttaatgaactgctaa

SEQ ID NO: 3909 - protein, 15 aa, homo sapiens
MSLLGSYFYLFPLIG

SEQ ID NO: 3910 - DNA, 48 bp, homo sapiens
atgtcactcttggggagttacttctacttgttccctttaataggatga

SEQ ID NO: 3911 - protein, 16 aa, homo sapiens
MISSFPTFFCLSNQDT

SEQ ID NO: 3912 - DNA, 51 bp, homo sapiens
atgatttcatcttttccaaccttcttctgtctctccaaccaagacacatag

SEQ ID NO: 3913 - protein, 89 aa, homo sapiens
MSGSPLEDRMKNWEIMAVLESRQEDGESRACPALRPRNKRTRVRWPFKSDSPPPAPARTAGNPAPALPRPEIPFRRPHRLPVTHSRPAR

SEQ ID NO: 3914 - DNA, 270 bp, homo sapiens
atgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtga

SEQ ID NO: 3915 - protein, 32 aa, homo sapiens [sequence omitted]

SEQ ID NO: 3916 - DNA, 99 bp, homo sapiens
atggcactgaaggactacgcgctagagaagggtacgggtctacgagcccgggagggcgtcctgcgcggggagcctcccggggaacacctgttggtgtga

SEQ ID NO: 3917 - protein, 5 aa, homo sapiens
MLKKS

SEQ ID NO: 3918 - DNA, 18 bp, homo sapiens
atgttgaagaaaagctag

SEQ ID NO: 3919 - protein, 17 aa, homo sapiens
MANGWTGSRPGRRNPEL

SEQ ID NO: 3920 - DNA, 54 bp, homo sapiens
atggccaatggctggactggctcccgccctgggcggaggaatcccgagctgtga

SEQ ID NO: 3921 - protein, 13 aa, homo sapiens
MTLQRYLAHWGQD

SEQ ID NO: 3922 - DNA, 42 bp, homo sapiens
atgaccttgcaaaggtatcttgctcactggggacaggattag

SEQ ID NO: 3923 - protein, 258 aa, homo sapiens [sequence omitted]

SEQ ID NO: 3924 - DNA, 777 bp, homo sapiens
atgttgaaactcgtcggtggcggtggcgggcaggactgggcatgctcagtggcggggaccagtctgggaggcgaggaagccgcgtttgaagtcgcgcggcctggggatcaggggaaggcgggcggcgggagccccggctgggggtgcgcggggatccccgattccgcgcccggggctggcgtgctccaggccggcgccgtggggccggcgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgcgtaagtcccgctgggaggggagcgcgggcgcaaggcagacgcagcgtgcggggcccgggactgggagcggctga

SEQ ID NO: 3925 - protein, 15 aa, homo sapiens
MLSGGDQSGRRGSRV

SEQ ID NO: 3926 - DNA, 48 bp, homo sapiens
atgctcagtggcggggaccagtctgggaggcgaggaagccgcgtttga

SEQ ID NO: 3927 - protein, 7 aa, homo sapiens
MTSSEAA

SEQ ID NO: 3928 - DNA, 24 bp, homo sapiens
atgacctccagcgaggccgcctga

SEQ ID NO: 3929 - protein, 78 aa, homo sapiens
MIPSGLGTPGRRRVAGRGEVTLATCGCQEKAAGKPRKDPGAQGRWLSSRAAPALILLLCVLLFVSFWAVKGRGSLPLR

SEQ ID NO: 3930 - DNA, 237 bp, homo sapiens
atgattcctagcggactgggcacgcctggacggcggagggtggctgggaggggcgaggtcacgctagcaacctgtggctgccaggagaaggcggctgggaagccacggaaagacccgggagcgcaggggaggtggctcagctcgcgcgcagcccctgctcttattttactattatgcgtgttgctgttcgtatccttctgggcggtgaaggggagaggcagcctcccgctccggtga

SEQ ID NO: 3931 - protein, 53 aa, homo sapiens
MRVAVRILLGGEGERQPPAPVKPVLGVAHKPCSPSQAAGGVRGVRRLGGIGRW

SEQ ID NO: 3932 - DNA, 162 bp, homo sapiens
atgcgtgttgctgttcgtatccttctgggcggtgaaggggagaggcagcctcccgctccggtgaaacccgtcctgggagtcgcccataaaccctgttctccatctcaggcggctggaggggtgaggggggtgcggcgccttggtgggattggcaggtggtga

SEQ ID NO: 3933 - protein, 13 aa, homo sapiens
MPTGWTGFRELAS

SEQ ID NO: 3934 - DNA, 42 bp, homo sapiens
atgccgacgggttggacgggtttccgagagctggcgagttga

SEQ ID NO: 3935 - protein, 16 aa, homo sapiens
MGWGRGLDRWSGSWRP

SEQ ID NO: 3936 - DNA, 51 bp, homo sapiens
atggggtgggggaggggcctggaccgttggagtgggtcctggagaccctaa

SEQ ID NO: 3937 - protein, 110 aa, homo sapiens
MSGSLRPRVSAAGQRLVDYSRRPDRPPPVARQPSGKNRPLPAPQHATKKPGAPTPLGSSVRLLPYISRGSGGSLSKPLPPITSFLGRPLGPGVESGWVQKSKGAVLFQKF

SEQ ID NO: 3938 - DNA, 333 bp, homo sapiens
atgagcgggtctctgcgtccgagagtgagcgcagccgggcagcgcctagtggattacagcagacgcccggaccgaccgccgcctgtagctcggcagccttcgggtaagaatcgccccctccccgctccccagcatgccaccaagaagcctggggcgccgacccccttgggcagctcagtccggctgctcccctacatttcccggggaagtggggggtcgctgtctaagccccttcccccaatcacttcgttcctagggcgtcccctggggcctggggtggagtccggctgggttcagaagtctaagggggcagtattatttcaaaaattctga

SEQ ID NO: 3939 - protein, 40 aa, homo sapiens
MPPRSLGRRPPWAAQSGCSPTFPGEVGGRCLSPFPQSLRS

SEQ ID NO: 3940 - DNA, 123 bp, homo sapiens
atgccaccaagaagcctggggcgccgacccccttgggcagctcagtccggctgctcccctacatttcccggggaagtggggggtcgctgtctaagccccttcccccaatcacttcgttcctag

SEQ ID NO: 3941 - protein, 8 aa, homo sapiens
MESPSILP

SEQ ID NO: 3942 - DNA, 27 bp, homo sapiens
atggagagcccctcaatcctaccctag

SEQ ID NO: 3943 - protein, 9 aa, homo sapiens
MCLVFESRL

SEQ ID NO: 3944 - DNA, 30 bp, homo sapiens
atgtgcttggtgtttgaatctaggctttag

SEQ ID NO: 3945 - protein, 33 aa, homo sapiens
MVRERSPRGPLGQGRVFGMLGRVYKNCKGEAGS

SEQ ID NO: 3946 - DNA, 102 bp, homo sapiens
atggtcagggagcgcagcccgagggggccacttggccagggccgcgtgtttgggatgcttggccgggtatataagaactgcaaaggtgaggccggctcctga

SEQ ID NO: 3947 - protein, 93 aa, homo sapiens [sequence omitted]

SEQ ID NO: 3948 - DNA, 282 bp, homo sapiens
atggcatgggggcttcggggctgggctgggggcgcgattcacctgccgctccgcaacaaagccccggcagccgggcgtggggctaaacttaccttgaacttgcagtatcccccactgaggtgctggtggggggcagggattcccgagctgagcggcggcgaggctgcccccggccgggactcggcacttctgcagctctcccagccacgtcagggtcaggaggcgtttacaggggcagggcggcgaggtggggggcggggggcacatgtgggcggagactag

SEQ ID NO: 3949 - protein, 26 aa, homo sapiens
MGASGLGWGRDSPAAPQQSPGSRAWG

SEQ ID NO: 3950 - DNA, 81 bp, homo sapiens
atgggggcttcggggctgggctgggggcgcgattcacctgccgctccgcaacaaagccccggcagccgggcgtggggctaa

SEQ ID NO: 3951 - protein, 26 aa, homo sapiens
MWAETRGASGRAALVVGVCAGPCWGA

SEQ ID NO: 3952 - DNA, 81 bp, homo sapiens
atgtgggcggagactaggggggcttcggggagagcagccctggtggtcggcgtctgtgcaggtccctgctggggagcttga

SEQ ID NO: 3953 - protein, 5 aa, homo sapiens
MAVFP

SEQ ID NO: 3954 - DNA, 18 bp, homo sapiens
atggcagtcttcccgtga

SEQ ID NO: 3955 - protein, 43 aa, homo sapiens
MYSLGDLSSLPRWPPWLPAGRTPPLSRGMDFPILLSVFDQRWC

SEQ ID NO: 3956 - DNA, 132 bp, homo sapiens
atgtattcactaggtgacctgtcttctctgcctcggtggcctccatggctgcctgctggccgcacacccccactcagcagaggaatggactttccaatcttgctgagtgtgtttgaccaaaggtggtgctga

SEQ ID NO: 3957 - protein, 23 aa, homo sapiens
MAACWPHTPTQQRNGLSNLAECV

SEQ ID NO: 3958 - DNA, 72 bp, homo sapiens
atggctgcctgctggccgcacacccccactcagcagaggaatggactttccaatcttgctgagtgtgtttga

SEQ ID NO: 3959 - protein, 44 aa, homo sapiens
MRLIRKRKNCLLLNPGSHKGRGERPKATEAVEGAILPATGRALD

SEQ ID NO: 3960 - DNA, 135 bp, homo sapiens
atgcgacttatcagaaagagaaagaattgtttacttttaaaccctggatcccataaagggagaggggagaggcctaaagccacagaagctgtggaaggcgccatcctgcctgccacaggaagggccttggactga

SEQ ID NO: 3961 - protein, 29 aa, homo sapiens
MVGVLNQATASVVFPPQKYFSLRETLSEW

SEQ ID NO: 3962 - DNA, 90 bp, homo sapiens
atggtgggagtcttgaaccaagccactgccagtgtagtttttccaccacaaaagtattttagtttgagggaaacgttatcagaatggtaa

SEQ ID NO: 3963 - protein, 23 aa, homo sapiens
MVSFSLKDSPNDGFFQSGMVFRN

SEQ ID NO: 3964 - DNA, 72 bp, homo sapiens
atggtaagtttttccctgaaagacagcccaaatgatggctttttccaatcaggcatggtcttcagaaattaa

SEQ ID NO: 3965 - protein, 50 aa, homo sapiens [sequence omitted]

SEQ ID NO: 3966 - DNA, 153 bp, homo sapiens
atgatggctttttccaatcaggcatggtcttcagaaattaaacatcagttgcaggcaatggtttatttcttatttttcttcttcttttttcttcttctcctcctcttccccctcctcctcctcttcctcttttttccttctctctctgattaa

SEQ ID NO: 3967 - protein, 48 aa, homo sapiens
MASKREGPRPGHPSCSHSCWVGASAATLAGCVVSAGLLLAGGACSPHL

SEQ ID NO: 3968 - DNA, 147 bp, homo sapiens
atggcctcgaagcgagaagggcctcgcccgggtcacccttcgtgcagccactcctgctgggtgggcgcctctgctgcgaccctcgcgggctgtgtggtttcagcagggctgcttttagctggcggggcttgttctccccatctctag

SEQ ID NO: 3969 - protein, 41 aa, homo sapiens
MTTGLTPHPSAGCPEQSWTVFLAPSPEGRPSWETGFSSNSN

SEQ ID NO: 3970 - DNA, 126 bp, homo sapiens
atgacgactggcctgacacctcatccatcagcagggtgcccagagcagagttggacagtcttccttgctccatctccagaggggaggcccagttgggaaacaggattctcttccaatagcaattag

SEQ ID NO: 3971 - protein, 33 aa, homo sapiens
MRRNPGLRGLIRNFVVSNKLWPLEESTPWLLWL

SEQ ID NO: 3972 - DNA, 102 bp, homo sapiens
atgaggagaaatccaggtctccgtggcctgattagaaactttgttgtgtcaaataaactttggccactggaggaaagtaccccatggttgctctggctttag

SEQ ID NO: 3973 - protein, 41 aa, homo sapiens
MVALALERSVQGFSIFFSPLSLSLPLSLPSSLVSKGASGQR

SEQ ID NO: 3974 - DNA, 126 bp, homo sapiens
atggttgctctggctttagaaagatctgtccagggcttctcaatcttcttttcacccctctctctctcactccctctctctctcccctcttctcttgtttcaaaaggggcctctggtcagcgctga

SEQ ID NO: 3975 - protein, 156 aa, homo sapiens [sequence omitted]

SEQ ID NO: 3976 - DNA, 471 bp, homo sapiens
atggccggtgacccagtaaggactaaaccttgcgctggtttattgtggcaagctgagaaaggggctttaggcccgggaccccaggcactgacccgcacacatcccgcggatcgcctattcattcgcacagccctccagtcgcccaggctcccattgtttgctgagcaacaatggagatttcgcagggaaagtaaagctcttttcagattcctctctgatgttttgcatttagggaaacaccgacctccactttttcccccgacattttccctcctggcatttaaagctgttcgttttcggggaaacttctgtgagtttcgcgcttgttcgaccaacaccagtgttaggaggaggcgagaccggtggaaaaaggagagccccagagatttcccgtgtgtgtgtgtgtgtgtgtgtgtgtgtgtgtgtgtgtgtgtgtgtgtaatgcatttagaggacgggagctgcctctag

SEQ ID NO: 3977 - protein, 29 aa, homo sapiens
MADKREGEGVGVSARVSSPPPAPAPAGAT

SEQ ID NO: 3978 - DNA, 90 bp, homo sapiens
atggcggacaagagggagggggagggggtgggggtctcggcccgtgtttcctcccctcctcccgctcccgcccccgccggagccacctga

SEQ ID NO: 3979 - protein, 83 aa, homo sapiens
MKPTKLAGPPKRSPPERTLRGGRGRGCRRAPLPARLLPAGSAPKPWTALPPARLAGGRCTPGVEVGSRGPRSLLRTPRGAGFF

SEQ ID NO: 3980 - DNA, 252 bp, homo sapiens
atgaaacctacgaagctcgcggggccaccgaaaaggtccccaccggagcggactctgcggggcgggcggggcagaggctgcaggcgggctccccttcccgcgcggctcctaccggccggctccgcccccaagccctggacggcccttcccccagcccgcctggctgggggccgctgcacaccgggggtggaagtggggagccggggaccccgatcgctactcaggactccaagaggggccgggttcttctag

SEQ ID NO: 3981 - protein, 6 aa, homo sapiens
MYKNLG

SEQ ID NO: 3982 - DNA, 21 bp, homo sapiens
atgtacaaaaatctagggtga

SEQ ID NO: 3983 - protein, 30 aa, homo sapiens
MGGAKESFPLEWEQAPRSWNPEASWTRPGS

SEQ ID NO: 3984 - DNA, 93 bp, homo sapiens
atggggggtgctaaggagtctttccccttagaatgggaacaagctccaaggagctggaatcccgaggcgtcctggacccgtccaggaagctaa

SEQ ID NO: 3985 - protein, 8 aa, homo sapiens
MAQGLGWP

SEQ ID NO: 3986 - DNA, 27 bp, homo sapiens
atggcgcaggggctgggttggccctag

SEQ ID NO: 3987 - protein, 16 aa, homo sapiens
MGTEACRPRRPALLAV

SEQ ID NO: 3988 - DNA, 51 bp, homo sapiens
atggggacagaggcctgccggccgcgccggcctgcgctccttgcagtctaa

SEQ ID NO: 3989 - protein, 8 aa, homo sapiens
MGAGKDDL

SEQ ID NO: 3990 - DNA, 27 bp, homo sapiens
atgggggcggggaaggacgacctttaa

SEQ ID NO: 3991 - protein, 15 aa, homo sapiens
MCSWRGCARGCRRAM

SEQ ID NO: 3992 - DNA, 48 bp, homo sapiens
atgtgcagctggaggggctgcgcgcgtgggtgcaggagggccatgtga

SEQ ID NO: 3993 - protein, 301 aa, homo sapiens; identical to SEQ ID NO: 33

SEQ ID NO: 3994 - DNA, 906 bp, homo sapiens; identical to SEQ ID NO: 34

SEQ ID NO: 3995 - protein, 41 aa, homo sapiens; identical to SEQ ID NO: 35

SEQ ID NO: 3996 - DNA, 126 bp, homo sapiens; identical to SEQ ID NO: 36

SEQ ID NO: 3997 - protein, 50 aa, homo sapiens [sequence omitted]

SEQ ID NO: 3998 - DNA, 153 bp, homo sapiens; identical to SEQ ID NO: 38

SEQ ID NO: 3999 - protein, 13 aa, homo sapiens
MGAGAGRIVAGRD

SEQ ID NO: 4000 - DNA, 42 bp, homo sapiens; identical to SEQ ID NO: 40

SEQ ID NO: 4001 - protein, 38 aa, homo sapiens
MVPQEAVRAPLRFEWVSSERYSSLHFYSLRILLLGLLL

SEQ ID NO: 4002 - DNA, 117 bp, homo sapiens
atggtgccacaggaggctgtgcgggccccgctccgcttcgaatgggtgagttcagaacgctattcgtctttacacttctatagcctccgaatcctacttcttggtcttctcctttga

SEQ ID NO: 4003 - protein, 13 aa, homo sapiens
MGEFRTLFVFTLL

SEQ ID NO: 4004 - DNA, 42 bp, homo sapiens
atgggtgagttcagaacgctattcgtctttacacttctatag

SEQ ID NO: 4005 - protein, 24 aa, homo sapiens
MIFACGILALGERDASYFLFSHLC

SEQ ID NO: 4006 - DNA, 75 bp, homo sapiens
atgatttttgcatgcggcatacttgccctgggggaaagagatgcctcctattttctcttcagtcatttgtgctag

SEQ ID NO: 4007 - protein, 24 aa, homo sapiens
MRHTCPGGKRCLLFSLQSFVLVVN

SEQ ID NO: 4008 - DNA, 75 bp, homo sapiens
atgcggcatacttgccctgggggaaagagatgcctcctattttctcttcagtcatttgtgctagtcgtaaattaa

SEQ ID NO: 4009 - protein, 34 aa, homo sapiens; identical to SEQ ID NO: 3737

SEQ ID NO: 4010 - DNA, 105 bp, homo sapiens; identical to SEQ ID NO: 3738

SEQ ID NO: 4011 - protein, 5 aa, homo sapiens
MGSGT

SEQ ID NO: 4012 - DNA, 18 bp, homo sapiens
atggggtccgggacttga

SEQ ID NO: 4013 - protein, 20 aa, homo sapiens
MIFFRFWEVESTGQRLHLTH

SEQ ID NO: 4014 - DNA, 63 bp, homo sapiens; identical to SEQ ID NO: 3742

SEQ ID NO: 4015 - protein, 23 aa, homo sapiens
MGVTVPPCLPLLYLDKDLLYPDF

SEQ ID NO: 4016 - DNA, 72 bp, homo sapiens; identical to SEQ ID NO: 3744

SEQ ID NO: 4017 - protein, 26 aa, homo sapiens
MHLLCPCCRKEPADWPLSAAHSTGWL

SEQ ID NO: 4018 - DNA, 81 bp, homo sapiens; identical to SEQ ID NO: 3762

SEQ ID NO: 4019 - protein, 50 aa, homo sapiens; identical to SEQ ID NO: 3763

SEQ ID NO: 4020 - DNA, 153 bp, homo sapiens; identical to SEQ ID NO: 3764

SEQ ID NO: 4021 - protein, 8 aa, homo sapiens
MPCLISHS

SEQ ID NO: 4022 - DNA, 27 bp, homo sapiens
atgccctgtctcatttcgcatagctaa

SEQ ID NO: 4023 - protein, 24 aa, homo sapiens
MLIKIPCLNLKNNDSAVIRNLVRV

SEQ ID NO: 4024 - DNA, 75 bp, homo sapiens; identical to SEQ ID NO: 3768

SEQ ID NO: 4025 - protein, 25 aa, homo sapiens
MVCERISVCLGRKLFDLQKSQKTSR

SEQ ID NO: 4026 - DNA, 78 bp, homo sapiens; identical to SEQ ID NO: 3770

SEQ ID NO: 4027 - protein, 24 aa, homo sapiens
MFTFVEVQNVLTIVCLFFVCLFKS

SEQ ID NO: 4028 - DNA, 75 bp, homo sapiens; identical to SEQ ID NO: 3772

SEQ ID NO: 4029 - protein, 7 aa, homo sapiens
MLLWKEY

SEQ ID NO: 4030 - DNA, 24 bp, homo sapiens
atgttgctttggaaggaatattaa

SEQ ID NO: 4031 - protein, 6 aa, homo sapiens
MRPLCT

SEQ ID NO: 4032 - DNA, 21 bp, homo sapiens
atgaggcccctttgcacatga

SEQ ID NO: 4033 - protein, 17 aa, homo sapiens
MLLLDSSCLIFLLLWLF

SEQ ID NO: 4034 - DNA, 54 bp, homo sapiens; identical to SEQ ID NO: 3778

SEQ ID NO: 4035 - protein, 42 aa, homo sapiens [sequence omitted]

SEQ ID NO: 4036 - DNA, 129 bp, homo sapiens; identical to SEQ ID NO: 3780

SEQ ID NO: 4037 - protein, 13 aa, homo sapiens
MSVTVEILLMVFI

SEQ ID NO: 4038 - DNA, 42 bp, homo sapiens; identical to SEQ ID NO: 3782

SEQ ID NO: 4039 - protein, 57 aa, homo sapiens; identical to SEQ ID NO: 3783

SEQ ID NO: 4040 - DNA, 174 bp, homo sapiens; identical to SEQ ID NO: 3784

SEQ ID NO: 4041 - protein, 53 aa, homo sapiens
MLCLASRCVSVCLCARACSLGHPCLAEGRGWRVSAWRVKASQSVRSKGTLESN

SEQ ID NO: 4042 - DNA, 162 bp, homo sapiens
atgctttgcctcgcctctcgctgtgtatctgtatgcctgtgtgcgcgcgcgtgctcgctcgggcatccgtgtctagccgaggggagggggtggcgtgtgagtgcgtggagggtaaaagccagtcagtcagtgagaagcaaaggtacgttggagagcaactaa

SEQ ID NO: 4043 - protein, 46 aa, homo sapiens
MPVCARVLARASVSSRGEGVACECVEGKSQSVSEKQRYVGEQLKSD

SEQ ID NO: 4044 - DNA, 141 bp, homo sapiens
atgcctgtgtgcgcgcgcgtgctcgctcgggcatccgtgtctagccgaggggagggggtggcgtgtgagtgcgtggagggtaaaagccagtcagtcagtgagaagcaaaggtacgttggagagcaactaaaatctgactga

SEQ ID NO: 4045 - protein, 81 aa, homo sapiens [sequence omitted]

SEQ ID NO: 4046 - DNA, 246 bp, homo sapiens
atgtattccctaaggaggatgggtctccgtgatgggggtggtataattatgttaatgtcatttttatggaggggtgagatttttcattctgataattggttgaatgctatggtcaaaaattgtaaagccatattcagttttagggaaaagcatggacttagatctaagggctgttttattttttcgctttttgtgagtgctgcttttttgtttttttggtttttgttttttaactatttattttaa

SEQ ID NO: 4047 - protein, 4 aa, homo sapiens
MGVV

SEQ ID NO: 4048 - DNA, 15 bp, homo sapiens
atgggggtggtataa

SEQ ID NO: 4049 - protein, 237 aa, homo sapiens [sequence omitted]

SEQ ID NO: 4050 - DNA, 714 bp, homo sapiens
atgtcaggagaaggggacactcagatgcaaagccggtggggacctgccaagaagccagcccacaaggccatggactcctccacgccatcagctggagcagtgggcagccccaggaagggagacgggagcggccaggggaagggcgaggggtcccccgggcgacccccgaggctcaggcgcccggactccagtcctgggcctccgttttccacccttgaacaagcggcttccacctgtgagccagctgcctcctctgaaaatggaagcccctcaactcagagggtgtcgctctgggacgtgggtcaggggccggagcaggcagggagaggtgagaggaaaggctggggaccctcacttctccctgcccaaaccctcgctcgggagcagacggctcctctgcccgcaggcacccctgcctggcagctccctccagcccccgtcgggtccgggacgtcctctgatgggaaggttccaccacatccgtggctgacagagccagcccgtccgaggccggggggcgctcggggtaaacaggaagccccatccctcccgcactctgcttcactccctcctcctgcacctcctgcagcccggctcccgcggccgcgcctggtgcccctctgtctcgcgccacctgagatgcccaggctggcctctgccaggggcttagtctgccctctcctggggcttcagaggccaaaagcaccctggtga

SEQ ID NO: 4051 - protein, 76 aa, homo sapiens
MEAPQLRGCRSGTWVRGRSRQGEVRGKAGDPHFSLPKPSLGSRRLLCPQAPLPGSSLQPPSGPGRPLMGRFHHIRG

SEQ ID NO: 4052 - DNA, 231 bp, homo sapiens
atggaagcccctcaactcagagggtgtcgctctgggacgtgggtcaggggccggagcaggcagggagaggtgagaggaaaggctggggaccctcacttctccctgcccaaaccctcgctcgggagcagacggctcctctgcccgcaggcacccctgcctggcagctccctccagcccccgtcgggtccgggacgtcctctgatgggaaggttccaccacatccgtggctga

SEQ ID NO: 4053 - protein, 41 aa, homo sapiens
MALLTRETMGKLRPVWGTKLGPELQLPAPAGPPPLTPPQAG

SEQ ID NO: 4054 - DNA, 126 bp, homo sapiens
atggccctgctgacaagagagacaatggggaaactgaggcctgtgtggggcacaaagctgggaccagagctccagcttcctgcccctgccgggcctccacctctgacaccaccccaggcagggtga

SEQ ID NO: 4055 - protein, 23 aa, homo sapiens
MRTGAGLGVATLSHQVSPSVLGP

SEQ ID NO: 4056 - DNA, 72 bp, homo sapiens
atgaggacaggcgcaggccttggggtggccacactctcccaccaggtctccccctctgtgctgggcccctga

SEQ ID NO: 4057 - protein, 294 aa, homo sapiens
MGAGRGRQVGRGRGRGGAGLGAPTARARAAVAAARARPGSGGECGASGARRGRGPVAARAGSRAGPAEPPGAGNLAARGAGGGSGTRQRDRWGRGRSGPGRPRLGRAGPGEWAQRPREPAPPAGGGRAGGAAGRAGVAAAPRPTRRDSAPRGPACAACSAPREPRSQQRGWEGAAGRSVSLRLCALPRGPRGPQPCSRREGSASACGAARPLPLRTRPLAGGGCGAAAGQVGREPVGAGGTGTGLLVHLAPPPPPRPAPLGRGRGPPRGNGACSTGSESTTGFLWPRENMTFKN

SEQ ID NO: 4058 - DNA, 885 bp, homo sapiens
atgggggcggggcggggccgccaggtggggcggggccgggggcggggcggggcggggctcggggcccccacggcgcgggctcgggcggcagtggcggcggcgcgtgcgcgccccggatccggcggtgagtgcggagcgagcggggcgcgccggggtcggggtccggtcgccgcccgggctgggtcgagggcgggacccgcggagcccccgggggcggggaacctggccgcgcgcggagctgggggcggctccgggacgaggcagcgcgaccgctggggccgggggcggagcgggccggggcgcccgcggctgggtcgggccgggccgggagaatgggcccagcggccccgggaaccggctccccctgccggcggcgggcgggcgggcggcgcggcggggagggccggggtcgccgcggcccctcgtccgacccggcgcgactcagcgcctcggggcccagcctgtgccgcctgctccgccccccgcgaaccccggagccagcagcgcggctgggagggggcggcgggcaggtccgtctcgctccgcctctgcgccctccctcgtgggccccgcggtccccagccctgctcccgccgcgaggggtccgccagtgcctgcggcgcagccaggcccctccctctgcggacccggcctctcgcgggtgggggctgcggggctgctgccgggcaggtggggagggagcccgtgggcgctgggggcacggggaccggactgctggtccacctggcgccgccgccccctccccgcccggcacccctgggtcgaggccgtggccccccccggggaaatggggcttgcagcaccggctcggagagcaccacgggcttcctctggcctcgggaaaacatgactttcaaaaattga

SEQ ID NO: 4059 - protein, 256 aa, homo sapiens [sequence omitted]

SEQ ID NO: 4060 - DNA, 771 bp, homo sapiens
atgggcccagcggccccgggaaccggctccccctgccggcggcgggcgggcgggcggcgcggcggggagggccggggtcgccgcggcccctcgtccgacccggcgcgactcagcgcctcggggcccagcctgtgccgcctgctccgccccccgcgaaccccggagccagcagcgcggctgggagggggcggcgggcaggtccgtctcgctccgcctctgcgccctccctcgtgggccccgcggtccccagccctgctcccgccgcgaggggtccgccagtgcctgcggcgcagccaggcccctccctctgcggacccggcctctcgcgggtgggggctgcggggctgctgccgggcaggtggggagggagcccgtgggcgctgggggcacggggaccggactgctggtccacctggcgccgccgccccctccccgcccggcacccctgggtcgaggccgtggccccccccggggaaatggggcttgcagcaccggctcggagagcaccacgggcttcctctggcctcgggaaaacatgactttcaaaaattgagtctccacttagcaccgcttcctgtccaggcgactctcaggaattgtgggggggagctgtgccaatatgtgtggggggcaatgaggtctgggagattcgcctacccccaggcccgccctggcatccccctgcccacatcaagccgccgggccgctgccctacctcttccttcccgggtcccactccccaatgtcccccgacttcgagtcttgccttga

SEQ ID NO: 4061 - protein, 20 aa, homo sapiens
MGLAAPARRAPRASSGLGKT

SEQ ID NO: 4062 - DNA, 63 bp, homo sapiens
atggggcttgcagcaccggctcggagagcaccacgggcttcctctggcctcgggaaaacatga

SEQ ID NO: 4063 - protein, 5 aa, homo sapiens
MCGGQ

SEQ ID NO: 4064 - DNA, 18 bp, homo sapiens
atgtgtggggggcaatga

SEQ ID NO: 4065 - protein, 8 aa, homo sapiens
MVNPILCT

SEQ ID NO: 4066 - DNA, 27 bp, homo sapiens
atggttaatccaattctgtgcacctga

SEQ ID NO: 4067 - protein, 11 aa, homo sapiens
MTERMNGHMND

SEQ ID NO: 4068 - DNA, 36 bp, homo sapiens
atgacagaaagaatgaatggacacatgaacgactga

SEQ ID NO: 4069 - protein, 48 aa, homo sapiens [sequence omitted]

SEQ ID NO: 4070 - DNA, 147 bp, homo sapiens
atggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatga

SEQ ID NO: 4071 - protein, 25 aa, homo sapiens
MKLNESERENKEKPIKKRTNTWVYL

SEQ ID NO: 4072 - DNA, 78 bp, homo sapiens
atgaaactaaatgaaagcgaaagggaaaataaagaaaaaccaataaaaaagagaacgaatacgtgggtgtatctgtaa

SEQ ID NO: 4073 - protein, 10 aa, homo sapiens
MSLRGRTTYE

SEQ ID NO: 4074 - DNA, 33 bp, homo sapiens
atgtcactccggggacgtacaacctatgaatag

SEQ ID NO: 4075 - protein, 37 aa, homo sapiens [sequence omitted]

SEQ ID NO: 4076 - DNA, 114 bp, homo sapiens
atgaatagtcggctgccgctcaaagagaacgaagaggcggggctagtgcgtggtgggaaggggcgggattctgccagccgcggctgccgctggagccggtgtccgggctggtga

SEQ ID NO: 4077 - protein, 32 aa, homo sapiens
MGLIPFRKTLTCTHPAPPSPRRAALQPPPPPQ

SEQ ID NO: 4078 - DNA, 99 bp, homo sapiens
atggggttaattccctttcgtaagactcttacttgcacccacccagccccgccgtcgccccgccgcgccgcgctccaaccgcctcctcctcctcagtaa

SEQ ID NO: 4079 - protein, 65 aa, homo sapiens
MPFPPPSSSPGITRLAPLPRPPTGSANGEGGRQGRDVVCGKVAFPAGSSALQPGPSDVPLLPARR

SEQ ID NO: 4080 - DNA, 198 bp, homo sapiens
atgcccttccctcccccgtccagctccccgggaataacgcgccttgctcccctcccccgcccgccaaccggtagcgctaacggagaaggaggcaggcaggggagagatgtggtgtgtggaaaggtggccttccccgccgggtcgtcggcgcttcagccagggccttctgacgtcccgctgctgccagcccgccgttag

SEQ ID NO: 4081 - protein, 28 aa, homo sapiens
MFMHRNIAEVDVVAVSYSGLLPDHLLKM

SEQ ID NO: 4082 - DNA, 87 bp, homo sapiens
atgtttatgcatagaaatatagctgaggtggatgtggttgctgtcagctattcaggtttgctacctgatcacctcctgaagatgtag

SEQ ID NO: 4083 - protein, 15 aa, homo sapiens
MWLLSAIQVCYLITS

SEQ ID NO: 4084 - DNA, 48 bp, homo sapiens
atgtggttgctgtcagctattcaggtttgctacctgatcacctcctga

SEQ ID NO: 4085 - protein, 9 aa, homo sapiens
MCLEYRYSF

SEQ ID NO: 4086 - DNA, 30 bp, homo sapiens
atgtgtttagagtacagatattcattttaa

SEQ ID NO: 4087 - protein, 7 aa, homo sapiens
MFDFLPV

SEQ ID NO: 4088 - DNA, 24 bp, homo sapiens
atgtttgattttctaccagtatga

SEQ ID NO: 4089 - protein, 141 aa, homo sapiens
MLHMIQPPRSTPVAALRPRRRDPSPCLPDDLCLTPSCLLYSHKFAASSPTSVLRGQPPSITSQQHCEASVFSPTCSSLSLLQSISQVFPKTFRDCPLPVEEKQALRLARTTKVCLNILSHLFSHFSPSCAYKSAPLCMSRP

SEQ ID NO: 4090 - DNA, 426 bp, homo sapiens
atgctgcatatgatccagccacctcgctctactcctgtggctgcccttcgtcctcgtcgccgggacccctctccctgcctcccagacgacctgtgccttaccccttcctgtctcttatattctcataaatttgctgcctcctctcctacgtccgtccttcggggtcagcctccatccattacctctcagcagcattgcgaagcctctgttttctccccgacttgcagcagcctctccctcctccagtcaatttcgcaggtttttcccaaaaccttcagagactgcccattgcctgtagaggaaaagcaggctcttcgcctggcacggaccaccaaggtttgcctgaacatcctttcccaccttttctctcacttctccccttcctgtgcctacaaatcagcccctctgtgtatgtctcggccttga

SEQ ID NO: 4091 - protein, 53 aa, homo sapiens [sequence omitted]

SEQ ID NO: 4092 - DNA, 162 bp, homo sapiens
atggatgctgattttgccccatcattatttgtgctggtgccatgggaagaagcggcccaggagaaagatcaggctccaggagaggctgatgcgcttgcttcgggatgtttagttggaagggctccgggcacccaaggagaaatgtccacacttcccttctaa

SEQ ID NO: 4093 - protein, 35 aa, homo sapiens
MLILPHHYLCWCHGKKRPRRKIRLQERLMRLLRDV

SEQ ID NO: 4094 - DNA, 108 bp, homo sapiens
atgctgattttgccccatcattatttgtgctggtgccatgggaagaagcggcccaggagaaagatcaggctccaggagaggctgatgcgcttgcttcgggatgtttag

SEQ ID NO: 4095 - protein, 15 aa, homo sapiens
MGRSGPGERSGSRRG

SEQ ID NO: 4096 - DNA, 48 bp, homo sapiens
atgggaagaagcggcccaggagaaagatcaggctccaggagaggctga

SEQ ID NO: 4097 - protein, 59 aa, homo sapiens
MRAGCVMALVTVHSELRRNRDFAWRRPLHGRWGAGGHQISGDGGGGEDLSNENRCQGGI

SEQ ID NO: 4098 - DNA, 180 bp, homo sapiens
atgcgcgctggctgcgtcatggctctagtcacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttga

SEQ ID NO: 4099 - protein, 91 aa, homo sapiens [sequence omitted]

SEQ ID NO: 4100 - DNA, 276 bp, homo sapiens
atgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctcccgctaagcgacgagtcttcaacaagttggaggaaggcaggaacgcaggggttaagctcggaaagccgcaattaccaagatcgtga

SEQ ID NO: 4101 - protein, 20 aa, homo sapiens
MGGGGAPNQWGRGWGGRPIQ

SEQ ID NO: 4102 - DNA, 63 bp, homo sapiens
atggggggcgggggggcaccaaatcagtggggacgggggtgggggggaagacctatccaatga

SEQ ID NO: 4103 - protein, 103 aa, homo sapiens; identical to SEQ ID NO: 163

SEQ ID NO: 4104 - DNA, 312 bp, homo sapiens; identical to SEQ ID NO: 164

SEQ ID NO: 4105 - protein, 244 aa, homo sapiens [sequence omitted]

SEQ ID NO: 4106 - DNA, 735 bp, homo sapiens
atgggagcctgggggagcggatcctgctcactccattcaagaatcccaagtattcaagatggacggcagggagtgtggaaggagaaagggggcgaggggggaagagcgagatcggcagaggagagggtctccgcggcccaccggcctcgcaacctcggtcccggccggcgggtggcggggcggccgctggggatccaagcccggcccgggagaggggctggcggggtgcgagagggcgtgagcgagggggagcgaggccagggaggggagccaagagggagggaagggcagagaaagagcccgggaagaaggaggtggcaggcagaggatcctaacgaagagcaatgtgtaggtatcgagagcttcccgaagggtaacgacaccgattttcggttttattctctcttggggaagggagggggacggtctgggctctttctctcgtcttcctttttccctcctcattctccactcgtgggcatcttttctattttttcctttggaaacactgtaactgggaagcaccaggcgtgtctttctgaggtggcctcactgtcattttccagtggggggcgtggtggggtagggatggggggctccgctgggcacggccgagctgggccatctgtctccacctgggttgtgtgcgagggcgtggagtgttccgagggggaccgggggccgaagggctggagcagggcagggagttctgcacctccagaagttgtagggtga

SEQ ID NO: 4107 - protein, 60 aa, homo sapiens
MDGRECGRRKGARGEERDRQRRGSPRPTGLATSVPAGGWRGGRWGSKPGPGEGLAGCERA

SEQ ID NO: 4108 - DNA, 183 bp, homo sapiens
atggacggcagggagtgtggaaggagaaagggggcgaggggggaagagcgagatcggcagaggagagggtctccgcggcccaccggcctcgcaacctcggtcccggccggcgggtggcggggcggccgctggggatccaagcccggcccgggagaggggctggcggggtgcgagagggcgtga

SEQ ID NO: 4109 - protein, 10 aa, homo sapiens
MCRYRELPEG

SEQ ID NO: 4110 - DNA, 33 bp, homo sapiens; identical to SEQ ID NO: 170

SEQ ID NO: 4111 - protein, 29 aa, homo sapiens
MCVCGGRALTLQFLLFGCVMRAELCSKYG

SEQ ID NO: 4112 - DNA, 90 bp, homo sapiens; identical to SEQ ID NO: 174

SEQ ID NO: 4113 - protein, 25 aa, homo sapiens
MPGAGPTIYTASHLLLATASPMGQV

SEQ ID NO: 4114 - DNA, 78 bp, homo sapiens; identical to SEQ ID NO: 2598

SEQ ID NO: 4115 - protein, 38 aa, homo sapiens; identical to SEQ ID NO: 2599

SEQ ID NO: 4116 - DNA, 117 bp, homo sapiens; identical to SEQ ID NO: 2600

SEQ ID NO: 4117 - protein, 69 aa, homo sapiens
MLLRKVDHNHEETKAYTSVPHISHRSKRPRGPGPGLHSPAIPGGFQESLTRVLPGDPGWLSWEGGYPSL

SEQ ID NO: 4118 - DNA, 210 bp, homo sapiens
atgcttctccgcaaagtggatcacaatcacgaagaaaccaaagcttacacttccgttccccatatctcccacagatccaaaagaccacggggcccaggacccggtctccatagcccagccatacccgggggttttcaggaaagcctcactcgcgtcctgccgggcgatccggggtggttgagttgggaggggggctaccccagtttgtaa

SEQ ID NO: 4119 - protein, 64 aa, homo sapiens
MHNKAARGRVHSRLGGGSGISTGSRPPPLWARAWRPSPGFQALLSVSLENSQRLELRKGGQSSF

SEQ ID NO: 4120 - DNA, 195 bp, homo sapiens
atgcataacaaagcagcccgcggccgcgttcacagcaggcttggcgggggttcgggaatttccacagggtctcggcctcccccactgtgggctcgcgcctggcgcccctcaccgggcttccaagcgctcttgtcggtgtcgctagaaaactcgcagagattggagctgagaaaaggcgggcaaagttccttttga

SEQ ID NO: 4121 - protein, 12 aa, homo sapiens
MNEPPHEYYARL

SEQ ID NO: 4122 - DNA, 39 bp, homo sapiens
atgaatgagccgccgcacgagtactacgcgcgcctataa

SEQ ID NO: 4123 - protein, 32 aa, homo sapiens
MSRRTSTTRAYKSRRAGQAAGGDRAVATRPAR

SEQ ID NO: 4124 - DNA, 99 bp, homo sapiens
atgagccgccgcacgagtactacgcgcgcctataaaagccgccgcgccggccaggctgcgggaggcgaccgggcagtggcgacgcggcccgccaggtaa

SEQ ID NO: 4125 - protein, 203 aa, homo sapiens [sequence omitted]

SEQ ID NO: 4126 - DNA, 612 bp, homo sapiens
atgtgcggacacggacgggaggacgaggaggggacgggcaggcggcgggtggggcggcccctccggggtggggatgggggcggacggggggcaccggggtcccctcgcggctgcggagccggggccagagacgacacgagcccgcgcagcacctgccggcgcccgatggacacgcagctacttcggaggagcatcgagtggaggaccgacctcggagacccccccccggctttcttggggctcctgcgccattctcccaggaaagtgaggcgaaggtgctggcgccccaggagacgcgccccctcctctccctccctgcggcgcggtgactcagcctcgctgcccgggccggctgagcgggggtgcaggcgagagacggacgcccacccccgcttccccggccctcctgggacccccgccccgcatggcgtcgggcgccccttcccggcaggtcccgtccagcgggtcccgcggcgcccacggcttcccgcctctgcgagcggagctgtcctctcaggaccgggggggcggggcctcccaggtcccgccccgcccccacgcccccgccggaagtgccccctctgggacatctttgacgtcacggccctctga

SEQ ID NO: 4127 - protein, 64 aa, homo sapiens
MGADGGHRGPLAAAEPGPETTRARAAPAGARWTRSYFGGASSGGPTSETPPRLSWGSCAILPGK

SEQ ID NO: 4128 - DNA, 195 bp, homo sapiens
atgggggcggacggggggcaccggggtcccctcgcggctgcggagccggggccagagacgacacgagcccgcgcagcacctgccggcgcccgatggacacgcagctacttcggaggagcatcgagtggaggaccgacctcggagacccccccccggctttcttggggctcctgcgccattctcccaggaaagtga

SEQ ID NO: 4129 - protein, 33 aa, homo sapiens; identical to SEQ ID NO: 3945

SEQ ID NO: 4130 - DNA, 102 bp, homo sapiens; identical to SEQ ID NO: 3946

SEQ ID NO: 4131 - protein, 93 aa, homo sapiens [sequence omitted]

SEQ ID NO: 4132 - DNA, 282 bp, homo sapiens; identical to SEQ ID NO: 3948

SEQ ID NO: 4133 - protein, 26 aa, homo sapiens
MGASGLGWGRDSPAAPQQSPGSRAWG

SEQ ID NO: 4134 - DNA, 81 bp, homo sapiens; identical to SEQ ID NO: 3950

SEQ ID NO: 4135 - protein, 26 aa, homo sapiens
MWAETRGASGRAALVVGVCAGPCWGA

SEQ ID NO: 4136 - DNA, 81 bp, homo sapiens; identical to SEQ ID NO: 3952

SEQ ID NO: 4137 - protein, 12 aa, homo sapiens
MVQSRPANFLYF

SEQ ID NO: 4138 - DNA, 39 bp, homo sapiens
atggtgcaatctcgtccggctaattttttgtatttttag

SEQ ID NO: 4139 - protein, 46 aa, homo sapiens
MEFHHVVQAFLELLTSGDPAALASQSVGITGVSHRARPISTIYYIR

SEQ ID NO: 4140 - DNA, 141 bp, homo sapiens
atggagtttcaccatgttgtccaggcttttcttgaactcctgacctcaggtgatccagctgccttggcctcccaaagtgtggggattacaggcgtgagccaccgcgcccggcccataagtaccatatattatataagatga

SEQ ID NO: 4141 - protein, 9 aa, homo sapiens
MLSRLFLNS

SEQ ID NO: 4142 - DNA, 30 bp, homo sapiens
atgttgtccaggcttttcttgaactcctga

SEQ ID NO: 4143 - protein, 10 aa, homo sapiens
MRASPPLRNL

SEQ ID NO: 4144 - DNA, 33 bp, homo sapiens
atgagagcttccccacccctaagaaacttgtag

SEQ ID NO: 4145 - protein, 22 aa, homo sapiens
MDQGVEGGGCGPGVGRQSACSL

SEQ ID NO: 4146 - DNA, 69 bp, homo sapiens
atggaccagggggtagagggaggtgggtgtggacctggggtcgggcgccagtcagcttgcagcctatga

SEQ ID NO: 4147 - protein, 28 aa, homo sapiens
MKDGKEGYRDRGRVGLRIARAAWHTVLG

SEQ ID NO: 4148 - DNA, 87 bp, homo sapiens
atgaaggacggaaaggagggctacagagataggggaagagtggggctgaggatagccagagcggcttggcacacagttttagggtaa

SEQ ID NO: 4149 - protein, 41 aa, homo sapiens
MTEPVTPGSSFKACLMGDSVVPVTKLGPESQGRAHQVAALP

SEQ ID NO: 4150 - DNA, 126 bp, homo sapiens
atgactgagccggtcactccagggtcttccttcaaagcgtgtctaatgggagacagcgttgtcccagtaaccaaattgggaccagagtcccagggaagggctcatcaggtggccgctctgccttga

SEQ ID NO: 4151 - protein, 16 aa, homo sapiens
MILFPLDPAPLVPFSL

SEQ ID NO: 4152 - DNA, 51 bp, homo sapiens
atgattctcttccctctggatccagcccctctagttcccttttcactttga

SEQ ID NO: 4153 - protein, 73 aa, homo sapiens [sequence omitted]

SEQ ID NO: 4154 - DNA, 222 bp, homo sapiens
atggggtggccggagccctggggggcaggcagatggggagaatgcttctctgccccaggcagtggggagcagcagtggactgccagcttcaggtcccccgggggtcagcaggagtgggaggcagaggggtggccagttagccgagagggacaaggctggccgggagctggcaggctccgttcctgcctgggtgcctggcttctgtgggtggccctgggctga

SEQ ID NO: 4155 - protein, 35 aa, homo sapiens
MGRMLLCPRQWGAAVDCQLQVPRGSAGVGGRGVAS

SEQ ID NO: 4156 - DNA, 108 bp, homo sapiens
atggggagaatgcttctctgccccaggcagtggggagcagcagtggactgccagcttcaggtcccccgggggtcagcaggagtgggaggcagaggggtggccagttag

SEQ ID NO: 4157 - protein, 90 aa, homo sapiens [sequence omitted]

SEQ ID NO: 4158 - DNA, 273 bp, homo sapiens
atgcccagtcctggagtccagggctctgaccctgactctgactgggctgctgctatggggttgctgggtgccagcagcggcaccgtccaggggactgtgaccctcacaagtgcctgtgctagcaggggggttggcggctggctggaatgtgctggggctactcccactgcccaggtggagagtctgagtggagggagagatcttccccctgccataggctcacaggttttactccaagctactgatccccagacccatagacccacatggtaa

SEQ ID NO: 4159 - protein, 32 aa, homo sapiens
MCWGYSHCPGGESEWRERSSPCHRLTGFTPSY

SEQ ID NO: 4160 - DNA, 99 bp, homo sapiens
atgtgctggggctactcccactgcccaggtggagagtctgagtggagggagagatcttccccctgccataggctcacaggttttactccaagctactga

SEQ ID NO: 4161 - protein, 9 aa, homo sapiens
MVKFRNQKS

SEQ ID NO: 4162 - DNA, 30 bp, homo sapiens
atggttaaattcagaaatcagaagagttga

SEQ ID NO: 4163 - protein, 8 aa, homo sapiens
MWKKNCFY

SEQ ID NO: 4164 - DNA, 27 bp, homo sapiens
atgtggaaaaaaaattgtttttattga

SEQ ID NO: 4165 - protein, 16 aa, homo sapiens
MSNVFFKFNFSVMSLK

SEQ ID NO: 4166 - DNA, 51 bp, homo sapiens
atgtccaatgtcttcttcaaatttaattttagtgtcatgtctctaaagtaa

SEQ ID NO: 4167 - protein, 12 aa, homo sapiens
MSSSNLILVSCL

SEQ ID NO: 4168 - DNA, 39 bp, homo sapiens
atgtcttcttcaaatttaattttagtgtcatgtctctaa

SEQ ID NO: 4169 - protein, 14 aa, homo sapiens
MALCRAWVWGSGGP

SEQ ID NO: 4170 - DNA, 45 bp, homo sapiens
atggctttatgcagggcctgggtctggggttctgggggcccatga

SEQ ID NO: 4171 - protein, 80 aa, homo sapiens [sequence omitted]

SEQ ID NO: 4172 - DNA, 243 bp, homo sapiens
atgcagggcctgggtctggggttctgggggcccatgagagaggaaggaaaggagaaccagagggggttggggctggggcagatggcccaaagttcaggtgggaggccgcaggatgcctggttgtttggccctgaaggttgggcatgtctggagtgtgtggaggggcgtgctgtgctgtgctgtgtgctgtgtgctgtgctgtgctgtgctgttgttggggaatgcaggattcctgtccagtga

SEQ ID NO: 4173 - protein, 80 aa, homo sapiens [sequence omitted]

SEQ ID NO: 4174 - DNA, 243 bp, homo sapiens
atgcctggttgtttggccctgaaggttgggcatgtctggagtgtgtggaggggcgtgctgtgctgtgctgtgtgctgtgtgctgtgctgtgctgtgctgttgttggggaatgcaggattcctgtccagtgaaaacaggttgcttctaccagggttgtgcagggagccagcaagtgttgccctggggctgagggtacagttggggtgggagaggcagctactccctggcagaggcagggcctga

SEQ ID NO: 4175 - protein, 52 aa, homo sapiens
MSGVCGGACCAVLCAVCCAVLCCCWGMQDSCPVKTGCFYQGCAGSQQVLPWG

SEQ ID NO: 4176 - DNA, 159 bp, homo sapiens
atgtctggagtgtgtggaggggcgtgctgtgctgtgctgtgtgctgtgtgctgtgctgtgctgtgctgttgttggggaatgcaggattcctgtccagtgaaaacaggttgcttctaccagggttgtgcagggagccagcaagtgttgccctggggctga

SEQ ID NO: 4177 - protein, 8 aa, homo sapiens
MVNPILCT

SEQ ID NO: 4178 - DNA, 27 bp, homo sapiens
atggttaatccaattctgtgcacctga

SEQ ID NO: 4179 - protein, 11 aa, homo sapiens
MTERMNGHMND

SEQ ID NO: 4180 - DNA, 36 bp, homo sapiens; identical to SEQ ID NO: 4068

SEQ ID NO: 4181 - protein, 48 aa, homo sapiens [sequence omitted]

SEQ ID NO: 4182 - DNA, 147 bp, homo sapiens; identical to SEQ ID NO: 4070

SEQ ID NO: 4183 - protein, 25 aa, homo sapiens
MKLNESERENKEKPIKKRTNTWVYL

SEQ ID NO: 4184 - DNA, 78 bp, homo sapiens; identical to SEQ ID NO: 4072

SEQ ID NO: 4185 - protein, 50 aa, homo sapiens
MDLWSRSSSAHPQAGAGSASSKSSGGGGGGSSSGSGSSGSGSSGSGSLVL

SEQ ID NO: 4186 - DNA, 153 bp, homo sapiens
atggatttatggtcccggtcaagctcagcccatccccaggcaggggcgggctcagcgagcagcaagagttctggtggcggcggcggcggcagtagcagcggcagcggtagcagcggcagcggtagcagcggcagcggcagcttggtcctctga

SEQ ID NO: 4187 - protein, 28 aa, homo sapiens
MVPVKLSPSPGRGGLSEQQEFWWRRRRQ

SEQ ID NO: 4188 - DNA, 87 bp, homo sapiens
atggtcccggtcaagctcagcccatccccaggcaggggcgggctcagcgagcagcaagagttctggtggcggcggcggcggcagtag

SEQ ID NO: 4189 - protein, 10 aa, homo sapiens
MGSRRGRGAR

SEQ ID NO: 4190 - DNA, 33 bp, homo sapiens
atgggttcgcgcagggggcggggggcgaggtga

SEQ ID NO: 4191 - protein, 42 aa, homo sapiens
MGGERKGVRFPEPAGRFGVPSPLLSSPRWGAAGGRDADGAIF

SEQ ID NO: 4192 - DNA, 129 bp, homo sapiens
atgggcggggagcggaagggggtccgtttccccgagcctgcggggcggttcggcgttcccagtccgctcctctcctctccacggtggggtgcggctggagggagagacgcggacggggcgattttctaa

SEQ ID NO: 4193 - protein, 64 aa, homo sapiens
MGGCDPLPCSGPYTYTPPTTCRALRPTARPAGLTWCLRVLLASWGCGNQPWAAFALHEETMRLS

SEQ ID NO: 4194 - DNA, 195 bp, homo sapiens
atgggtgggtgtgatcccctcccttgctcgggcccctacacctacacacctcccaccacctgcagagctctccggcccacggcacgccctgctgggctcacctggtgcctgagggttttgcttgccagctggggctgtgggaaccagccgtgggctgcttttgccctacacgaggagacgatgagactgagctga

SEQ ID NO: 4195 - protein, 41 aa, homo sapiens
MRKVLAKRLRKFATEAHGEEWAQSTSGRQHLFSSTHSPSSP

SEQ ID NO: 4196 - DNA, 126 bp, homo sapiens
atgagaaaagtgcttgcaaaacggctgagaaaatttgcaacagaggctcacggggaagagtgggctcaaagcaccagtggcaggcagcacctattctcatctacacacagcccctccagtccctag

SEQ ID NO: 4197 - protein, 24 aa, homo sapiens
MPRPLWSWVSLWQKLGIFAEPAAF

SEQ ID NO: 4198 - DNA, 75 bp, homo sapiens
atgccccgtcctttgtggagctgggtatcgttgtggcagaagttgggaatttttgcagagcctgctgctttttga

SEQ ID NO: 4199 - protein, 5 aa, homo sapiens
MWVHQ

SEQ ID NO: 4200 - DNA, 18 bp, homo sapiens
atgtgggttcaccagtga

SEQ ID NO: 4201 - protein, 40 aa, homo sapiens [sequence omitted]

SEQ ID NO: 4202 - DNA, 123 bp, homo sapiens
atgcgtgacttattagaggagcaaaagaagccgaatatggaaggggaaagccttggcctgatccagggtgctctagaacaaattcctcccactgaactgtcctgctgtggggcaagcaggtga

SEQ ID NO: 4203 - protein, 47 aa, homo sapiens [sequence omitted]

SEQ ID NO: 4204 - DNA, 144 bp, homo sapiens
atgcactggcaacagcagggggatggtgacagccggtgtggggatctggagcacccacacgcccacatcctgcatggtgagacccttactgacacctatttacaagcaaggcttaaaaagaagcatctggggggcgccgggtga

SEQ ID NO: 4205 - protein, 63 aa, homo sapiens
MVTAGVGIWSTHTPTSCMVRPLLTPIYKQGLKRSIWGAPGEGKSSGLSDQTGRFGVGEAGSRK

SEQ ID NO: 4206 - DNA, 192 bp, homo sapiens
atggtgacagccggtgtggggatctggagcacccacacgcccacatcctgcatggtgagacccttactgacacctatttacaagcaaggcttaaaaagaagcatctggggggcgccgggtgaaggcaaatcttcagggctctcggatcaaactgggagatttggggttggagaagcaggcagcaggaaatga

SEQ ID NO: 4207 - protein, 25 aa, homo sapiens
MNLSSVHIWLQSSQTLKLRLQLDVE

SEQ ID NO: 4208 - DNA, 78 bp, homo sapiens
atgaatctgtcttctgttcatatctggctgcaaagctcacaaacgctcaagctcaggctgcagctggatgtggaatga

SEQ ID NO: 4209 - protein, 25 aa, homo sapiens
MRSDGAGMRPLHPLQEPAVPGSATG

SEQ ID NO: 4210 - DNA, 78 bp, homo sapiens
atgaggagtgatggggcaggcatgcggccactccatcctctgcaggagccagcagtacccggcagcgcgaccggctga

SEQ ID NO: 4211 - protein, 24 aa, homo sapiens
MGQACGHSILCRSQQYPAARPAEP

SEQ ID NO: 4212 - DNA, 75 bp, homo sapiens
atggggcaggcatgcggccactccatcctctgcaggagccagcagtacccggcagcgcgaccggctgagccgtga

SEQ ID NO: 4213 - protein, 32 aa, homo sapiens
MELSHVEGSILFLGTPPPRVARLQPGVGAGYL

SEQ ID NO: 4214 - DNA, 99 bp, homo sapiens
atggagctgagccacgtggaaggatcgatcctgttcctgggcacccctcctccccgcgttgccagactgcagcctggggtgggggcaggttacctctga

SEQ ID NO: 4215 - protein, 48 aa, homo sapiens [sequence omitted]

SEQ ID NO: 4216 - DNA, 147 bp, homo sapiens
atgagggtgtctaacgtcaacctagtaggtgatgaggctggggtcccatggaaggggctgctggttggaggaggggctgataatgaacctgaaccggttcttcaagggctgagggtgtatgtggggagggggaggtctgccaagtag

SEQ ID NO: 4217 - protein, 133 aa, homo sapiens [sequence omitted]

SEQ ID NO: 4218 - DNA, 402 bp, homo sapiens
atgggtgccccggccgccaagggtgcagctggagcgagtcctcccggaaggggagaggagcttaggttcccaggcatggagaggagcgatctttgtggagggatcgggaccaggggaaggggcgacttggaactgagctggaagggggtgcctgaaaatgggtttatggcgtggagccagagggaaaaagatgctgcctggaccccctctgagagtctctcccttccttcctgtttggaaatgattgttacccgagactttgatgacggtcccattcagtttttaaacttcaggagggatcacagaatcttgatcgtcttgcttccctcgcgcccacttagtcctgcgtgggtagggtttccacttcttgggagcctagcccttcagctcatttttctttga

SEQ ID NO: 4219 - protein, 28 aa, homo sapiens
MGLWRGARGKKMLPGPPLRVSPFLPVWK

SEQ ID NO: 4220 - DNA, 87 bp, homo sapiens
atgggtttatggcgtggagccagagggaaaaagatgctgcctggaccccctctgagagtctctcccttccttcctgtttggaaatga

SEQ ID NO: 4221 - protein, 7 aa, homo sapiens
MTVPFSF

SEQ ID NO: 4222 - DNA, 24 bp, homo sapiens
atgacggtcccattcagtttttaa

SEQ ID NO: 4223 - protein, 7 aa, homo sapiens
MAFSLHC

SEQ ID NO: 4224 - DNA, 24 bp, homo sapiens
atggcttttagcttacactgttga

SEQ ID NO: 4225 - protein, 46 aa, homo sapiens
MAGGHTCAQGGRRGPGKEPALAARQAEKEGGRAEARAGSRPWNLGP

SEQ ID NO: 4226 - DNA, 141 bp, homo sapiens
atggcaggaggacacacctgtgcgcagggtggcaggcggggcccaggtaaggagcctgcgctggctgcccggcaggcggagaaggaaggaggaagagcggaggccagggcgggctctaggccgtggaatctggggccttaa

SEQ ID NO: 4227 - protein, 44 aa, homo sapiens [sequence omitted]

SEQ ID NO: 4228 - DNA, 135 bp, homo sapiens
atgagggtgggtaaatcggtgtgtgtcgcgggtcgggaaaggctgccgggggtaggggaaggtggctcagaggcggcgggccgacggtcgaggggcttcggagggcctgcttggactgcaacctgggcctcgtga

SEQ ID NO: 4229 - protein, 18 aa, homo sapiens
MGARDLQLFRRDPGPEAA

SEQ ID NO: 4230 - DNA, 57 bp, homo sapiens
atgggagccagggatctgcagcttttccgcagggatcctgggcctgaagctgcctga

SEQ ID NO: 4231 - protein, 39 aa, homo sapiens
MMEAPVPVSATSIASGPQPLAGCSPLPTSHAPRKPLVLS

SEQ ID NO: 4232 - DNA, 120 bp, homo sapiens
atgatggaggcccctgtccctgtgtcagcaacatccatcgcctcaggtccccagcccttagctggctgcagccccctccccacttcccacgcaccccggaagcccctcgtcttgagctga

SEQ ID NO: 4233 - protein, 39 aa, homo sapiens [sequence omitted]

SEQ ID NO: 4234 - DNA, 120 bp, homo sapiens
atgactggattcttactgtgcttcagtcattattattatactgttcacttcacacattatcatacttcagtgactcagaccttgggcaaatactctgtgcctcgctttttcagtccataa

SEQ ID NO: 4235 - protein, 13 aa, homo sapiens
MGLLNSCCRTYMR

SEQ ID NO: 4236 - DNA, 42 bp, homo sapiens
atgggcctacttaatagttgttgcaggacttacatgagataa

SEQ ID NO: 4237 - protein, 66 aa, homo sapiens [sequence omitted]

SEQ ID NO: 4238 - DNA, 201 bp, homo sapiens
atgttccaaagtggaaagttttattcagtgatagaaaacatccaaacctgtcacagagcccatctgaacacagcatgggaccgccaacaagaagaaagcccgcccggaagcagctcaatcaggaggctgggctggaatgacagcgcagcggggcctgaaactatttatatcccaaagctcctctcagataaacacaaatga

SEQ ID NO: 4239 - protein, 21 aa, homo sapiens
MGPPTRRKPARKQLNQEAGLE

SEQ ID NO: 4240 - DNA, 66 bp, homo sapiens
atgggaccgccaacaagaagaaagcccgcccggaagcagctcaatcaggaggctgggctggaatga

SEQ ID NO: 4241 - protein, 12 aa, homo sapiens
MKMGVYPSFSPF

SEQ ID NO: 4242 - DNA, 39 bp, homo sapiens
atgaaaatgggagtttatccctccttttctcctttctga

SEQ ID NO: 4243 - protein, 17 aa, homo sapiens
MKPSPAFWFLGSRKQRY

SEQ ID NO: 4244 - DNA, 54 bp, homo sapiens
atgaaaccttcccccgccttttggtttttaggaagcagaaagcagagatattaa

SEQ ID NO: 4245 - protein, 48 aa, homo sapiens
MNEVASYHPGRMLGQQFPALADTAKGFPYLIRWLQPPRKVEQDSSSVL

SEQ ID NO: 4246 - DNA, 147 bp, homo sapiens
atgaatgaggtagcgtcttaccaccctggccgcatgcttggtcagcaatttccagcacttgcagacactgcaaaaggcttcccttatctcataagatggttacaaccacctagaaaggtggagcaggattcttcgtctgtgttataa

SEQ ID NO: 4247 - protein, 5 aa, homo sapiens
MVTTT

SEQ ID NO: 4248 - DNA, 18 bp, homo sapiens
atggttacaaccacctag

SEQ ID NO: 4249 - protein, 31 aa, homo sapiens
MLVGAGNLAVSASCCCYPWEPGNVALGQGPA

SEQ ID NO: 4250 - DNA, 96 bp, homo sapiens
atgctggtaggggcgggtaatctggcagtttcagcttcctgttgttgctacccttgggaacctggcaatgttgcccttggccaaggcccagcttga

SEQ ID NO: 4251 - protein, 20 aa, homo sapiens
MLPLAKAQLELWQPAPQAKE

SEQ ID NO: 4252 - DNA, 63 bp, homo sapiens
atgttgcccttggccaaggcccagcttgagctgtggcagcctgctccccaagccaaagaataa

SEQ ID NO: 4253 - protein, 69 aa, homo sapiens
MPVIPALWAPKAGRSPEVRSSRPARPTWRNPISTNNLKISQTWWWLPVIPATWEAEAGESLESGRRKLH

SEQ ID NO: 4254 - DNA, 210 bp, homo sapiens
atgcctgtaatcccagcactttgggcacctaaggcaggcagatcacctgaggtcaggagttcgagaccagcccggccaacatggcgaaaccccatctctactaacaatttaaaaattagccagacgtggtggtggttgcctgtaatcccagccacttgggaggctgaggcaggagaatcacttgaatctgggaggcggaagttgcattga

SEQ ID NO: 4255 - protein, 7 aa, homo sapiens
MAKPHLY

SEQ ID NO: 4256 - DNA, 24 bp, homo sapiens
atggcgaaaccccatctctactaa

SEQ ID NO: 4257 - protein, 12 aa, homo sapiens
MKMGVYPSFSPF

SEQ ID NO: 4258 - DNA, 39 bp, homo sapiens; identical to SEQ ID NO: 4242

SEQ ID NO: 4259 - protein, 17 aa, homo sapiens
MKPSPAFWFLGSRKQRY

SEQ ID NO: 4260 - DNA, 54 bp, homo sapiens; identical to SEQ ID NO: 4244

SEQ ID NO: 4261 - protein, 48 aa, homo sapiens; identical to SEQ ID NO: 4245

SEQ ID NO: 4262 - DNA, 147 bp, homo sapiens; identical to SEQ ID NO: 4246

SEQ ID NO: 4263 - protein, 5 aa, homo sapiens
MVTTT

SEQ ID NO: 4264 - DNA, 18 bp, homo sapiens
atggttacaaccacctag

SEQ ID NO: 4265 - protein, 11 aa, homo sapiens
MNSVWCITIAQ

SEQ ID NO: 4266 - DNA, 36 bp, homo sapiens
atgaacagtgtctggtgtataacaattgctcaataa

SEQ ID NO: 4267 - protein, 14 aa, homo sapiens
METLTNCVTLGKSP

SEQ ID NO: 4268 - DNA, 45 bp, homo sapiens
atggaaacacttactaattgtgtgaccttaggcaagtccccctaa

SEQ ID NO: 4269 - protein, 52 aa, homo sapiens
MSKRGSQNGDNNSGYLLWMIAVGLGKMMHVIHLAECLVPSRCPLKFSYDCSL

SEQ ID NO: 4270 - DNA, 159 bp, homo sapiens
atgagtaaaaggggatcacaaaatggagataataattcgggctacctgctatggatgattgctgtgggattagggaagatgatgcacgtgatacatttagcagagtgcctggtgcctagtaggtgcccattaaaatttagctatgactgttctctttag

SEQ ID NO: 4271 - protein, 11 aa, homo sapiens
MEIIIRATCYG

SEQ ID NO: 4272 - DNA, 36 bp, homo sapiens
atggagataataattcgggctacctgctatggatga

SEQ ID NO: 4273 - protein, 43 aa, homo sapiens
MQIGLSCLPLPQQIRVSPERCSFSKTLDRSSFPGWHQQGRLEW

SEQ ID NO: 4274 - DNA, 132 bp, homo sapiens
atgcaaataggccttagctgccttcctctaccccagcaaataagagtctctccagaaagatgctctttctccaagacgcttgaccgctcttcctttcctggatggcaccagcagggccgattggagtggtaa

SEQ ID NO: 4275 - protein, 7 aa, homo sapiens
MLFLQDA

SEQ ID NO: 4276 - DNA, 24 bp, homo sapiens
atgctctttctccaagacgcttga

SEQ ID NO: 4277 - protein, 41 aa, homo sapiens; identical to SEQ ID NO: 275

SEQ ID NO: 4278 - DNA, 126 bp, homo sapiens; identical to SEQ ID NO: 276

SEQ ID NO: 4279 - protein, 5 aa, homo sapiens
MDRRQ

SEQ ID NO: 4280 - DNA, 18 bp, homo sapiens
atggacaggagacagtag

SEQ ID NO: 4281 - protein, 12 aa, homo sapiens
MGTDSPLPFGTA

SEQ ID NO: 4282 - DNA, 39 bp, homo sapiens
atgggaacagactccccactgccctttggtactgcttga

SEQ ID NO: 4283 - protein, 9 aa, homo sapiens
MPFHRHSFQ

SEQ ID NO: 4284 - DNA, 30 bp, homo sapiens
atgccttttcaccgccattccttccagtga

SEQ ID NO: 4285 - protein, 5 aa, homo sapiens
MRNWT

SEQ ID NO: 4286 - DNA, 18 bp, homo sapiens
atgagaaactggacttga

SEQ ID NO: 4287 - protein, 54 aa, homo sapiens
MAGAGSRSGLRLERALWAGFLALPHLPPFSEEPAWGGGGRRLGRGWGPYLRSTG

SEQ ID NO: 4288 - DNA, 165 bp, homo sapiens
atggcgggggcggggtcccgctctggcttgaggttagaaagggctctctgggcagggttcctggccctcccacaccttcctcctttctcagaagagccagcatggggcgggggcgggaggcggctggggcgggggtgggggccttatttaaggagcaccggctga

SEQ ID NO: 4289 - protein, 7 aa, homo sapiens
MPPAKTL

SEQ ID NO: 4290 - DNA, 24 bp, homo sapiens
atgcccccagccaaaacactttag

SEQ ID NO: 4291 - protein, 50 aa, homo sapiens
MLLPPFLFLVSFEWSFRNIFSALGEASPDPILGEMPHLCSRSPHTTVQIL

SEQ ID NO: 4292 - DNA, 153 bp, homo sapiens
atgctcctcccaccctttctttttctagttagctttgaatggtcctttagaaatattttttctgcccttggggaagcctctcctgacccgatactaggtgaaatgccccacctctgctcccgcagcccccacaccactgtgcaaatcctctga

SEQ ID NO: 4293 - protein, 75 aa, homo sapiens
MELPAPDLAPSSPDTMVRGGDGIALAGSVGCSSPGWESGEWPHATLPVSPSIKRGAEEVGSTDPFCFGSCHLCSS

SEQ ID NO: 4294 - DNA, 228 bp, homo sapiens
atggaattgccagcacctgacctggcgcccagctccccagacacgatggtgaggggaggagacgggattgcacttgctggaagcgtagggtgcagcagccccggctgggagtccggggagtggcctcatgccactttgcctgtctccccatccattaagagaggggcggaggaagtgggcagtacagaccctttctgcttcggttcctgccatctgtgctcttcctga

SEQ ID NO: 4295 - protein, 53 aa, homo sapiens
MPLCLSPHPLREGRRKWAVQTLSASVPAICALPEKYLHRCTSVEYVPVCENSD

SEQ ID NO: 4296 - DNA, 162 bp, homo sapiens
atgccactttgcctgtctccccatccattaagagaggggcggaggaagtgggcagtacagaccctttctgcttcggttcctgccatctgtgctcttcctgagaaatatttgcacaggtgtacctcggtagaatacgtaccagtgtgtgaaaactcagattga

SEQ ID NO: 4297 - protein, 22 aa, homo sapiens
MRAICFRPASSVFRFLWAGWVS

SEQ ID NO: 4298 - DNA, 69 bp, homo sapiens
atgcgcgcaatctgcttccggcctgcgagctcggtgttccgctttttgtgggccgggtgggtttcctaa

SEQ ID NO: 4299 - protein, 392 aa, homo sapiens
MAPDSDPFPEGPLLKLLPLDARDRGTQRCRLGPAALHALGARLGSAVKISLPDGGSCLCTAWPRRDGADGFVQLDPLCASPGAAVGASRSRRSLSLNRLLLVPCPPLRRVAVWPVLRERAGAPGARNTAAVLEAAQELLRNRPISLGHVVVAPPGAPGLVAALHIVGGTPSPDPAGLVTPRTRVSLGGEPPSEAQPQPEVPLGGLSEAADSLRELLRLPLRYPRALTALGLAVPRGVLLAGPPGVGKTQLVRAVAREAGAELLAVSAPALQGSRPGETEENVRRVFQRARELASRGPSLLFLDEMDALCPQRGSRAPESRVVAQVLTLLDGASGDREVVVVGATNRPDALDPALRRPGRFDREVNGLGGFAHCRWNLGRFWRHLAAPEAFAS

SEQ ID NO: 4300 - DNA, 1179 bp, homo sapiens
atggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcgggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtaggcccgggagatttgaccgagaggtgaatgggcttggcgggtttgcccactgtcggtggaacctcggccgcttctggcgccatttggctgccccggaggcgtttgcctcttag

SEQ ID NO: 4301 - protein, 33 aa, homo sapiens
MGLAGLPTVGGTSAASGAIWLPRRRLPLRFEHR

SEQ ID NO: 4302 - DNA, 102 bp, homo sapiens
atgggcttggcgggtttgcccactgtcggtggaacctcggccgcttctggcgccatttggctgccccggaggcgtttgcctcttaggtttgagcatcggtga

SEQ ID NO: 4303 - protein, 12 aa, homo sapiens
MQRTRSLPIYDL

SEQ ID NO: 4304 - DNA, 39 bp, homo sapiens
atgcagagaacacgttctctgccgatatatgatctgtga

SEQ ID NO: 4305 - protein, 18 aa, homo sapiens
MSFFQLLMKRKEVSFKNN

SEQ ID NO: 4306 - DNA, 57 bp, homo sapiens
atgagctttttccaactcctgatgaaaaggaaggaagtaagttttaaaaacaattga

SEQ ID NO: 4307 - protein, 7 aa, homo sapiens
MKRWHRF

SEQ ID NO: 4308 - DNA, 24 bp, homo sapiens
atgaaaagatggcacagattttga

SEQ ID NO: 4309 - protein, 8 aa, homo sapiens
MAQILNKV

SEQ ID NO: 4310 - DNA, 27 bp, homo sapiens
atggcacagattttgaacaaagtataa

SEQ ID NO: 4311 - protein, 61 aa, homo sapiens
MFHIEVSKCVPSTCYLLAHSLGGVHDCGGGWSLIFRCVFSLENRCDVSRSQFIKTFLAVFG

SEQ ID NO: 4312 - DNA, 186 bp, homo sapiens
atgtttcatattgaagtgtccaaatgtgtcccctccacctgttatttgttagctcattcccttggtggtgttcatgactgtggcggcgggtggagcctcatctttcgctgtgtattctctttggaaaaccgatgtgatgtaagtaggtctcaatttataaaaacgtttttggcagtgtttggatga

SEQ ID NO: 4313 - protein, 10 aa, homo sapiens
MVHTQSYFCF

SEQ ID NO: 4314 - DNA, 33 bp, homo sapiens
atggtacacactcaatcgtatttttgtttttga

SEQ ID NO: 4315 - protein, 30 aa, homo sapiens
MRLAPKLGPLLIFPLKSCETSLVLLIRSIF

SEQ ID NO: 4316 - DNA, 93 bp, homo sapiens
atgaggctagcccccaagttgggaccattattaatttttcccctcaagtcatgcgaaacatctcttgtccttttaatcagaagcatattttag

SEQ ID NO: 4317 - protein, 18 aa, homo sapiens
MRNISCPFNQKHILGAAE

SEQ ID NO: 4318 - DNA, 57 bp, homo sapiens
atgcgaaacatctcttgtccttttaatcagaagcatattttaggggctgcggaataa

SEQ ID NO: 4319 - protein, 13 aa, homo sapiens
MADNNSPPPPVFY

SEQ ID NO: 4320 - DNA, 42 bp, homo sapiens
atggcagacaataactccccacctcccccagtattttattaa

SEQ ID NO: 4321 - protein, 43 aa, homo sapiens
MWFLPTPRPHLAPGQRGHTWLQASPSPPFQPRSPARSAFLPCI

SEQ ID NO: 4322 - DNA, 132 bp, homo sapiens
atgtggtttctgcccacaccccgcccccaccttgctcctggccagcgggggcacacatggctccaagcctctcccagccctccttttcagcccaggagtccagccaggtctgcgtttctcccatgcatttga

SEQ ID NO: 4323 - protein, 53 aa, homo sapiens
MAPSLSQPSFSAQESSQVCVSPMHLTNSNLMVHSNVTFKLYTGCRRLVSPRLS

SEQ ID NO: 4324 - DNA, 162 bp, homo sapiens
atggctccaagcctctcccagccctccttttcagcccaggagtccagccaggtctgcgtttctcccatgcatttgacgaattccaacctgatggtccactcgaatgtgacctttaaactttatacaggttgtcgtcgccttgtgtccccacggctctcctag

SEQ ID NO: 4325 - protein, 35 aa, homo sapiens
MCPFTCSLLPSPLSLRSPRTKDSFLARFLSVCEGS

SEQ ID NO: 4326 - DNA, 108 bp, homo sapiens
atgtgtcctttcacctgtagccttctcccctcccccctcagcctcagaagtcccaggacaaaggattctttcttggccaggtttttgtcagtgtgtgaagggagttag

SEQ ID NO: 4327 - protein, 35 aa, homo sapiens
MAPNSVRPVSTLIHLFFFFFPERGSLCLPGWSAVV

SEQ ID NO: 4328 - DNA, 108 bp, homo sapiens
atggcacccaactctgttaggccagtaagtacccttattcatctttttttttttttttttccagagaggggctcactctgtctcccaggctggagtgcagtggtgtga

SEQ ID NO: 4329 - protein, 53 aa, homo sapiens [sequence omitted]

SEQ ID NO: 4330 - DNA, 162 bp, homo sapiens
atgcttgggggaggtggtagaggggtctgggaccaaggaatagcgaggcccctcttagcggggggccctggtatacacagaggctcagatggtggactagattttctgaagcatataactcattgttccttgtgttccagtttgggtaaggataggatttaa

SEQ ID NO: 4331 - protein, 6 aa, homo sapiens
MPFSRA

SEQ ID NO: 4332 - DNA, 21 bp, homo sapiens
atgccctttagcagagcctag

SEQ ID NO: 4333 - protein, 4 aa, homo sapiens
MDEG

SEQ ID NO: 4334 - DNA, 15 bp, homo sapiens
atggatgaaggctga

SEQ ID NO: 4335 - protein, 5 aa, homo sapiens
MKADR

SEQ ID NO: 4336 - DNA, 18 bp, homo sapiens
atgaaggctgatagataa

SEQ ID NO: 4337 - protein, 8 aa, homo sapiens
MILILGGA

SEQ ID NO: 4338 - DNA, 27 bp, homo sapiens
atgatccttatcctaggcggggcctaa

SEQ ID NO: 4339 - protein, 27 aa, homo sapiens
MGTYGQSAAAFLLRLHVGTSCGARWRR

SEQ ID NO: 4340 - DNA, 84 bp, homo sapiens
atgggaacgtatggccaatcagcggcggcgtttcttttgcggctccacgtcggcaccagctgcggggcaagatggaggcgctga

SEQ ID NO: 4341 - protein, 63 aa, homo sapiens
MANQRRRFFCGSTSAPAAGQDGGADFGRSWRGSRDAVVSTGAGSQGSARVGDGEREFRVILGD

SEQ ID NO: 4342 - DNA, 192 bp, homo sapiens
atggccaatcagcggcggcgtttcttttgcggctccacgtcggcaccagctgcggggcaagatggaggcgctgattttggtaggagctggaggggcagcagagatgctgtggtgtccacaggggccgggagtcagggttcagcccgagtgggagacggggaaagagagttccgggtaattcttggggactga

SEQ ID NO: 4343 - protein, 38 aa, homo sapiens
MEALILVGAGGAAEMLWCPQGPGVRVQPEWETGKESSG

SEQ ID NO: 4344 - DNA, 117 bp, homo sapiens
atggaggcgctgattttggtaggagctggaggggcagcagagatgctgtggtgtccacaggggccgggagtcagggttcagcccgagtgggagacggggaaagagagttccgggtaa

SEQ ID NO: 4345 - protein, 57 aa, homo sapiens
MELRARGWWLLCAAAALVACARGDPASKSRSCGEVRQIYGAKGFSLSDVPQAEISGE

SEQ ID NO: 4346 - DNA, 174 bp, homo sapiens
atggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagtga

SEQ ID NO: 4347 - protein, 45 aa, homo sapiens
MCGRSAGRLRPRGPGQQEPELRRGPPDLRSQGLQPERRAPGGDLG

SEQ ID NO: 4348 - DNA, 138 bp, homo sapiens
atgtgcggccgcagcgctggtcgcctgcgcccgcggggacccggccagcaagagccggagctgcggcgaggtccgccagatctacggagccaagggcttcagcctgagcgacgtgccccaggcggagatctcgggtga

SEQ ID NO: 4349 - protein, 106 aa, homo sapiens
MAPCAAAPLQPHGPRLQAPRRTPSPGSPPPRSVVLRPSPPPARRLLPCGADLAGLRARGAPPGPRLELGVFCPPLGPARLQAGSPSPGAGCRGAVGLGVAGLSGRR

SEQ ID NO: 4350 - DNA, 321 bp, homo sapiens
atggctccctgcgctgcggctcctctgcaaccccacggccctcgcctccaagccccgcgccgcactccctcgccagggtctcctccgccccgctcggtcgtcctccgcccctccccgccccccgcacgccggcttcttccctgcggagctgatctcgccgggctgcgggctcggggcgctcctcccgggccacggctggagctgggcgtcttctgcccgccgctcggcccagcgcgcctgcaggccgggagtcccagccccggggccggctgtcggggcgctgtggggctcggcgtggccgggctttcggggcgccgctga

SEQ ID NO: 4351 - protein, 74 aa, homo sapiens [sequence omitted]

SEQ ID NO: 4352 - DNA, 225 bp, homo sapiens
atggggactcagcgcagaaatgcccatggtcctggggattctgagcaagaaggatccgtgcatctgggtgaggggggtctgtggccatgccttgccgcggggggcggagtggtgggaggaggcagtcgggctctggacccctgcccctccaggaggaacagaacccacagacagccccttgcccttggtggatctcccgatgcccccagcctgaggttcttgtaa

SEQ ID NO: 4353 - protein, 68 aa, homo sapiens
MVAGGLRADGRGVGRGGKHDGVSLGAVDAVDEELRCRGRSTSQVGPRLPLAQTSGAQADRDWPGAQAS

SEQ ID NO: 4354 - DNA, 207 bp, homo sapiens
atggtggcgggggggcttcgggcagacggcaggggtgtggggaggggagggaagcacgatggggtgagtctgggggccgtggatgccgttgacgaggagctgagatgccgtggccggtccacctcgcaggtggggccaaggctgcctctggctcagacgtcaggagcccaggcggacagggactggccaggggcgcaggcttcttag

SEQ ID NO: 4355 - protein, 6 aa, homo sapiens
MPLTRS

SEQ ID NO: 4356 - DNA, 21 bp, homo sapiens
atgccgttgacgaggagctga

SEQ ID NO: 4357 - protein, 124 aa, homo sapiens [sequence omitted]

SEQ ID NO: 4358 - DNA, 375 bp, homo sapiens
atgccgtggccggtccacctcgcaggtggggccaaggctgcctctggctcagacgtcaggagcccaggcggacagggactggccaggggcgcaggcttcttagaggatggggcaaaagtgaggaaaagatcctctgcagcctgggcagtgggtggtccccaggaaaccccctgggtcgtttgtccagtgcaccctcaccccaggaggctgctggacgtgccggaggatgccacagccaccggagctggttggggtccgagagcagatgggccaggggctggggcaggcttcgagaagagggttcgggcttggggaaagccttcgcagccatcggccagccaggaaggccccgttgccgggtgcagagctgagtag

SEQ ID NO: 4359 - protein, 4 aa, homo sapiens
MGQK

SEQ ID NO: 4360 - DNA, 15 bp, homo sapiens
atggggcaaaagtga

SEQ ID NO: 4361 - protein, 171 aa, homo sapiens [sequence omitted]

SEQ ID NO: 4362 - DNA, 516 bp, homo sapiens
atgacagctggtcttgggcacattgctctccattcagaaaggccccagcccctggcattcttccaggagggggcttgctttgccgccctgcagggggactctgcagagccggcctctgccatctcatgtccaggaccacaacctgtggccccggcctgcgccgggccggagctccgcagaaggaagccagcgggaggcctcctgcctttgactgccgtgcgtccagcctgcagcgggcctcagggggccgcctcgatccagcctgcccgaggctcccaggccttcgcccgccttgcgtccagcctgccgggggctcccaggccggcgcccgagctctggctccgtgtcttcactcccgtgcttgtccgaggagggagggagggacgggggctgtgctggggcagctggaacaacgcaggtcgccgggccggctgggcgagttggccgggcggggctgaggggtcggcgggggaggctgaggcgcgggggccggtgcgcggccgtgagggggtgtga

SEQ ID NO: 4363 - protein, 110 aa, homo sapiens
MSRTTTCGPGLRRAGAPQKEASGRPPAFDCRASSLQRASGGRLDPACPRLPGLRPPCVQPAGGSQAGARALAPCLHSRACPRREGGTGAVLGQLEQRRSPGRLGELAGRG

SEQ ID NO: 4364 - DNA, 333 bp, homo sapiens
atgtccaggaccacaacctgtggccccggcctgcgccgggccggagctccgcagaaggaagccagcgggaggcctcctgcctttgactgccgtgcgtccagcctgcagcgggcctcagggggccgcctcgatccagcctgcccgaggctcccaggccttcgcccgccttgcgtccagcctgccgggggctcccaggccggcgcccgagctctggctccgtgtcttcactcccgtgcttgtccgaggagggagggagggacgggggctgtgctggggcagctggaacaacgcaggtcgccgggccggctgggcgagttggccgggcggggctga

SEQ ID NO: 4365 - protein, 39 aa, homo sapiens
MPLVSLSRLRGGGWGVGPPGPREGGAQEEPAGDATHPPP

SEQ ID NO: 4366 - DNA, 120 bp, homo sapiens
atgcctctcgtcagcctctcccgtctgcgtggtgggggctggggagtgggtccgccgggacctcgcgagggaggggcacaggaggagccggcgggggacgccacccaccctcctccctag

SEQ ID NO: 4367 - protein, 31 aa, homo sapiens
MCPADLCSPGLGSLDGCTGPHHSPHPRRDAS

SEQ ID NO: 4368 - DNA, 96 bp, homo sapiens
atgtgtccggctgacctgtgctctcctggtctgggcagcctggatgggtgcacagggccccatcacagcccacaccctcggagagacgcctcctga

SEQ ID NO: 4369 - protein, 36 aa, homo sapiens
MALSPNPCTSAGLRPWYRPGGQGPGDPGTGRPQGVR

SEQ ID NO: 4370 - DNA, 111 bp, homo sapiens
atggccctgtctcccaacccttgtaccagtgctgggctcagaccctggtacaggcctgggggacagggacctggggaccccggcaccggcaggccccaaggggtgaggtga

SEQ ID NO: 4371 - protein, 104 aa, homo sapiens
MRLSPSGPTYPLVRSCLTAPTPCLSSPPLCDAQSTPVSIVPASRGGLCSPQLCKTPPPHVPQPWATVCPVLFLSRPPSLRPVCIGPSPDASCPLPSQQPGPRYH

SEQ ID NO: 4372 - DNA, 315 bp, homo sapiens
atgcgtctctccccttcgggtcccacatatcctctggtgcgctcctgcctcaccgcccccaccccatgcctgtcgtccccacctctgtgtgatgcgcaaagtacacctgtttctattgtacctgcctctcgcggtggtctgtgctctccccagctctgcaaaacccctcctccccatgtgccacaaccctgggccaccgtgtgtcctgtcctgttcctctcaaggcccccatctctgcggcctgtgtgtattgggccgtctccggacgcttcctgcccacttccttcccagcagcctgggccccggtaccactga

SEQ ID NO: 4373 - protein, 8 aa, homo sapiens
MPVVPTSV

SEQ ID NO: 4374 - DNA, 27 bp, homo sapiens
atgcctgtcgtccccacctctgtgtga

SEQ ID NO: 4375 - protein, 107 aa, homo sapiens
MRKVHLFLLYLPLAVVCALPSSAKPLLPMCHNPGPPCVLSCSSQGPHLCGLCVLGRLRTLPAHFLPSSLGPGTTEQAPGEPHDATCPHHQFPYCDFEAAGAEEVSRI

SEQ ID NO: 4376 - DNA, 324 bp, homo sapiens
atgcgcaaagtacacctgtttctattgtacctgcctctcgcggtggtctgtgctctccccagctctgcaaaacccctcctccccatgtgccacaaccctgggccaccgtgtgtcctgtcctgttcctctcaaggcccccatctctgcggcctgtgtgtattgggccgtctccggacgcttcctgcccacttccttcccagcagcctgggccccggtaccactgaacaggctccaggggagcctcatgatgccacttgcccacaccaccaatttccttactgcgattttgaggcagctggcgcagaggaagtttctagaatctga

SEQ ID NO: 4377 - protein, 35 aa, homo sapiens
MRRRPAPPAPPARVLGGGEAGGREEVGGPRGGREA

SEQ ID NO: 4378 - DNA, 108 bp, homo sapiens
atgcggcggagaccggcccctcccgcgcccccggcccgggttctgggaggaggggaggccggtggccgtgaggaggttgggggccctcgcggaggccgagaggcttaa

SEQ ID NO: 4379 - protein, 72 aa, homo sapiens
MPEKQKGRGRRRKREIAGTSAGFARTREGGSRRPDLRPPGAASRAAKGGLRAACRCPSPKPAVSPNANPQVW

SEQ ID NO: 4380 - DNA, 219 bp, homo sapiens
atgcctgaaaaacaaaaggggagaggcaggaggaggaagagggaaatcgcagggacgtcggcagggttcgcccggacgcgagagggaggctcgcgacggcccgacctccgtcccccgggcgcggcctcgcgggcagccaagggtgggctccgagcggcctgccggtgcccgagccccaagcccgccgtgtccccgaacgcaaaccctcaagtttggtag

SEQ ID NO: 4381 - protein, 4 aa, homo sapiens
MRLR

SEQ ID NO: 4382 - DNA, 15 bp, homo sapiens
atgagactaagataa

SEQ ID NO: 4383 - protein, 24 aa, homo sapiens
MGTGYTFKLKAEGSARVWGFVFKT

SEQ ID NO: 4384 - DNA, 75 bp, homo sapiens
atgggaactggttatacattcaagctgaaagctgaaggcagtgcaagagtttggggatttgtatttaagacttaa

SEQ ID NO: 4385 - protein, 140 aa, homo sapiens [sequence omitted]

SEQ ID NO: 4386 - DNA, 423 bp, homo sapiens
atgcagcggcccgaggctggccacgtccgcacccgggggagggggccgcggcggcaggccgggggccggcgccgcctgctcgagccggggagccctcggggctgcgggtacggagcgggcgggcgcggggatcccgggcggcgggagctgggcagggacagagcagggttagggggagcagccaactcagaactcgcgcgcccggcggctgggaactttgtgtcacccctgactggccccaggacccgggaggaaaagttcgtcccagcgccgaccggagaggaggcctgtcctgagtccgtcggcgcggggctgaagttctgggtccgtttggagtgggggtggcgggtgagttgcgattccgcggggagggtaaggagtggcctgtccgtcccagactcggctcccatcaccggtgggtga

SEQ ID NO: 4387 - protein, 55 aa, homo sapiens
MGMLLESTRARAWGRADSAGPARPGISWKKEARPAVPPGPGSVIHSDSGSGAVSA

SEQ ID NO: 4388 - DNA, 168 bp, homo sapiens
atgggcatgcttctggagtctacccgggccagggcctgggggcgcgctgatagcgcaggtccagcccggccagggatcagctggaagaaggaggctcggcccgctgtcccccccggcccaggttctgtgatacactccgactcgggctctggagcagtcagtgcatga

SEQ ID NO: 4389 - protein, 57 aa, homo sapiens
MTELGPGRTFCTQRAQRPLGACSGTSAWEWSGHLGWPMWHRAGQNQLWTLRTGVAGA

SEQ ID NO: 4390 - DNA, 174 bp, homo sapiens
atgacagaacttgggcccggaaggaccttctgcacccaacgggcacagcgcccactcggggcctgcagtggaacatctgcctgggagtggagtgggcacctgggttggcccatgtggcacagggctgggcagaaccagctgtggaccttgaggactggggttgctggggcctga

SEQ ID NO: 4391 - protein, 43 aa, homo sapiens
MYPRASRSHRHRVSTSSQGPNGTLLSGVSCRNLPSTPSRLFSS

SEQ ID NO: 4392 - DNA, 132 bp, homo sapiens
atgtatcctagggccagcagatcccatagacacagggtgtccacctcgagtcaggggccaaacggaactctcctctccggtgtcagttgcaggaaccttccctctacaccatcaaggctgttttcatcctag

SEQ ID NO: 4393 - protein, 259 aa, homo sapiens [sequence omitted]

SEQ ID NO: 4394 - DNA, 780 bp, homo sapiens
atgggcgggggcggagccggggtccgcccgccgctcggcctggagccccgggtcgggcctggagcctcggcctctgacttctggccgcccgctccagaccccacgctcccacccctaaaagcaggcctgaggctccggctgtgcccttccccgagcctccaccacccgcgtgggccagctccgcgccggccgctgctgctctgctccctccctctcacgctcccgggactggctccttctcctccacctgcttcctccagagggccctctgctttctgtctcccctccctctccaggacccctgcttcctttctccttccagttccctcctgccccgctgtctccaggccctgcactgcgctgccttgctgccccctccgtctctcactcccgcctgcccgtctcccctccttcatccctctccgtccctccttcatccctctccgtctcttcgcctcttttttctgtgtctttcattctttttcctttcctctttcttcctcttctctctccccatctctctctcactctgtctctgcctcaccctttccctctctctccatttctccctctccgcgcttctcttcctttctctctgccctctcccctgtttttctccacctccttcccctgtctgccagtttctctctgctgctctgtccgtctctccctctccctcccgctgcctgtctttcctctctctgtccttccctctcccttcttccctctttctctctctccctcacagctgccagtgtcatttttgtgatctgcagctag

SEQ ID NO: 4395 - protein, 58 aa, homo sapiens [sequence omitted]

SEQ ID NO: 4396 - DNA, 177 bp, homo sapiens
atggacagacaggacatgtggcccggggaccaccccgagctgggagcaaggggtacagggaagaggcaaagactgtcgaaaggagtgtgggaggatctctggattctggggggctcagtggagcaggtggggactagacaggggctacctgagggacttacccttttccaacactga

SEQ ID NO: 4397 - protein, 27 aa, homo sapiens
MSLGTGQRSRAGGGDMGIVSEPQDSSF

SEQ ID NO: 4398 - DNA, 84 bp, homo sapiens
atgtctctaggtactggacagaggagcagagctgggggtggggacatgggtatagtttctgaacctcaggacagcagtttctaa

SEQ ID NO: 4399 - protein, 4 aa, homo sapiens
MDLF

SEQ ID NO: 4400 - DNA, 15 bp, homo sapiens
atggatctgttttaa

SEQ ID NO: 4401 - protein, 69 aa, homo sapiens
MRRPRRPGGLGGSGGLRLLLCLLLLSSRPGGCSAVSAHGQEETWAGGWWGAGSSLGPGAKLGGGEGEMS

SEQ ID NO: 4402 - DNA, 210 bp, homo sapiens
atgcggcgcccgcggcggcctgggggtctcgggggatccgggggtctccggctgctcctctgcctcctgctgctgagcagccgcccggggggctgcagcgccgttagtgcccacggtcaggaggaaacttgggctggcgggtggtggggggcggggagcagcttggggcctggagcgaaactcggtgggggtgagggtgaaatgtcatga

SEQ ID NO: 4403 - protein, 14 aa, homo sapiens
MKLGENMGWGRHAR

SEQ ID NO: 4404 - DNA, 45 bp, homo sapiens
atgaagctcggggagaatatgggttgggggaggcatgcgagatga

SEQ ID NO: 4405 - protein, 15 aa, homo sapiens
MRDEEGERASRRKGA

SEQ ID NO: 4406 - DNA, 48 bp, homo sapiens
atgcgagatgaggaaggtgagagggcgtctcggaggaaaggggcgtag

SEQ ID NO: 4407 - protein, 87 aa, homo sapiens [sequence omitted]

SEQ ID NO: 4408 - DNA, 264 bp, homo sapiens
atgaggaaggtgagagggcgtctcggaggaaaggggcgtaggcctggaggtggggctgggaatacgggggcgggacctaagagaattgggctctggggaaaattgcaggttcgggagaaggacacggggtgcatgtgggcagagggacttagagaccggctgcgagaccacaggagaagccacttgctccgaggcgcctgggaggtggtgacaggcgctgaggaatgggaaggggaggtggcggggagaatgagggaacggtga

SEQ ID NO: 4409 - protein, 25 aa, homo sapiens
MSTPVSVPSLRSSLPGEPGLRAHLV

SEQ ID NO: 4410 - DNA, 78 bp, homo sapiens
atgtccacacctgtctctgtcccctccctccgctcctccctgccaggtgaacctggtctccgagcacatctggtgtga

SEQ ID NO: 4411 - protein, 41 aa, homo sapiens
MTEESLPPQGPSWTSAGMTRGPPAGQCALSARHRGARLRCS

SEQ ID NO: 4412 - DNA, 126 bp, homo sapiens
atgaccgaggagtcccttcctcctcaaggtccctcctggacttccgcaggtatgacgcgcggcccgccggcagggcagtgcgcgctgagcgcgcggcacaggggagcgaggcttcggtgctcctga

SEQ ID NO: 4413 - protein, 45 aa, homo sapiens [sequence omitted]

SEQ ID NO: 4414 - DNA, 138 bp, homo sapiens
atgtgccacaggatattgatgcataaagctcggatgttcagttggattctcatctggctgcatgggatgaaagaggtagcgagcgcaggcccagataccaccctgcgtgatcttgcagggaagcccggagacacttag

SEQ ID NO: 4415 - protein, 46 aa, homo sapiens
MLDSVLQEEIDNEKKAAFKTTALIVVNSRSALARWWCLVNKPPQGK

SEQ ID NO: 4416 - DNA, 141 bp, homo sapiens
atgctagactctgtcttacaggaagaaattgacaatgaaaaaaaagcagcatttaagaccacagctttgattgtggtaaacagtcggtccgcattggctaggtggtggtgcttagtgaataaaccaccacaaggaaaatga

SEQ ID NO: 4417 - protein, 61 aa, homo sapiens [sequence omitted]

SEQ ID NO: 4418 - DNA, 186 bp, homo sapiens
atggggccgccgctcccgctgctgctgctgctactgctgctgctgccgccacgcgtcctgcctgccgccccttcgtccgtcccccgcggccggcagctcccggggcgtctgggtgagtggggggcgccgggggaggggcgcctcaatgaattagttgggggcgttgtgagaggggcgcctccgtga

SEQ ID NO: 4419 - protein, 8 aa, homo sapiens
MQGRRLNK

SEQ ID NO: 4420 - DNA, 27 bp, homo sapiens
atgcagggaaggcgcctcaataaatga

SEQ ID NO: 4421 - protein, 20 aa, homo sapiens
MSGGVGGGAPLRGSGGGTPQ

SEQ ID NO: 4422 - DNA, 63 bp, homo sapiens
atgagtgggggcgttgggggaggggcgcctctgagaggttctgggggagggacgcctcaatga

SEQ ID NO: 4423 - protein, 25 aa, homo sapiens
MNERGAWGEGRLNECGAWGKGRLNE

SEQ ID NO: 4424 - DNA, 78 bp, homo sapiens
atgaatgagaggggggcgtggggggaggggcgcctcaatgaatgcggggcgtgggggaaggggcgcctcaatgaatga

SEQ ID NO: 4425 - protein, 22 aa, homo sapiens
MDQGVEGGGCGPGVGRQSACSL

SEQ ID NO: 4426 - DNA, 69 bp, homo sapiens; identical to SEQ ID NO: 4146

SEQ ID NO: 4427 - protein, 28 aa, homo sapiens
MKDGKEGYRDRGRVGLRIARAAWHTVLG

SEQ ID NO: 4428 - DNA, 87 bp, homo sapiens; identical to SEQ ID NO: 4148

SEQ ID NO: 4429 - protein, 41 aa, homo sapiens; identical to SEQ ID NO: 4149

SEQ ID NO: 4430 - DNA, 126 bp, homo sapiens; identical to SEQ ID NO: 4150

SEQ ID NO: 4431 - protein, 16 aa, homo sapiens
MILFPLDPAPLVPFSL

SEQ ID NO: 4432 - DNA, 51 bp, homo sapiens; identical to SEQ ID NO: 4152

SEQ ID NO: 4433 - protein, 4 aa, homo sapiens
MSHK

SEQ ID NO: 4434 - DNA, 15 bp, homo sapiens
atgagtcacaagtga

SEQ ID NO: 4435 - protein, 16 aa, homo sapiens
MDSRGQRQGEGGVFET

SEQ ID NO: 4436 - DNA, 51 bp, homo sapiens
atggattcccgcgggcagaggcagggggaaggaggggtgttcgaaacctaa

SEQ ID NO: 4437 - protein, 7 aa, homo sapiens
MVGDVPV

SEQ ID NO: 4438 - DNA, 24 bp, homo sapiens
atggttggggacgtacctgtataa

SEQ ID NO: 4439 - protein, 15 aa, homo sapiens
MALDQLPCWSGQRSV

SEQ ID NO: 4440 - DNA, 48 bp, homo sapiens
atggccctggaccagcttccctgttggagtggccagagaagtgtgtaa

SEQ ID NO: 4441 - protein, 36 aa, homo sapiens
MKYKSEKKKTVLCQNASFPLCILAFENSEERFLFFI

SEQ ID NO: 4442 - DNA, 111 bp, homo sapiens
atgaagtacaaatcagaaaaaaaaaaaactgtactgtgtcagaatgcaagctttcctctttgcattttggcatttgaaaactccgaagagcggtttttgttttttatttaa

SEQ ID NO: 4443 - protein, 34 aa, homo sapiens [sequence omitted]

SEQ ID NO: 4444 - DNA, 105 bp, homo sapiens
atgcaagctttcctctttgcattttggcatttgaaaactccgaagagcggtttttgttttttatttaaagaagatgatacatatgtgtacccgattcaaaactag

SEQ ID NO: 4445 - protein, 12 aa, homo sapiens
MIHMCTRFKTRE

SEQ ID NO: 4446 - DNA, 39 bp, homo sapiens
atgatacatatgtgtacccgattcaaaactagagaatag

SEQ ID NO: 4447 - protein, 9 aa, homo sapiens
MPKGNNVIF

SEQ ID NO: 4448 - DNA, 30 bp, homo sapiens
atgcctaaaggtaacaatgtcatcttttaa

SEQ ID NO: 4449 - protein, 12 aa, homo sapiens
MRSLSAFGAIFE

SEQ ID NO: 4450 - DNA, 39 bp, homo sapiens
atgaggagcctcagcgctttcggcgccattttcgagtga

SEQ ID NO: 4451 - protein, 12 aa, homo sapiens
MPDLINLAGETG

SEQ ID NO: 4452 - DNA, 39 bp, homo sapiens
atgcctgatctcatcaatctagcgggagagacaggataa

SEQ ID NO: 4453 - protein, 8 aa, homo sapiens
MTPPEKLL

SEQ ID NO: 4454 - DNA, 27 bp, homo sapiens
atgactccgccggaaaaattactttaa

SEQ ID NO: 4455 - protein, 84 aa, homo sapiens
MWRERGETGLWGEGSCSLSGTRTGCGGAAAAQRICQQDPPPGTGAGDGALRGLCRRPLLDRRTGRAPLPHFRTGPPFLAVFSTR

SEQ ID NO: 4456 - DNA, 255 bp, homo sapiens
atgtggcgggagcgcggagagacggggctgtggggggaggggagctgcagtttgagcgggacgcggaccggctgcggcggagcagccgccgcccagcggatctgtcagcaagaccccccgcccgggaccggagccggggacggcgcactgcggggtctctgcaggcggccgctccttgacaggaggactggacgcgcgcccctcccccatttccgaaccgggccgccttttctcgccgttttctcgacccggtga

SEQ ID NO: 4457 - protein, 19 aa, homo sapiens
MLTQSINSGTKGPTSSELC

SEQ ID NO: 4458 - DNA, 60 bp, homo sapiens
atgttgacgcaatctataaatagtggaacaaaaggaccaacttcctcggagctttgctga

SEQ ID NO: 4459 - protein, 25 aa, homo sapiens
MGRGALRRGRGRARRRGPRRGGTPG

SEQ ID NO: 4460 - DNA, 78 bp, homo sapiens
atggggcggggagcgctgcgccgggggagggggcgggcgcggcggcgcgggccccgccgaggggggacacctggctga

SEQ ID NO: 4461 - protein, 104 aa, homo sapiens
MAGACAAAKDGGLACATRAVGRAEARAALLGSRRGSRLLLSPVGRPPEATRQGPEAAACASLPPSSDPAPQLRPLTAVGGWSREALSLHAAVPPGSGAHAASKH

SEQ ID NO: 4462 - DNA, 315 bp, homo sapiens
atggccggtgcctgcgccgcagccaaagacggaggactggcgtgcgccacccgggcggtagggagagcggaggcgcgggccgccttgctggggtcgaggaggggctcccggctgcttctctcgcccgtgggccgacccccggaggctacgcgtcagggcccggaggccgctgcatgcgcctcgctccctccgagctcggacccggcgcctcagcttcgtcctctaactgctgtgggaggatggagcagagaagcgctgtcgctgcacgccgccgtgccccctggctctggtgcccacgcagccagcaagcactga

SEQ ID NO: 4463 - protein, 175 aa, homo sapiens
MRLAPSELGPGASASSSNCCGRMEQRSAVAARRRAPWLWCPRSQQALSWGAGWNRGTLASRSLGPERERPPRRRGGSTGRGEGAELALLTAVPERGGRKLGRGGGGEVGVGAGGESARAGFGGERGAGSCDVQTPPLQAGCRGDVTTLDCRGWHFRSLPSCSPAPGTAGWSPFAV

SEQ ID NO: 4464 - DNA, 528 bp, homo sapiens
atgcgcctcgctccctccgagctcggacccggcgcctcagcttcgtcctctaactgctgtgggaggatggagcagagaagcgctgtcgctgcacgccgccgtgccccctggctctggtgcccacgcagccagcaagcactgagctggggggcagggtggaaccggggcacgctcgcttctcggagcctcggacctgagcgcgagcgcccgccgcgccgccgtggcggttccacagggcgcggggagggggcggagctggcgctgttgacagcggtgccggagcggggagggcgaaagttggggagagggggcgggggagaggtgggagtcggggctgggggagagagcgcgcgcgcgggcttcggcggggagaggggggccgggtcatgtgatgtacagacacccccgctacaggctggctgcaggggtgacgtcaccacccttgactgcagggggtggcacttccgctccctccccagctgctccccagcccctggcaccgccggctggagccctttcgcagtttga

SEQ ID NO: 4465 - protein, 22 aa, homo sapiens
MAVIIAALFFKLVDPRNHCAHL

SEQ ID NO: 4466 - DNA, 69 bp, homo sapiens
atggcggtgataatcgccgcactttttttcaaattagtggatcccagaaatcattgcgcgcatttgtaa

SEQ ID NO: 4467 - protein, 13 aa, homo sapiens
MSRGGPEPRRSFL

SEQ ID NO: 4468 - DNA, 42 bp, homo sapiens
atgtctcggggaggccctgagcctcgcagatcttttctttaa

SEQ ID NO: 4469 - protein, 22 aa, homo sapiens
MVYCPTGLRLGSWRDKLLPLQN

SEQ ID NO: 4470 - DNA, 69 bp, homo sapiens
atggtttactgtccaacgggactccgcctggggagctggagagacaaactcttgccactccaaaattag

SEQ ID NO: 4471 - protein, 10 aa, homo sapiens
MPRAVNGARS

SEQ ID NO: 4472 - DNA, 33 bp, homo sapiens
atgccccgggccgtcaacggcgccaggagctaa

SEQ ID NO: 4473 - protein, 12 aa, homo sapiens
MRSLSAFGAIFE

SEQ ID NO: 4474 - DNA, 39 bp, homo sapiens; identical to SEQ ID NO: 4450

SEQ ID NO: 4475 - protein, 12 aa, homo sapiens
MPDLINLAGETG

SEQ ID NO: 4476 - DNA, 39 bp, homo sapiens; identical to SEQ ID NO: 4452

SEQ ID NO: 4477 - protein, 8 aa, homo sapiens
MTPPEKLL

SEQ ID NO: 4478 - DNA, 27 bp, homo sapiens
atgactccgccggaaaaattactttaa

SEQ ID NO: 4479 - protein, 84 aa, homo sapiens; identical to SEQ ID NO: 4455

SEQ ID NO: 4480 - DNA, 255 bp, homo sapiens; identical to SEQ ID NO: 4456

SEQ ID NO: 4481 - protein, 19 aa, homo sapiens
MLTQSINSGTKGPTSSELC

SEQ ID NO: 4482 - DNA, 60 bp, homo sapiens; identical to SEQ ID NO: 4458

SEQ ID NO: 4483 - protein, 25 aa, homo sapiens
MGRGALRRGRGRARRRGPRRGGTPG

SEQ ID NO: 4484 - DNA, 78 bp, homo sapiens; identical to SEQ ID NO: 4460

SEQ ID NO: 4485 - protein, 104 aa, homo sapiens; identical to SEQ ID NO: 4461

SEQ ID NO: 4486 - DNA, 315 bp, homo sapiens; identical to SEQ ID NO: 4462

SEQ ID NO: 4487 - protein, 175 aa, homo sapiens; identical to SEQ ID NO: 4463

SEQ ID NO: 4488 - DNA, 528 bp, homo sapiens; identical to SEQ ID NO: 4464

SEQ ID NO: 4489 - protein, 22 aa, homo sapiens
MAVIIAALFFKLVDPRNHCAHL

SEQ ID NO: 4490 - DNA, 69 bp, homo sapiens; identical to SEQ ID NO: 4466

SEQ ID NO: 4491 - protein, 13 aa, homo sapiens
MSRGGPEPRRSFL

SEQ ID NO: 4492 - DNA, 42 bp, homo sapiens; identical to SEQ ID NO: 4468

SEQ ID NO: 4493 - protein, 22 aa, homo sapiens
MVYCPTGLRLGSWRDKLLPLQN

SEQ ID NO: 4494 - DNA, 69 bp, homo sapiens; identical to SEQ ID NO: 4470

SEQ ID NO: 4495 - protein, 10 aa, homo sapiens
MPRAVNGARS

SEQ ID NO: 4496 - DNA, 33 bp, homo sapiens; identical to SEQ ID NO: 4472

SEQ ID NO: 4497 - protein, 142 aa, homo sapiens
MVAATPPGESARPSGDGGKPVVCGPGLAGGAERPGADWPGAAWRRRRGRGGSRPLAAPACGSRIWLPPRSPAGRRRGAGPGREGGRGRRARGGRARDPRRPCLGRPEGGWADGEHNGPSGRGRARPVPSPGPGARAGRGVSG

SEQ ID NO: 4498 - DNA, 429 bp, homo sapiens
atggtggcggctactcctcctggtgagtctgcccgcccctccggcgacggagggaaacctgttgtgtgcggcccgggtctggcgggcggggcggagcggcccggggcggactggcccggggcagcgtggcggcggcggcgtggccggggcgggtctcggccgttggccgccccggcgtgtggcagccgcatctggctgccccctcgctcgcccgcgggccggcggaggggggcagggccggggcgggagggtgggagggggcggcgtgcgcgtggcggccgcgcccgggacccgcgcagaccctgcctgggccgacccgaaggcgggtgggcggacggcgaacacaatggcccctcggggagaggacgtgcgaggcccgtgccttctccggggcccggggcgcgcgcggggcgtggggtctctgggtag

SEQ ID NO: 4499 - protein, 36 aa, homo sapiens
MAPRGEDVRGPCLLRGPGRARGVGSLGRKVSPEGES

SEQ ID NO: 4500 - DNA, 111 bp, homo sapiens
atggcccctcggggagaggacgtgcgaggcccgtgccttctccggggcccggggcgcgcgcggggcgtggggtctctgggtaggaaagtttctcccgagggcgagagttaa

SEQ ID NO: 4501 - protein, 125 aa, homo sapiens [sequence omitted]

SEQ ID NO: 4502 - DNA, 378 bp, homo sapiens
atggggcaggccgcgggccgggagggggcgcgcccacgaggtacctgcgcgccagcgggcggcgtggcgtgggcgggagcccgcggttccccaaactttgtacgcgcgagggtgggcggaggggcgccgagatcggcgcggcctgggcgccacccccgctccgcgtgggctttgttagcccgcgtgggcagcctcggggcggggcccgcaacttccccgccgtggccctcggaggaggccgcagtcggcctcagccgcggcgtggagccgcctgcgcccggccgcttgctgggagtgtggcgcgggagggccagcccggctcggcgggagcggcgtccccgccgccatgttcctgcggggcgggctgcacgggggtga

SEQ ID NO: 4503 - protein, 123 aa, homo sapiens [sequence omitted]

SEQ ID NO: 4504 - DNA, 372 bp, homo sapiens
atgttcctgcggggcgggctgcacgggggtgagggcgggggacatggcggcgactgcgcgccgccgccgattgttcccggcttaggcctcgggccgcgtgcgacgggcaccgcggccgcggagcccccgcccctctgggccgggctcgggggggctgggggacacaaaggaggggcggcgcgcccgcgtccccgccgcactcgggcctcggcgccgccggtcgccgcgcggctgccgccgggaaacgggttgggggggttgccgcgtccggcggggcctgactctgacccgccgccccctggcggctacgcggagaatcgcagggccgcgctcccccttgtgcgacatgtgctgccggcccgggctccatga

SEQ ID NO: 4505 - protein, 36 aa, homo sapiens
MSLSVKTKKKLDTGTQARRGIEPRQISLQPCLLSSH

SEQ ID NO: 4506 - DNA, 111 bp, homo sapiens
atgagtttgtcagttaaaacaaaaaaaaaattagatactggaacccaggctagacgaggtattgaaccgcgccagatttccttgcagccctgtctgctcagctcgcattga

SEQ ID NO: 4507 - protein, 31 aa, homo sapiens
MTQMMDRSTFSHVHTGRKRICWSLAVQGFVF

SEQ ID NO: 4508 - DNA, 96 bp, homo sapiens
atgacccagatgatggacagaagcacatttagtcatgtgcacactggaagaaagcggatttgctggtccctggcagtgcaggggtttgtcttctga

SEQ ID NO: 4509 - protein, 25 aa, homo sapiens
MCTLEESGFAGPWQCRGLSSDWAVP

SEQ ID NO: 4510 - DNA, 78 bp, homo sapiens
atgtgcacactggaagaaagcggatttgctggtccctggcagtgcaggggtttgtcttctgattgggctgtgccctga

SEQ ID NO: 4511 - protein, 4 aa, homo sapiens
MKIG

SEQ ID NO: 4512 - DNA, 15 bp, homo sapiens
atgaaaattggatag

SEQ ID NO: 4513 - protein, 10 aa, homo sapiens
MPERKVESAS

SEQ ID NO: 4514 - DNA, 33 bp, homo sapiens
atgccggagaggaaggtagaaagtgcttcataa

SEQ ID NO: 4515 - protein, 15 aa, homo sapiens
MCGRMTVGFYSDRIS

SEQ ID NO: 4516 - DNA, 48 bp, homo sapiens
atgtgtggaagaatgactgtaggattttacagtgacagaattagttaa

SEQ ID NO: 4517 - protein, 10 aa, homo sapiens
MFFVFFSPFS

SEQ ID NO: 4518 - DNA, 33 bp, homo sapiens
atgttttttgtatttttttctcccttcagttaa

SEQ ID NO: 4519 - protein, 22 aa, homo sapiens
MTHFQILFLHLQRLYCSSKLIN

SEQ ID NO: 4520 - DNA, 69 bp, homo sapiens
atgacgcattttcaaattttatttttacatttacagagactttattgtagttctaaactaataaactaa

SEQ ID NO: 4521 - protein, 7 aa, homo sapiens
MSLWPIG

SEQ ID NO: 4522 - DNA, 24 bp, homo sapiens
atgtctttgtggccaataggatag

SEQ ID NO: 4523 - protein, 11 aa, homo sapiens
MTHCPCLSHGL

SEQ ID NO: 4524 - DNA, 36 bp, homo sapiens
atgactcactgcccctgtctttcacatgggctgtaa

SEQ ID NO: 4525 - protein, 22 aa, homo sapiens
MGCNLVQFRTADSTASTGARDV

SEQ ID NO: 4526 - DNA, 69 bp, homo sapiens
atgggctgtaatttagttcaattcagaactgcagatagtacagcttccacaggagcaagggatgtctga

SEQ ID NO: 4527 - protein, 10 aa, homo sapiens
MSEHKWLSSE

SEQ ID NO: 4528 - DNA, 33 bp, homo sapiens
atgtctgagcacaagtggctgagttccgagtga

SEQ ID NO: 4529 - protein, 13 aa, homo sapiens
MTKCASVHHLGHI

SEQ ID NO: 4530 - DNA, 42 bp, homo sapiens
atgactaaatgtgcttctgtccatcatctgggtcatatatag

SEQ ID NO: 4531 - protein, 77 aa, homo sapiens
MCFCPSSGSYIVQCELSRQGCKEIWRGSIPRLAWVPVSNFFFVLTDKLISLLGQDAVLAGSSISTARILSGNTEVVL

SEQ ID NO: 4532 - DNA, 234 bp, homo sapiens
atgtgcttctgtccatcatctgggtcatatatagttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctag

SEQ ID NO: 4533 - protein, 25 aa, homo sapiens
MRAEQTGLQGNLARFNTSSSLGSSI

SEQ ID NO: 4534 - DNA, 78 bp, homo sapiens
atgcgagctgagcagacagggctgcaaggaaatctggcgcggttcaatacctcgtctagcctgggttccagtatctaa

SEQ ID NO: 4535 - protein, 55 aa, homo sapiens
MLCWLEVPFLQQESYLETQKLSSSHSSSNFFDCRCCFLPSPPSPFDKDPTVKSLT

SEQ ID NO: 4536 - DNA, 168 bp, homo sapiens
atgctgtgctggctggaagttccatttctacagcaagaatcctatctggaaacacagaagttgtcctctagccacagcagctcgaacttttttgattgtcgttgctgctttctcccatcacccccatccccttttgacaaagatccaactgtaaaaagtcttacgtaa

SEQ ID NO: 4537 - protein, 31 aa, homo sapiens
MPVIPALWEAQELETNLANIVKPCLYSKYKN

SEQ ID NO: 4538 - DNA, 96 bp, homo sapiens
atgcctgtaatcccagcactttgggaggcccaggagttggagaccaacctggccaacatagtgaaaccctgtctctactcaaaatacaaaaattag

SEQ ID NO: 4539 - protein, 9 aa, homo sapiens
MGVSLCFPG

SEQ ID NO: 4540 - DNA, 30 bp, homo sapiens
atgggggtctcactgtgttttccaggctag

SEQ ID NO: 4541 - protein, 38 aa, homo sapiens
MGISCSQRDECSVIISNVIINTCAPNSLSFPSPRRSPP

SEQ ID NO: 4542 - DNA, 117 bp, homo sapiens
atgggtatatcctgctcacagcgtgatgaatgtagcgttatcatcagtaatgtaattattaacacctgtgctcccaactcactctccttcccaagtcctaggcgttctcctccttag

SEQ ID NO: 4543 - protein, 9 aa, homo sapiens
MNVALSSVM

SEQ ID NO: 4544 - DNA, 30 bp, homo sapiens
atgaatgtagcgttatcatcagtaatgtaa

SEQ ID NO: 4545 - protein, 31 aa, homo sapiens; identical to SEQ ID NO: 4537

SEQ ID NO: 4546 - DNA, 96 bp, homo sapiens; identical to SEQ ID NO: 4538

SEQ ID NO: 4547 - protein, 9 aa, homo sapiens
MGVSLCFPG

SEQ ID NO: 4548 - DNA, 30 bp, homo sapiens; identical to SEQ ID NO: 4540

SEQ ID NO: 4549 - protein, 38 aa, homo sapiens; identical to SEQ ID NO: 4541

SEQ ID NO: 4550 - DNA, 117 bp, homo sapiens; identical to SEQ ID NO: 4542

SEQ ID NO: 4551 - protein, 9 aa, homo sapiens
MNVALSSVM

SEQ ID NO: 4552 - DNA, 30 bp, homo sapiens; identical to SEQ ID NO: 4544

SEQ ID NO: 4553 - protein, 27 aa, homo sapiens
MCIFFIPRGASHSAHFANGKLRLREVK

SEQ ID NO: 4554 - DNA, 84 bp, homo sapiens
atgtgcattttcttcatccccagaggtgcgagtcattctgcccattttgcaaatgggaaactgaggcttagagaggtgaagtga

SEQ ID NO: 4555 - protein, 6 aa, homo sapiens
MPWGQG

SEQ ID NO: 4556 - DNA, 21 bp, homo sapiens
atgccatggggccagggttag

SEQ ID NO: 4557 - protein, 27 aa, homo sapiens
MGPGLAGEPHHSERGQWQNHGRISGSA

SEQ ID NO: 4558 - DNA, 84 bp, homo sapiens
atggggccagggttagcaggagaacctcaccattcggagaggggccaatggcagaaccacggccgcatcagtgggtctgcgtga

SEQ ID NO: 4559 - protein, 22 aa, homo sapiens
MAEPRPHQWVCVRGLYPGHLSP

SEQ ID NO: 4560 - DNA, 69 bp, homo sapiens
atggcagaaccacggccgcatcagtgggtctgcgtgaggggcttgtatcccgggcacctttccccctag

SEQ ID NO: 4561 - protein, 27 aa, homo sapiens
MCIFFIPRGASHSAHFANGKLRLREVK

SEQ ID NO: 4562 - DNA, 84 bp, homo sapiens; identical to SEQ ID NO: 4554

SEQ ID NO: 4563 - protein, 6 aa, homo sapiens
MPWGQG

SEQ ID NO: 4564 - DNA, 21 bp, homo sapiens
atgccatggggccagggttag

SEQ ID NO: 4565 - protein, 27 aa, homo sapiens
MGPGLAGEPHHSERGQWQNHGRISGSA

SEQ ID NO: 4566 - DNA, 84 bp, homo sapiens; identical to SEQ ID NO: 4558

SEQ ID NO: 4567 - protein, 22 aa, homo sapiens
MAEPRPHQWVCVRGLYPGHLSP

SEQ ID NO: 4568 - DNA, 69 bp, homo sapiens; identical to SEQ ID NO: 4560

SEQ ID NO: 4569 - protein, 24 aa, homo sapiens
MGKTWRSRSGCPRTAGDSRRRPWA

SEQ ID NO: 4570 - DNA, 75 bp, homo sapiens
atggggaaaacctggcgttcccgctctgggtgcccgaggacagcaggggattccaggaggagaccttgggcatag

SEQ ID NO: 4571 - protein, 16 aa, homo sapiens
MRPLPEDAGVAFVFCQ

SEQ ID NO: 4572 - DNA, 51 bp, homo sapiens
atgcgccccctgcctgaggatgctggggtagcctttgtgttttgtcagtga

SEQ ID NO: 4573 - protein, 31 aa, homo sapiens
MCSLRLGLGSPLEKSGWVVGEGRGLIPQTSL

SEQ ID NO: 4574 - DNA, 96 bp, homo sapiens
atgtgctctctgcgactgggtttagggtctccccttgagaaaagcggttgggtggttggtgagggaagggggcttattccacagacttctttataa

SEQ ID NO: 4575 - protein, 18 aa, homo sapiens
MLLSFSVYRNHVLRQKVS

SEQ ID NO: 4576 - DNA, 57 bp, homo sapiens
atgcttttgtctttttcggtttataggaaccatgtgctgagacagaaggtttcatga

SEQ ID NO: 4577 - protein, 59 aa, homo sapiens
MPKSQAGGANLGWESRADCHPPQLPQAQLGVIRHTVTMDFPKTGPSTSEGQTLGATPGP

SEQ ID NO: 4578 - DNA, 180 bp, homo sapiens
atgccaaaaagccaagctgggggagcaaacttggggtgggagagcagggctgactgtcatccacctcagcttccccaagctcagcttggggtcatcagacacactgtgaccatggatttcccaaaaactggtccctccacctctgagggccagaccctgggggccacaccagggccgtag

SEQ ID NO: 4579 - protein, 16 aa, homo sapiens
MPPPTSMLRGGGSRFP

SEQ ID NO: 4580 - DNA, 51 bp, homo sapiens
atgcctccccccacctcaatgctgagagggggaggatcccgttttccttag

SEQ ID NO: 4581 - protein, 280 aa, homo sapiens [sequence omitted]

SEQ ID NO: 4582 - DNA, 843 bp, homo sapiens
atgggctccagagaccctgcggcccgccctgcatacccgggggcaccgcgctcacaccgccacccgcccggccctggccccagcctgacgcagcccagccaggggcgcaagacaatagctgcctcgggccagcggctccgcggaacaaaagcgggtcctcccgggcaggccgacgccccgccctctgcctccgaccccgggccagggtccccccaagccaacttccctccaacctgtctgagttcggccggcatcgggccgggactcggggggcgctggccagcagcgggggaggcggtggctggaccaggctcggctccggcgcctcggccgctcgggctcaggctcggcggactcgctccccgcgggggcggatctggcggcggtcacggcgagcagccaatcgggcggggccgcgcccaggtggggcgtggcgggggccggggtgggcgtggcgggcggggggcgggcaatgtgaggtcccgccccccagagacagggggcggggccctgcagccccgggtcgccccctgtccccccacttcccaccacctccccccacccactgccggcctggacttctgctccctccccctccctgcggcaggggtgtcactttcccgccgaaagactttggccaagtccttcccaggcctcggtttggcctcggtttatgaccacacttcagtccgcctgcaaagggggaaacagttccggcagggcaggtgcccgtgctgcgatgcacagagcacaaggcctccctcactggcacaaacctggctgcgactcagtttcacctgccatgaaatgggggccgatgagacagtagtcacggctctgtga

SEQ ID NO: 4583 - protein, 51 aa, homo sapiens
MTTLQSACKGGNSSGRAGARAAMHRAQGLPHWHKPGCDSVSPAMKWGPMRQ

SEQ ID NO: 4584 - DNA, 156 bp, homo sapiens
atgaccacacttcagtccgcctgcaaagggggaaacagttccggcagggcaggtgcccgtgctgcgatgcacagagcacaaggcctccctcactggcacaaacctggctgcgactcagtttcacctgccatgaaatgggggccgatgagacagtag

SEQ ID NO: 4585 - protein, 18 aa, homo sapiens
MRGDDGLPLGLRDVSPGG

SEQ ID NO: 4586 - DNA, 57 bp, homo sapiens
atgcgcggagatgacggcttgccattgggcctccgggatgtcagtcccggcggatga

SEQ ID NO: 4587 - protein, 189 aa, homo sapiens
MTACHWASGMSVPADDRPPRGGAAAPHLPEPLRRRWQGTRDRSLPADLREHPPTIQPRAGTGRAGAPSPDSGRVASATTPSSQVSFFSACYSLRAARRSLLSTSNCILHASREREFCCYPHFTVGKQPQRGSHLLEHSRLTLGPGGSLILTPLGPRSGETMEVGAAVFPRAGRDPLGKPGAHLPHQAWM

SEQ ID NO: 4588 - DNA, 570 bp, homo sapiens
atgacggcttgccattgggcctccgggatgtcagtcccggcggatgaccggccccctcgcggaggggccgcggccccgcacctgcccgaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacaggtatccttcttcagcgcctgctactcgctgcgcgctgcgcgccgctccctcctgtcgacatcgaattgtattcttcacgcaagccgcgagagagagttctgctgctatccccattttacagttgggaaacagcctcagagaggttctcacttgcttgaacacagtcgtctgaccctggggcctgggggctctctcatcctcacgcccctgggtccccgcagcggggagacgatggaggtaggagctgcagtatttccgagggcaggaagggaccccctcggtaaaccaggggctcacctcccccaccaggcctggatgtag

SEQ ID NO: 4589 - protein, 59 aa, homo sapiens
MTGPLAEGPRPRTCPNLCGGGGRVRGTAPSQPTYENIPRPSSPEQGLAEPAPLPRTLAA

SEQ ID NO: 4590 - DNA, 180 bp, homo sapiens
atgaccggccccctcgcggaggggccgcggccccgcacctgcccgaacctctgcggcggcggtggcagggtacgcgggaccgctccctcccagccgacttacgagaacatcccccgaccatccagccccgagcagggactggcagagccggcgccccttccccggactctggccgcgtag

SEQ ID NO: 4591 - protein, 64 aa, homo sapiens
MGPPFLTSSWHSHSPTALRLGRQSCAFMPAPRTTVPFSSPYLESGRNGASLPVEIHVGYISLPD

SEQ ID NO: 4592 - DNA, 195 bp, homo sapiens
atggggccgccctttcttacctcctcctggcattctcacagccccacagctctgcgtctggggaggcagagttgtgcgtttatgcccgcaccccgtactactgtcccattttcttcaccctacctggagtcaggaagaaacggtgcttcactgcctgttgagattcacgtaggttacatttccttgccagattaa

SEQ ID NO: 4593 - protein, 32 aa, homo sapiens
MVNAPASGWAVLGWLRWRAGAAPGSRRRWRRR

SEQ ID NO: 4594 - DNA, 99 bp, homo sapiens
atggtgaacgcgccggcttcgggctgggcggtactgggctggctgcggtggcgcgcgggcgcggcacccggaagtcggcggcggtggcggaggcggtga

SEQ ID NO: 4595 - protein, 79 aa, homo sapiens [sequence omitted]

SEQ ID NO: 4596 - DNA, 240 bp, homo sapiens
atgccccgcgcgttactggaaggtgtttttgataatccccgctggcacgggatgcgagggactctggcaggtgggaccagactcgctgcggggaggctgagatcggcagggttgggagctgcgtggtccctgcagggtgtgtgggctgctcggccttggccagcatcagggacagctctggcgcccggtcactctgccccctacccgcggcctgctgcgggccagcagggtgacagctaa

SEQ ID NO: 4597 - protein, 10 aa, homo sapiens
MRPSWGGLGS

SEQ ID NO: 4598 - DNA, 33 bp, homo sapiens
atgcggccttcctggggaggtttgggtagttag

SEQ ID NO: 4599 - protein, 38 aa, homo sapiens
MSHALPWPGLFALSCGSRPADHCFAATLGTVPSSMRQM

SEQ ID NO: 4600 - DNA, 117 bp, homo sapiens
atgtcacatgccctgccctggccaggcctgtttgcactgtcgtgtggctctagacctgctgaccactgttttgctgccactctgggcacagtgccctcttccatgaggcagatgtga

SEQ ID NO: 4601 - protein, 19 aa, homo sapiens
MSTKNFRVSDGDWICPDKK

SEQ ID NO: 4602 - DNA, 60 bp, homo sapiens
atgtcgaccaagaatttccgagtcagtgacggggactggatttgccctgacaaaaagtga

SEQ ID NO: 4603 - protein, 166 aa, homo sapiens [sequence omitted]

SEQ ID NO: 4604 - DNA, 501 bp, homo sapiens
atgattttctgtgccttaagacgggttgaggcggcgaaccgccagttccctggcgggaagaaggctcccaatctcctcacgagagaggtctttccgggagcctttgttctagatatgtcttcagcgtttcctcgacattacctccgcaaggtagcctctctttttagagtgcgagatggcctacctttttgcccccacccccctcccccgccccggccaggttttagcgataggaaacctctccagtcaggccagcttggtgttggatctcccccacgtgacttttctctgcagaactttactcttgttcacggaaaatattgctttctcgcactcgtccttttgcctcttatagttcaccttgttttgtatttttactcaaacttttcctccatactattttccccttttccggaagctctaccctcttcggtttgggaaattctgacattttctttgtggatcatttctccacaagaattgggcttttcgcctccttag

SEQ ID NO: 4605 - protein, 59 aa, homo sapiens
MAYLFAPTPLPRPGQVLAIGNLSSQASLVLDLPHVTFLCRTLLLFTENIAFSHSSFCLL

SEQ ID NO: 4606 - DNA, 180 bp, homo sapiens
atggcctacctttttgcccccacccccctcccccgccccggccaggttttagcgataggaaacctctccagtcaggccagcttggtgttggatctcccccacgtgacttttctctgcagaactttactcttgttcacggaaaatattgctttctcgcactcgtccttttgcctcttatag

SEQ ID NO: 4607 - protein, 9 aa, homo sapiens
MPAAEKHVC

SEQ ID NO: 4608 - DNA, 30 bp, homo sapiens
atgcctgcagcagagaagcacgtgtgttag

SEQ ID NO: 4609 - protein, 7 aa, homo sapiens
MSCYLLM

SEQ ID NO: 4610 - DNA, 24 bp, homo sapiens
atgagttgctatctcttaatgtga

SEQ ID NO: 4611 - protein, 20 aa, homo sapiens
MGEERPQASLLRGKESLLTG

SEQ ID NO: 4612 - DNA, 63 bp, homo sapiens
atgggggaggaaagaccccaagcttctctccttagagggaaggaatccttacttacaggttag

SEQ ID NO: 4613 - protein, 58 aa, homo sapiens
MDPCAPLPIPQAKGSEGRARSPRLAFGGTGLEGPLGAQRPREIEYLYAQQPSLSRRTE

SEQ ID NO: 4614 - DNA, 177 bp, homo sapiens
atggatccctgcgccccgctgccaattccccaagcaaagggaagcgaggggagagcgcggagcccccgattagcgttcggaggaactggcctagaggggccactcggagcgcaaaggccccgcgaaatagaatatctatacgcccagcaaccctccctttcgaggcgcacggaataa

SEQ ID NO: 4615 - protein, 11 aa, homo sapiens
MSVRPSPRGTR

SEQ ID NO: 4616 - DNA, 36 bp, homo sapiens
atgagcgtacgcccaagcccgcgggggaccaggtga

SEQ ID NO: 4617 - protein, 16 aa, homo sapiens
MSRAPASLPLLPGWAV

SEQ ID NO: 4618 - DNA, 51 bp, homo sapiens
atgagccgcgcgcccgcttcgctccccctcctccccggctgggctgtgtga

SEQ ID NO: 4619 - protein, 41 aa, homo sapiens
MKLCRLRGALTQLGVLDARADRARCPPAADTGSAAPDLGDR

SEQ ID NO: 4620 - DNA, 126 bp, homo sapiens
atgaagctctgccggctacgtggggcgctcactcaacttggtgtcctggacgccagagccgaccgagcgcgctgcccaccggcggcggacacgggctccgccgctccggacctcggcgacaggtaa

SEQ ID NO: 4621 - protein, 13 aa, homo sapiens
MGLPRARRWQPGA

SEQ ID NO: 4622 - DNA, 42 bp, homo sapiens
atggggcttccccgcgcccggcgttggcagcccggcgcttag

SEQ ID NO: 4623 - protein, 36 aa, homo sapiens
MVPGLPERSFLAERRQARPAFESECLAACVPFPGLG

SEQ ID NO: 4624 - DNA, 111 bp, homo sapiens
atggtccctgggttgcccgagcgaagtttccttgcggagcggcgccaagcccgccccgcttttgaatcggagtgtttagccgcctgcgtcccctttcccggactggggtag

SEQ ID NO: 4625 - protein, 142 aa, homo sapiens; identical to SEQ ID NO: 4497

SEQ ID NO: 4626 - DNA, 429 bp, homo sapiens; identical to SEQ ID NO: 4498

SEQ ID NO: 4627 - protein, 36 aa, homo sapiens; identical to SEQ ID NO: 4499

SEQ ID NO: 4628 - DNA, 111 bp, homo sapiens; identical to SEQ ID NO: 4500

SEQ ID NO: 4629 - protein, 125 aa, homo sapiens [sequence omitted]

SEQ ID NO: 4630 - DNA, 378 bp, homo sapiens; identical to SEQ ID NO: 4502

SEQ ID NO: 4631 - protein, 123 aa, homo sapiens [sequence omitted]

SEQ ID NO: 4632 - DNA, 372 bp, homo sapiens; identical to SEQ ID NO: 4504

SEQ ID NO: 4633 - protein, 5 aa, homo sapiens
MGGGE

SEQ ID NO: 4634 - DNA, 18 bp, homo sapiens
atggggggtggcgaatag

SEQ ID NO: 4635 - protein, 7 aa, homo sapiens
MSCLMNC

SEQ ID NO: 4636 - DNA, 24 bp, homo sapiens
atgtcttgtttaatgaactgctaa

SEQ ID NO: 4637 - protein, 15 aa, homo sapiens
MSLLGSYFYLFPLIG

SEQ ID NO: 4638 - DNA, 48 bp, homo sapiens; identical to SEQ ID NO: 3910

SEQ ID NO: 4639 - protein, 16 aa, homo sapiens
MISSFPTFFCLSNQDT

SEQ ID NO: 4640 - DNA, 51 bp, homo sapiens; identical to SEQ ID NO: 3912

SEQ ID NO: 4641 - protein, 78 aa, homo sapiens [sequence omitted]

SEQ ID NO: 4642 - DNA, 237 bp, homo sapiens
atggtggccctgtccttaaagatttgtgtgcgccactgcaacgtggtgaagaccatgcagtttgaaccatctacagctgtgtacgatgcgtgtcgagtcattcgggaacgggtgcctgaggcacaaactgggcaaggtaggtcatgggttatttactggcttcttaaaacgtgtttgcatgtttttcacttttttgctaaagagacagaggctccaagtggtacacaagcctattag

SEQ ID NO: 4643 - protein, 60 aa, homo sapiens
MRVESFGNGCLRHKLGKVGHGLFTGFLKRVCMFFTFLLKRQRLQVVHKPISAYVSNEIPS

SEQ ID NO: 4644 - DNA, 183 bp, homo sapiens
atgcgtgtcgagtcattcgggaacgggtgcctgaggcacaaactgggcaaggtaggtcatgggttatttactggcttcttaaaacgtgtttgcatgtttttcacttttttgctaaagagacagaggctccaagtggtacacaagcctattagtgcatatgtttcaaatgaaataccttcttag

SEQ ID NO: 4645 - protein, 7 aa, homo sapiens
MGYLLAS

SEQ ID NO: 4646 - DNA, 24 bp, homo sapiens
atgggttatttactggcttcttaa

SEQ ID NO: 4647 - protein, 28 aa, homo sapiens
MFQMKYLLRSDTTCFLCETCDYSDHAHC

SEQ ID NO: 4648 - DNA, 87 bp, homo sapiens
atgtttcaaatgaaataccttcttagatcagacactacctgcttcctctgtgagacttgtgattacagtgaccatgcccactgctga

SEQ ID NO: 4649 - protein, 18 aa, homo sapiens
MTMGIHEAITNTFALTRR

SEQ ID NO: 4650 - DNA, 57 bp, homo sapiens
atgacaatgggaattcatgaagctataaccaacacttttgcactaacaagacgatag

SEQ ID NO: 4651 - protein, 22 aa, homo sapiens
MPEFLFTTKNKLFNFCHLTCQR

SEQ ID NO: 4652 - DNA, 69 bp, homo sapiens
atgcctgaatttctattcacaactaaaaacaaacttttcaacttctgccatcttacctgccaaagataa

SEQ ID NO: 4653 - protein, 6 aa, homo sapiens
MNEEQF

SEQ ID NO: 4654 - DNA, 21 bp, homo sapiens
atgaatgaagaacagttctaa

SEQ ID NO: 4655 - protein, 10 aa, homo sapiens
MKNSSNASEV

SEQ ID NO: 4656 - DNA, 33 bp, homo sapiens
atgaagaacagttctaatgcctccgaagtatag

SEQ ID NO: 4657 - protein, 9 aa, homo sapiens
MGEVYKLLC

SEQ ID NO: 4658 - DNA, 30 bp, homo sapiens
atgggagaagtgtataaattattatgttga

SEQ ID NO: 4659 - protein, 10 aa, homo sapiens
MLISKISAKG

SEQ ID NO: 4660 - DNA, 33 bp, homo sapiens
atgttgataagcaagataagtgccaaagggtag

SEQ ID NO: 4661 - protein, 10 aa, homo sapiens
MRAAPVTRPS

SEQ ID NO: 4662 - DNA, 33 bp, homo sapiens
atgagagcagctccagttactcggccttcatga

SEQ ID NO: 4663 - protein, 22 aa, homo sapiens
MTQEVEGGTGIGLQRKGQHQPV

SEQ ID NO: 4664 - DNA, 69 bp, homo sapiens
atgacacaggaagttgaaggtggcacaggcattgggctgcaaagaaaaggccagcatcagcctgtctag

SEQ ID NO: 4665 - protein, 107 aa, homo sapiens
MGSQGSRVGRAGWVPEAEAQCTSGAQRAAMLEQRRRRRGASWVPAAAPVGWSRGPSRAAEGRPARRQGGRASGQLFPDPRPPPAWPRPPTPPPPRAQRPHPGAVRSR

SEQ ID NO: 4666 - DNA, 324 bp, homo sapiens
atggggtctcaggggtcaagggtcggtagggcgggctgggtcccggaagcggaagcgcagtgcacttccggcgcgcagcgggcggccatgttggagcagcggaggcggcgcagaggcgcgtcttgggtccccgcggcggcgccggtaggttggagccgcgggcctagccgcgccgcggaggggcggcccgcgaggcggcagggcggacgggcaagcggccaactcttcccggacccgcgtcctccgccggcctggccgagaccccccaccccacccccaccccgcgcccagcgaccccaccctggggctgtgcggtcccggtag

SEQ ID NO: 4667 - protein, 67 aa, homo sapiens
MCKDCAWRTVSGEGKCPRHLRIQECFQTKSPRAFPPGYSEDFICCIRAVGRNYTDGPHGPRDLPDPG

SEQ ID NO: 4668 - DNA, 204 bp, homo sapiens
atgtgcaaggattgtgcttggagaacggtctctggggaggggaagtgcccaagacacctgaggatccaagaatgtttccaaacaaagagccctagggcatttcctccagggtattctgaagacttcatctgctgcattagagcggtgggaagaaactacacagacgggcctcatggcccgagggacctgcctgatcctggctga

SEQ ID NO: 4669 - protein, 7 aa, homo sapiens
MFPNKEP

SEQ ID NO: 4670 - DNA, 24 bp, homo sapiens
atgtttccaaacaaagagccctag

SEQ ID NO: 4671 - protein, 40 aa, homo sapiens
MARGTCLILADLLMLWCSWGAASCFWEPSVLGWVLDVSYD

SEQ ID NO: 4672 - DNA, 123 bp, homo sapiens
atggcccgagggacctgcctgatcctggctgatcttttaatgctctggtgcagctggggagctgcctcttgcttctgggaaccctcagtgttgggttgggtattagatgttagttatgattga

SEQ ID NO: 4673 - protein, 16 aa, homo sapiens
MGKPRLGLGIREPSPC

SEQ ID NO: 4674 - DNA, 51 bp, homo sapiens; identical to SEQ ID NO: 2698

SEQ ID NO: 4675 - protein, 96 aa, homo sapiens [sequence omitted]

SEQ ID NO: 4676 - DNA, 291 bp, homo sapiens; identical to SEQ ID NO: 2700

SEQ ID NO: 4677 - protein, 28 aa, homo sapiens
MGPSLMLPGPAPPCPGTVQGFLPFEPHL

SEQ ID NO: 4678 - DNA, 87 bp, homo sapiens; identical to SEQ ID NO: 2702

SEQ ID NO: 4679 - protein, 22 aa, homo sapiens
MGWPGRAPSSLCLGFHCGIRGP

SEQ ID NO: 4680 - DNA, 69 bp, homo sapiens; identical to SEQ ID NO: 2704

SEQ ID NO: 4681 - protein, 60 aa, homo sapiens
MGKLRPAAGALHRAGARPGSGAAGRGLPAPVSAGGSAGSCSDGSKEEKGKLLGSGAGRTA

SEQ ID NO: 4682 - DNA, 183 bp, homo sapiens
atggggaagttgaggccggcggcaggcgcgctccaccgggcgggggcgcggcccgggagcggagcggccggcagggggctccccgcgccggtctccgcgggaggaagcgctggcagctgctcggacgggtcaaaggaggaaaagggaaaattactgggctccggggcgggaaggactgcgtga

SEQ ID NO: 4683 - protein, 38 aa, homo sapiens
MCHQHVEPGRAAASKPTPPTFEGSRRPAPLPASSGSLS

SEQ ID NO: 4684 - DNA, 117 bp, homo sapiens
atgtgtcaccagcacgtggagccaggtcgggccgcggcgagcaagccgacccccccaactttcgaggggtctcgccgccccgctcctctcccggcttcgtcgggctcgctctcctag

SEQ ID NO: 4685 - protein, 38 aa, homo sapiens
MAPVPRQRCGLGLAGGCGLLREVGHGSCPAPRAPRPPS

SEQ ID NO: 4686 - DNA, 117 bp, homo sapiens
atggcccccgtgcccaggcagcggtgcgggctcggccttgcgggagggtgcggcctgctgcgagaggtcggccacggctcctgccccgcgccccgcgcccctcgcccgccgagctga

SEQ ID NO: 4687 - protein, 72 aa, homo sapiens
MGAEGWVFAGEMRVSDQLAYKVPVLGPRDQRLLPGPRPRPASSRAGVRSGQAASQVHAGEGVVRCARPGCVR

SEQ ID NO: 4688 - DNA, 219 bp, homo sapiens
atgggagctgagggctgggtctttgcgggcgagatgagggtgtcggatcaactggcctacaaagtcccagttctcggcccccgggaccagcgtcttctccccggtcctcgccccaggccggcttcctcccgggctggcgtgcgctccggccaggctgcctctcaggtccacgctggagaaggagtggtgaggtgcgctcgccccggctgcgtgcggtga

SEQ ID NO: 4689 - protein, 38 aa, homo sapiens; identical to SEQ ID NO: 4683

SEQ ID NO: 4690 - DNA, 117 bp, homo sapiens; identical to SEQ ID NO: 4684

SEQ ID NO: 4691 - protein, 38 aa, homo sapiens; identical to SEQ ID NO: 4685

SEQ ID NO: 4692 - DNA, 117 bp, homo sapiens; identical to SEQ ID NO: 4686

SEQ ID NO: 4693 - protein, 72 aa, homo sapiens; identical to SEQ ID NO: 4687

SEQ ID NO: 4694 - DNA, 219 bp, homo sapiens; identical to SEQ ID NO: 4688

SEQ ID NO: 4695 - protein, 32 aa, homo sapiens
MGQALPLTEACPAVLSRAATLSLGVGRTGPDF

SEQ ID NO: 4696 - DNA, 99 bp, homo sapiens
atgggccaagccctgccacttaccgaggcctgccctgctgtgctttccagggcggcaaccttgagcttgggggtggggagaacggggcctgacttctag

SEQ ID NO: 4697 - protein, 49 aa, homo sapiens; identical to SEQ ID NO: 393

SEQ ID NO: 4698 - DNA, 150 bp, homo sapiens; identical to SEQ ID NO: 394

SEQ ID NO: 4699 - protein, 77 aa, homo sapiens; identical to SEQ ID NO: 395

SEQ ID NO: 4700 - DNA, 234 bp, homo sapiens; identical to SEQ ID NO: 396

SEQ ID NO: 4701 - protein, 15 aa, homo sapiens
MGGGACGGRAPGIPD

SEQ ID NO: 4702 - DNA, 48 bp, homo sapiens; identical to SEQ ID NO: 398

SEQ ID NO: 4703 - protein, 13 aa, homo sapiens
MRRLCPLRTHPYL

SEQ ID NO: 4704 - DNA, 42 bp, homo sapiens; identical to SEQ ID NO: 400

SEQ ID NO: 4705 - protein, 40 aa, homo sapiens
MSTGLTEMNALDPIHLPFICSCALFSYKVDGLFRFPLGNV

SEQ ID NO: 4706 - DNA, 123 bp, homo sapiens
atgtccacgggcctgacagaaatgaatgctctggaccccatccacttgcctttcatttgttcctgtgcccttttttcatacaaagtggatggcctctttaggtttcctttaggaaatgtgtaa

SEQ ID NO: 4707 - protein, 28 aa, homo sapiens
MLWTPSTCLSFVPVPFFHTKWMASLGFL

SEQ ID NO: 4708 - DNA, 87 bp, homo sapiens
atgctctggaccccatccacttgcctttcatttgttcctgtgcccttttttcatacaaagtggatggcctctttaggtttcctttag

SEQ ID NO: 4709 - protein, 13 aa, homo sapiens
MCKCLQAFVLTLK

SEQ ID NO: 4710 - DNA, 42 bp, homo sapiens
atgtgtaagtgcctacaggcctttgtgctcacattaaaataa

SEQ ID NO: 4711 - protein, 16 aa, homo sapiens
MAFVTIQMNNVKYFQK

SEQ ID NO: 4712 - DNA, 51 bp, homo sapiens
atggcatttgtgactatccaaatgaacaatgtaaagtactttcaaaaatag

SEQ ID NO: 4713 - protein, 16 aa, homo sapiens
MGKPRLGLGIREPSPC

SEQ ID NO: 4714 - DNA, 51 bp, homo sapiens; identical to SEQ ID NO: 2698

SEQ ID NO: 4715 - protein, 96 aa, homo sapiens [sequence omitted]

SEQ ID NO: 4716 - DNA, 291 bp, homo sapiens; identical to SEQ ID NO: 2700

SEQ ID NO: 4717 - protein, 28 aa, homo sapiens
MGPSLMLPGPAPPCPGTVQGFLPFEPHL

SEQ ID NO: 4718 - DNA, 87 bp, homo sapiens; identical to SEQ ID NO: 2702

SEQ ID NO: 4719 - protein, 22 aa, homo sapiens
MGWPGRAPSSLCLGFHCGIRGP

SEQ ID NO: 4720 - DNA, 69 bp, homo sapiens; identical to SEQ ID NO: 2704

SEQ ID NO: 4721 - protein, 21 aa, homo sapiens
MGWDGFWGGVPNSDWEWRNPS

SEQ ID NO: 4722 - DNA, 66 bp, homo sapiens
atgggctgggacgggttttgggggggtgtccccaattctgactgggagtggaggaacccctcctga

SEQ ID NO: 4723 - protein, 13 aa, homo sapiens
MRLGRLLSPAPQM

SEQ ID NO: 4724 - DNA, 42 bp, homo sapiens
atgcgactggggcggctcctttctcctgcaccccaaatgtga

SEQ ID NO: 4725 - protein, 59 aa, homo sapiens [sequence omitted]

SEQ ID NO: 4726 - DNA, 180 bp, homo sapiens
atgcaccctaaattttgctcttttcaaaataggggaccaggatctcaggggagagtagctgaggtaagtggggagggaagtgtcctctgttttcaggagagacgtggcggttgggggggaggtttggaggtgcgtgctggggtggggttggctttgtcagtcttggaattggggggatga

SEQ ID NO: 4727 - protein, 32 aa, homo sapiens
MIGEAFSYTPKLQPPRRKPKAETREPPNIPSR

SEQ ID NO: 4728 - DNA, 99 bp, homo sapiens
atgattggagaggctttctcttatacccctaaactgcagccccccagacggaaaccaaaggctgagaccagagagccccccaacatccccagccgttag

SEQ ID NO: 4729 - protein, 25 aa, homo sapiens
MGAGVSVSTCEQAGVWRGRGEERAR

SEQ ID NO: 4730 - DNA, 78 bp, homo sapiens
atgggtgcgggtgtgagcgtgagcacctgtgagcaggcgggtgtctggagaggcagaggtgaggagcgggcacgttag

SEQ ID NO: 4731 - protein, 52 aa, homo sapiens
MNCLTWGSSASAEPGPWDILGRVPSQQLFRSTGFPLQIPFFLCLFPRIPETF

SEQ ID NO: 4732 - DNA, 159 bp, homo sapiens
atgaattgtcttacctggggcagctcggcctctgcagagccagggccctgggacattttgggcagggtgccttcacagcaactgttcagatcaaccggctttcccctccaaatcccattcttcctctgtttgttccctagaattcccgaaactttctga

SEQ ID NO: 4733 - protein, 21 aa, homo sapiens
MHLRICLKLRILFICGDLQLG

SEQ ID NO: 4734 - DNA, 66 bp, homo sapiens
atgcaccttcgtatctgtttgaagttgagaattctttttatctgtggagacctccagctgggctga

SEQ ID NO: 4735 - protein, 28 aa, homo sapiens
MSLESELSGPAPKWFYLESWVQFFRCVV

SEQ ID NO: 4736 - DNA, 87 bp, homo sapiens
atgtctctggaatctgagctatcaggaccggctccaaaatggttttacctagagtcctgggttcagttcttccgatgtgttgtttag

SEQ ID NO: 4737 - protein, 51 aa, homo sapiens
MIKRGRDGNGRPKGAESLCGSSGWGKSWGPRTGTTAVASGHRSWNKVPPLS

SEQ ID NO: 4738 - DNA, 156 bp, homo sapiens
atgattaagagaggaagagatggcaatgggagacctaagggagcagagtcactctgtggcagctcaggttggggtaagagctgggggcccaggacagggaccactgcagtggcctctggccacagatcctggaacaaagtccctccactgagttga

SEQ ID NO: 4739 - protein, 43 aa, homo sapiens [sequence omitted]

SEQ ID NO: 4740 - DNA, 132 bp, homo sapiens
atggcaatgggagacctaagggagcagagtcactctgtggcagctcaggttggggtaagagctgggggcccaggacagggaccactgcagtggcctctggccacagatcctggaacaaagtccctccactga

SEQ ID NO: 4741 - protein, 44 aa, homo sapiens [sequence omitted]

SEQ ID NO: 4742 - DNA, 135 bp, homo sapiens
atgcttttccatctggttggatttttccagagctggaatggaacagagagaaggggggatctggcaaggtttagggaatctgccagggtcagccagctgggggaaagccagggtactcaggatcttttagattaa

SEQ ID NO: 4743 - protein, 30 aa, homo sapiens
MEQREGGIWQGLGNLPGSASWGKARVLRIF

SEQ ID NO: 4744 - DNA, 93 bp, homo sapiens
atggaacagagagaaggggggatctggcaaggtttagggaatctgccagggtcagccagctgggggaaagccagggtactcaggatcttttag

SEQ ID NO: 4745 - protein, 32 aa, homo sapiens
MAGFSPWRRRQRRRRRRRRARQPFAGSTRTGR

SEQ ID NO: 4746 - DNA, 99 bp, homo sapiens
atggcagggttctctccttggcggcggcggcagcggcggaggcggcggcggcggcgggcgaggcagcccttcgcgggcagcaccagaactggtcggtga

SEQ ID NO: 4747 - protein, 18 aa, homo sapiens
MITTGWRQPCVSSPVANG

SEQ ID NO: 4748 - DNA, 57 bp, homo sapiens
atgatcacgaccggatggcggcagccttgcgtttcttcgcctgtcgctaacggctga

SEQ ID NO: 4749 - protein, 11 aa, homo sapiens
MAAALRFFACR

SEQ ID NO: 4750 - DNA, 36 bp, homo sapiens
atggcggcagccttgcgtttcttcgcctgtcgctaa

SEQ ID NO: 4751 - protein, 23 aa, homo sapiens
MFHTAPLCSWVLEKGTLPRASMF

SEQ ID NO: 4752 - DNA, 72 bp, homo sapiens
atgttccatacagcacctttgtgcagctgggtgctggagaaggggacccttccaagagccagtatgttttaa

SEQ ID NO: 4753 - protein, 14 aa, homo sapiens
MRRYKPGWGFAAIS

SEQ ID NO: 4754 - DNA, 45 bp, homo sapiens
atgcgccgctataaacccggctggggttttgcagcgatttcttag

SEQ ID NO: 4755 - protein, 4 aa, homo sapiens
MRSQ

SEQ ID NO: 4756 - DNA, 15 bp, homo sapiens
atgagatctcaatag

SEQ ID NO: 4757 - protein, 53 aa, homo sapiens
MAHFRSMSKPPGSREPQHDSWPLFASDTKSSTVHYFTCPAPLHNRKRGLTLKK

SEQ ID NO: 4758 - DNA, 162 bp, homo sapiens
atggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtga

SEQ ID NO: 4759 - protein, 64 aa, homo sapiens [sequence omitted]

SEQ ID NO: 4760 - DNA, 195 bp, homo sapiens
atgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtga

SEQ ID NO: 4761 - protein, 18 aa, homo sapiens
MLIYILQGYPSRGGHPGD

SEQ ID NO: 4762 - DNA, 57 bp, homo sapiens
atgctgatttacatcctccagggatacccctccaggggaggccatccaggagactga

SEQ ID NO: 4763 - protein, 52 aa, homo sapiens [sequence omitted]

SEQ ID NO: 4764 - DNA, 159 bp, homo sapiens
atgtgggtgagggctgaccacctcccgggcgcccagaaaccccaggggccactcacaagctatctctggatccccaaggagtcccccagagttctaggtctggaagtctgtccctcccttcaaccaatgggcataagagtcggggggtgctatttttag

SEQ ID NO: 4765 - protein, 35 aa, homo sapiens
MSGKEVTGPVSLCSVVSSLDREESGSLGLSRGWLG

SEQ ID NO: 4766 - DNA, 108 bp, homo sapiens
atgtctgggaaagaggtcacaggaccagtatcattgtgctcagtggtgtccagcctggacagggaagagtcaggttcccttgggctcagcaggggttggcttggctga

SEQ ID NO: 4767 - protein, 11 aa, homo sapiens
MRWLGATDPET

SEQ ID NO: 4768 - DNA, 36 bp, homo sapiens
atgagatggttaggggcgactgacccagagacatag

SEQ ID NO: 4769 - protein, 15 aa, homo sapiens
MGRSWGGRQAGKERS

SEQ ID NO: 4770 - DNA, 48 bp, homo sapiens
atggggaggagctgggggggcaggcaggcggggaaggagaggtcttaa

SEQ ID NO: 4771 - protein, 77 aa, homo sapiens
MWKRWLALALALVAVAWVRAEVGEGPRSPNSVPGASWVCALGGWARVLGMLSRGGAGSFGPWGVLGWSWGSNAAYET

SEQ ID NO: 4772 - DNA, 234 bp, homo sapiens
atgtggaaacgctggctcgcgctcgcgctcgcgctggtggcggtcgcctgggtccgcgccgaggtaggcgaggggccgaggagtccgaactcggtccccggggcctcttgggtctgcgcgctgggcgggtgggcgcgcgtcctggggatgctctcccggggtggcgctgggagtttcggtccttggggtgtgctggggtggagctggggcagtaatgctgcttacgaaacttaa

SEQ ID NO: 4773 - protein, 13 aa, homo sapiens
MLLTKLKSLKQEK

SEQ ID NO: 4774 - DNA, 42 bp, homo sapiens
atgctgcttacgaaacttaaatctttaaagcaggaaaagtag

SEQ ID NO: 4775 - protein, 40 aa, homo sapiens
MEGERGGGEGTGWADGDEAATGAAASSKRRLSSVLHFRGD

SEQ ID NO: 4776 - DNA, 123 bp, homo sapiens
atggagggagagcggggaggaggagaggggacgggctgggccgacggggacgaggcggcgactggagcagcagcgagttcaaaaaggcgcctcagttccgtccttcacttcagaggagactga

SEQ ID NO: 4777 - protein, 74 aa, homo sapiens
MPHLELFTVRFRREISGRLPGAAGTHACARAHTHTHTCVCAPPPHPRPPKSQTFLLSPEATIPNPASCSASPTL

SEQ ID NO: 4778 - DNA, 225 bp, homo sapiens
atgccacatctggaactgtttacagtgcgattccgccgagaaatcagtggccgccttcctggtgctgccggcacgcacgcgtgcgcgcgcgcgcacacacacacacacacgtgtgtgtgcgcccctcctccccacccccgacccccaaagagtcagacattcctcctgagcccagaagccacgatcccaaaccctgcctcctgctccgcctcccccactctttag

SEQ ID NO: 4779 - protein, 30 aa, homo sapiens
MRAGPSLATSEGTERIVSGRVVVSLAAQRC

SEQ ID NO: 4780 - DNA, 93 bp, homo sapiens
atgcgagccggccccagccttgccacgtcagaagggacagagcggatcgtctcgggaagagtggtggtttccttggctgctcagaggtgctga

SEQ ID NO: 4781 - protein, 22 aa, homo sapiens
MDSRPRQPSVQTTCSGGSQCVQ

SEQ ID NO: 4782 - DNA, 69 bp, homo sapiens
atggatagccggccccgccaacccagtgttcagactacctgttcaggaggctctcaatgtgtacagtag

SEQ ID NO: 4783 - protein, 44 aa, homo sapiens [sequence omitted]

SEQ ID NO: 4784 - DNA, 135 bp, homo sapiens
atgtgtacagtagtctgcacattggttaggctgggcttgggtgagcggctcgtcgagacaggccccccaaactcgccggcaggtgagtgtcattttccaccaccccgtttcccactgtggcagagcctcgcatag

SEQ ID NO: 4785 - protein, 19 aa, homo sapiens
MHKEGSVIFQGIALIARYI

SEQ ID NO: 4786 - DNA, 60 bp, homo sapiens
atgcataaagaaggtagtgtaatctttcagggaattgccctaatagcaagatatatatag

SEQ ID NO: 4787 - protein, 13 aa, homo sapiens
MCVCVCVCVCVCV

SEQ ID NO: 4788 - DNA, 42 bp, homo sapiens
atgtgtgtgtgtgtgtgtgtgtgtgtgtgtgtgtgtgtgtaa

SEQ ID NO: 4789 - protein, 15 aa, homo sapiens
MKSSGLDIFVFLVFI

SEQ ID NO: 4790 - DNA, 48 bp, homo sapiens
atgaagagttcagggctggacatatttgtgttccttgttttcatctga

SEQ ID NO: 4791 - protein, 25 aa, homo sapiens
MVEKHLYFKRCFAKPLMLSKLLYEK

SEQ ID NO: 4792 - DNA, 78 bp, homo sapiens
atggtggagaagcatctttattttaaaagatgttttgcaaagcctcttatgctttcaaaattactatatgaaaagtga

SEQ ID NO: 4793 - protein, 39 aa, homo sapiens
MGLKRPPDGQTLLPGWTRGHLHSVYPVFRLSVQDSQIVQ

SEQ ID NO: 4794 - DNA, 120 bp, homo sapiens
atggggctgaagcgcccaccggatggacagacactgctgcctggatggaccagaggacacctccactccgtctacccagtgtttagactatctgttcaggactcccaaattgtacagtag

SEQ ID NO: 4795 - protein, 37 aa, homo sapiens
MDRHCCLDGPEDTSTPSTQCLDYLFRTPKLYSSLHIG

SEQ ID NO: 4796 - DNA, 114 bp, homo sapiens
atggacagacactgctgcctggatggaccagaggacacctccactccgtctacccagtgtttagactatctgttcaggactcccaaattgtacagtagtctgcacattggttag

SEQ ID NO: 4797 - protein, 13 aa, homo sapiens
MDQRTPPLRLPSV

SEQ ID NO: 4798 - DNA, 42 bp, homo sapiens
atggaccagaggacacctccactccgtctacccagtgtttag

SEQ ID NO: 4799 - protein, 13 aa, homo sapiens
MDGGATLCGTGWG

SEQ ID NO: 4800 - DNA, 42 bp, homo sapiens
atggatgggggtgccaccctgtgtgggactggttgggggtag

SEQ ID NO: 4801 - protein, 142 aa, homo sapiens; identical to SEQ ID NO: 4497

SEQ ID NO: 4802 - DNA, 429 bp, homo sapiens; identical to SEQ ID NO: 4498

SEQ ID NO: 4803 - protein, 36 aa, homo sapiens; identical to SEQ ID NO: 4499

SEQ ID NO: 4804 - DNA, 111 bp, homo sapiens; identical to SEQ ID NO: 4500

SEQ ID NO: 4805 - protein, 125 aa, homo sapiens [sequence omitted]

SEQ ID NO: 4806 - DNA, 378 bp, homo sapiens; identical to SEQ ID NO: 4502

SEQ ID NO: 4807 - protein, 123 aa, homo sapiens [sequence omitted]

SEQ ID NO: 4808 - DNA, 372 bp, homo sapiens; identical to SEQ ID NO: 4504

SEQ ID NO: 4809 - protein, 142 aa, homo sapiens; identical to SEQ ID NO: 4497

SEQ ID NO: 4810 - DNA, 429 bp, homo sapiens; identical to SEQ ID NO: 4498

SEQ ID NO: 4811 - protein, 36 aa, homo sapiens; identical to SEQ ID NO: 4499

SEQ ID NO: 4812 - DNA, 111 bp, homo sapiens; identical to SEQ ID NO: 4500

SEQ ID NO: 4813 - protein, 125 aa, homo sapiens [sequence omitted]

SEQ ID NO: 4814 - DNA, 378 bp, homo sapiens; identical to SEQ ID NO: 4502

SEQ ID NO: 4815 - protein, 123 aa, homo sapiens [sequence omitted]

SEQ ID NO: 4816 - DNA, 372 bp, homo sapiens; identical to SEQ ID NO: 4504

SEQ ID NO: 4817 - protein, 5 aa, homo sapiens
MGGGE

SEQ ID NO: 4818 - DNA, 18 bp, homo sapiens
atggggggtggcgaatag

SEQ ID NO: 4819 - protein, 7 aa, homo sapiens
MSCLMNC

SEQ ID NO: 4820 - DNA, 24 bp, homo sapiens
atgtcttgtttaatgaactgctaa

SEQ ID NO: 4821 - protein, 15 aa, homo sapiens
MSLLGSYFYLFPLIG

SEQ ID NO: 4822 - DNA, 48 bp, homo sapiens; identical to SEQ ID NO: 3910

SEQ ID NO: 4823 - protein, 16 aa, homo sapiens
MISSFPTFFCLSNQDT

SEQ ID NO: 4824 - DNA, 51 bp, homo sapiens; identical to SEQ ID NO: 3912

SEQ ID NO: 4825 - protein, 87 aa, homo sapiens; identical to SEQ ID NO: 441

SEQ ID NO: 4826 - DNA, 264 bp, homo sapiens; identical to SEQ ID NO: 442

SEQ ID NO: 4827 - protein, 85 aa, homo sapiens [sequence omitted]

SEQ ID NO: 4828 - DNA, 258 bp, homo sapiens; identical to SEQ ID NO: 444

SEQ ID NO: 4829 - protein, 96 aa, homo sapiens; identical to SEQ ID NO: 445

SEQ ID NO: 4830 - DNA, 291 bp, homo sapiens; identical to SEQ ID NO: 446

SEQ ID NO: 4831 - protein, 14 aa, homo sapiens
MTGVGATSLVRFFT

SEQ ID NO: 4832 - DNA, 45 bp, homo sapiens; identical to SEQ ID NO: 448

SEQ ID NO: 4833 - protein, 87 aa, homo sapiens; identical to SEQ ID NO: 441

SEQ ID NO: 4834 - DNA, 264 bp, homo sapiens; identical to SEQ ID NO: 442

SEQ ID NO: 4835 - protein, 85 aa, homo sapiens [sequence omitted]

SEQ ID NO: 4836 - DNA, 258 bp, homo sapiens; identical to SEQ ID NO: 444

SEQ ID NO: 4837 - protein, 96 aa, homo sapiens; identical to SEQ ID NO: 445

SEQ ID NO: 4838 - DNA, 291 bp, homo sapiens; identical to SEQ ID NO: 446

SEQ ID NO: 4839 - protein, 14 aa, homo sapiens
MTGVGATSLVRFFT

SEQ ID NO: 4840 - DNA, 45 bp, homo sapiens; identical to SEQ ID NO: 448

SEQ ID NO: 4841 - protein, 46 aa, homo sapiens; identical to SEQ ID NO: 4225

SEQ ID NO: 4842 - DNA, 141 bp, homo sapiens; identical to SEQ ID NO: 4226

SEQ ID NO: 4843 - protein, 44 aa, homo sapiens [sequence omitted]

SEQ ID NO: 4844 - DNA, 135 bp, homo sapiens; identical to SEQ ID NO: 4228

SEQ ID NO: 4845 - protein, 18 aa, homo sapiens
MGARDLQLFRRDPGPEAA

SEQ ID NO: 4846 - DNA, 57 bp, homo sapiens; identical to SEQ ID NO: 4230

SEQ ID NO: 4847 - protein, 39 aa, homo sapiens; identical to SEQ ID NO: 4231

SEQ ID NO: 4848 - DNA, 120 bp, homo sapiens; identical to SEQ ID NO: 4232

SEQ ID NO: 4849 - protein, 33 aa, homo sapiens
MRAPLGGGLHFSAGRWVWVPLTSPGVYFCMCEI

SEQ ID NO: 4850 - DNA, 102 bp, homo sapiens
atgagggctccccttgggggcggcctgcatttctcagcgggaaggtgggtgtgggtgcccctcacatcacctggcgtttatttttgcatgtgtgaaatataa

SEQ ID NO: 4851 - protein, 11 aa, homo sapiens
MGTYGPKLTAE

SEQ ID NO: 4852 - DNA, 36 bp, homo sapiens
atgggaacatatggtccgaaactcactgctgaataa

SEQ ID NO: 4853 - protein, 12 aa, homo sapiens
MVRNSLLNNVLS

SEQ ID NO: 4854 - DNA, 39 bp, homo sapiens
atggtccgaaactcactgctgaataatgtgctgtcatga

SEQ ID NO: 4855 - protein, 18 aa, homo sapiens
MCCHEIYFKNPLTEYNLG

SEQ ID NO: 4856 - DNA, 57 bp, homo sapiens
atgtgctgtcatgaaatttacttcaaaaaccccctcacggagtacaatcttgggtag

SEQ ID NO: 4857 - protein, 80 aa, homo sapiens [sequence omitted]

SEQ ID NO: 4858 - DNA, 243 bp, homo sapiens
atgcagcgatggcaaggcctgtcatcccttctctaccaccaagagctgtgcaatccccagaagtcactgtccctccctgagcctcagtttccccaactgcaaaatgaaaataacaaaacctttctgattccctttccagggtggctgcggtggttgagccacacgcggcccatgtggaaatgtctggggggtccctcagatctggtggctgtgttctggtctggggctcaccttggctcctga

SEQ ID NO: 4859 - protein, 23 aa, homo sapiens
MARPVIPSLPPRAVQSPEVTVPP

SEQ ID NO: 4860 - DNA, 72 bp, homo sapiens
atggcaaggcctgtcatcccttctctaccaccaagagctgtgcaatccccagaagtcactgtccctccctga

SEQ ID NO: 4861 - protein, 7 aa, homo sapiens
MKITKPF

SEQ ID NO: 4862 - DNA, 24 bp, homo sapiens
atgaaaataacaaaacctttctga

SEQ ID NO: 4863 - protein, 42 aa, homo sapiens
MSGGSLRSGGCVLVWGSPWLLSTWLLAGWAGGGMACHRPALE

SEQ ID NO: 4864 - DNA, 129 bp, homo sapiens
atgtctggggggtccctcagatctggtggctgtgttctggtctggggctcaccttggctcctgagcacttggctcctggctggctgggcgggtggtgggatggcgtgtcaccgccctgcactggaatga

SEQ ID NO: 4865 - protein, 106 aa, homo sapiens [sequence omitted]

SEQ ID NO: 4866 - DNA, 321 bp, homo sapiens
atggggaagaagtggagggatgcggcggaaatggagcggggctgctccgaccgcgaggacaacgcggagagccgcagacgcagccggagcgccagccggggcaggtttgccgagtcgtggaaaaggttaagttccaagcaggggtccaccaaacgctcgggactcccgtcgcagcagacgccggtgagtggccgggggagagccccagtctttgctttcttttctcccttcgcacgcgacttgagccctttccatggtgctgaacttgcctccctaagggtgagagccagggaacttgtggcgccgcttctaatgaaatag

SEQ ID NO: 4867 - protein, 36 aa, homo sapiens
MRRKWSGAAPTARTTRRAADAAGAPAGAGLPSRGKG

SEQ ID NO: 4868 - DNA, 111 bp, homo sapiens
atgcggcggaaatggagcggggctgctccgaccgcgaggacaacgcggagagccgcagacgcagccggagcgccagccggggcaggtttgccgagtcgtggaaaaggttaa

SEQ ID NO: 4869 - protein, 7 aa, homo sapiens
MVLNLPP

SEQ ID NO: 4870 - DNA, 24 bp, homo sapiens
atggtgctgaacttgcctccctaa

SEQ ID NO: 4871 - protein, 28 aa, homo sapiens
MFERRGGSLLDHKSFAVNRACETLSSVL

SEQ ID NO: 4872 - DNA, 87 bp, homo sapiens
atgttcgagaggcgagggggctcgctgttagatcataagagttttgcagttaacagagcgtgtgagacgttgtcgagtgtattgtga

SEQ ID NO: 4873 - protein, 9 aa, homo sapiens
MLPRLVLNS

SEQ ID NO: 4874 - DNA, 30 bp, homo sapiens
atgttgcccagactggtcttgaactcctga

SEQ ID NO: 4875 - protein, 50 aa, homo sapiens
MFFFIKERNQLFRTGPHLSSGVISVPHRPAELGALYRVSVSHFLFPVLKP

SEQ ID NO: 4876 - DNA, 153 bp, homo sapiens
atgttctttttcattaaagagagaaatcaactattcaggaccggcccccacctttcctcaggagtcatttctgttccgcacaggcctgctgaactgggtgctttatatagggtaagtgtttctcattttttgttccctgtcctcaagccttag

SEQ ID NO: 4877 - protein, 12 aa, homo sapiens
MAVAISLFCIIL

SEQ ID NO: 4878 - DNA, 39 bp, homo sapiens
atggctgtagccatctctctgttctgcattatcttatga

SEQ ID NO: 4879 - protein, 46 aa, homo sapiens
MTKKKNSYFEANSKLGPDVSRHRYSYLKVSLKSVDLGNFGKTKMSG

SEQ ID NO: 4880 - DNA, 141 bp, homo sapiens
atgacaaaaaaaaaaaattcttattttgaagcaaactcaaagctaggtcctgatgtctcaaggcacaggtactcgtacttaaaggtgagtctgaaatctgtggatttggggaactttggaaaaacaaagatgagtggctag

SEQ ID NO: 4881 - protein, 9 aa, homo sapiens
MLIIFSLRS

SEQ ID NO: 4882 - DNA, 30 bp, homo sapiens
atgctaataatattttccctgagaagctga

SEQ ID NO: 4883 - protein, 23 aa, homo sapiens
MKGFCIWGEVGISYCSTGFCCKH

SEQ ID NO: 4884 - DNA, 72 bp, homo sapiens
atgaaaggcttttgtatttggggggaggtgggaatttcctactgttcaacaggtttttgttgtaaacattaa

SEQ ID NO: 4885 - protein, 24 aa, homo sapiens
MWEGVPLLSQEGGQAPGSLHSPFS

SEQ ID NO: 4886 - DNA, 75 bp, homo sapiens
atgtgggagggagtgccacttctgtcccaggagggaggccaggcaccaggcagcctgcattcaccattctcctga

SEQ ID NO: 4887 - protein, 11 aa, homo sapiens
MWGPPSQFSFK

SEQ ID NO: 4888 - DNA, 36 bp, homo sapiens
atgtggggacctccctcccaattctccttcaaatga

SEQ ID NO: 4889 - protein, 11 aa, homo sapiens
MPCSPSTEPPP

SEQ ID NO: 4890 - DNA, 36 bp, homo sapiens
atgccctgcagcccgtccacagagcccccaccgtga

SEQ ID NO: 4891 - protein, 58 aa, homo sapiens
MLSPSFHLPSSFGWLPSLDPGFILPLGLHRHLSQSCFFVSLPCPSFLARVLTSLPLCF

SEQ ID NO: 4892 - DNA, 177 bp, homo sapiens
atgttgtctccatctttccatcttccttcctcctttggatggcttccttcccttgatcctggttttatcttgcctcttggtcttcatcgacacttgtcacaatcatgcttctttgtctctctcccttgtccttccttcttggcacgtgttctcacctccctgcctctctgcttctaa

SEQ ID NO: 4893 - protein, 5 aa, homo sapiens
MASFP

SEQ ID NO: 4894 - DNA, 18 bp, homo sapiens
atggcttccttcccttga

SEQ ID NO: 4895 - protein, 105 aa, homo sapiens
MLLCLSPLSFLLGTCSHLPASLLLTLFPHPVPRTHIDSVPFLFCLCVFPFLTPWSVLPVCALGLPPSPGGLPLLFFTLLICSSLCPALPLLFLAPPTVQILQDSP

SEQ ID NO: 4896 - DNA, 318 bp, homo sapiens
atgcttctttgtctctctcccttgtccttccttcttggcacgtgttctcacctccctgcctctctgcttctaaccctgtttccacaccccgtccctcgcactcatattgactcggtgccctttcttttctgcctctgcgtctttccctttctgactccctggtctgtcctgcctgtctgcgctctggggctgcctccatccccgggtggcctgcctctgttgttcttcactctcctcatctgttcttctctctgcccggctctacctctgttgttccttgctccacccacggtccagattcttcaggattctccgtga

SEQ ID NO: 4897 - protein, 17 aa, homo sapiens
MNPMPGRRGGWGGVGVG

SEQ ID NO: 4898 - DNA, 54 bp, homo sapiens
atgaatcccatgccagggaggaggggtggctggggtggggtgggggtggggtga

SEQ ID NO: 4899 - protein, 44 aa, homo sapiens
MAVGTVPATAQPSAMPSATSAISPCHLQPPTPCTPAPQPPVPNH

SEQ ID NO: 4900 - DNA, 135 bp, homo sapiens
atggcggtgggcactgtgccagccaccgcacagccatctgcgatgccttctgcaacctctgctatttctccctgtcacctccagcccccaaccccctgcaccccagctccccagcccccagtccccaatcattaa

SEQ ID NO: 4901 - protein, 22 aa, homo sapiens
MLINIPTGQAARLGVQRGCEEK

SEQ ID NO: 4902 - DNA, 69 bp, homo sapiens
atgctaattaacattcctacagggcaggctgccaggctgggggtgcagaggggatgtgaagagaagtag

SEQ ID NO: 4903 - protein, 24 aa, homo sapiens
MGEEEGEPVFLEEQRGGKENPKEG

SEQ ID NO: 4904 - DNA, 75 bp, homo sapiens
atgggggaggaggaaggagagccagtcttcttagaagaacagcggggagggaaagagaacccaaaagaaggatga

SEQ ID NO: 4905 - protein, 29 aa, homo sapiens
MQDFMQSTRSSHWAHMCRSKHGRMCHRSS

SEQ ID NO: 4906 - DNA, 90 bp, homo sapiens
atgcaggacttcatgcagagtaccaggtccagtcactgggcacacatgtgcaggtctaaacatgggcgtatgtgccacaggagttcctag

SEQ ID NO: 4907 - protein, 41 aa, homo sapiens
MGVCATGVPRGRYLHLSIWDQYALQGVCVCVCVCVCVDKPA

SEQ ID NO: 4908 - DNA, 126 bp, homo sapiens
atgggcgtatgtgccacaggagttcctaggggaagatatctgcatctgagcatatgggaccaatatgcattacagggtgtgtgtgtgtgtgtgtgtgtgtgtgtgtgtgtggacaagcctgcatag

SEQ ID NO: 4909 - protein, 25 aa, homo sapiens
MGPICITGCVCVCVCVCVCGQACIV

SEQ ID NO: 4910 - DNA, 78 bp, homo sapiens
atgggaccaatatgcattacagggtgtgtgtgtgtgtgtgtgtgtgtgtgtgtgtgtggacaagcctgcatagtctga

SEQ ID NO: 4911 - protein, 32 aa, homo sapiens
MHYRVCVCVCVCVCVWTSLHSLNVRKGMYLTD

SEQ ID NO: 4912 - DNA, 99 bp, homo sapiens
atgcattacagggtgtgtgtgtgtgtgtgtgtgtgtgtgtgtgtgtggacaagcctgcatagtctgaatgtgagaaagggtatgtacctcactgactga

SEQ ID NO: 4913 - protein, 17 aa, homo sapiens
MNPMPGRRGGWGGVGVG

SEQ ID NO: 4914 - DNA, 54 bp, homo sapiens; identical to SEQ ID NO: 4898

SEQ ID NO: 4915 - protein, 44 aa, homo sapiens; identical to SEQ ID NO: 4899

SEQ ID NO: 4916 - DNA, 135 bp, homo sapiens; identical to SEQ ID NO: 4900

SEQ ID NO: 4917 - protein, 22 aa, homo sapiens
MLINIPTGQAARLGVQRGCEEK

SEQ ID NO: 4918 - DNA, 69 bp, homo sapiens; identical to SEQ ID NO: 4902

SEQ ID NO: 4919 - protein, 24 aa, homo sapiens
MGEEEGEPVFLEEQRGGKENPKEG

SEQ ID NO: 4920 - DNA, 75 bp, homo sapiens; identical to SEQ ID NO: 4904

SEQ ID NO: 4921 - protein, 142 aa, homo sapiens; identical to SEQ ID NO: 4497

SEQ ID NO: 4922 - DNA, 429 bp, homo sapiens; identical to SEQ ID NO: 4498

SEQ ID NO: 4923 - protein, 36 aa, homo sapiens; identical to SEQ ID NO: 4499

SEQ ID NO: 4924 - DNA, 111 bp, homo sapiens; identical to SEQ ID NO: 4500

SEQ ID NO: 4925 - protein, 125 aa, homo sapiens [sequence omitted]

SEQ ID NO: 4926 - DNA, 378 bp, homo sapiens; identical to SEQ ID NO: 4502

SEQ ID NO: 4927 - protein, 123 aa, homo sapiens [sequence omitted]

SEQ ID NO: 4928 - DNA, 372 bp, homo sapiens; identical to SEQ ID NO: 4504

SEQ ID NO: 4929 - protein, 5 aa, homo sapiens
MGGGE

SEQ ID NO: 4930 - DNA, 18 bp, homo sapiens
atggggggtggcgaatag

SEQ ID NO: 4931 - protein, 7 aa, homo sapiens
MSCLMNC

SEQ ID NO: 4932 - DNA, 24 bp, homo sapiens
atgtcttgtttaatgaactgctaa

SEQ ID NO: 4933 - protein, 15 aa, homo sapiens
MSLLGSYFYLFPLIG

SEQ ID NO: 4934 - DNA, 48 bp, homo sapiens; identical to SEQ ID NO: 3910

SEQ ID NO: 4935 - protein, 16 aa, homo sapiens
MISSFPTFFCLSNQDT

SEQ ID NO: 4936 - DNA, 51 bp, homo sapiens; identical to SEQ ID NO: 3912

SEQ ID NO: 4937 - protein, 10 aa, homo sapiens
MTAEQNKYIL

SEQ ID NO: 4938 - DNA, 33 bp, homo sapiens
atgacagcagaacaaaataagtacatcctataa

SEQ ID NO: 4939 - protein, 8 aa, homo sapiens
MLHPLIFF

SEQ ID NO: 4940 - DNA, 27 bp, homo sapiens
atgctccacccgttaatctttttttaa

SEQ ID NO: 4941 - protein, 55 aa, homo sapiens
MWPPMWPRLFSNSWAQAILLSQPPKVLDYRLSHRAGSAVYNRKKQTNLSQIFSDP

SEQ ID NO: 4942 - DNA, 168 bp, homo sapiens
atgtggccccctatgtggcccaggctgttctcaaactcctgggctcaagcaatcctcctgtctcagcctcccaaagtgttggattacaggctgagccaccgcgccgggtctgcagtttacaaccgaaaaaaacaaacaaacctttcccaaatcttctctgacccttaa

SEQ ID NO: 4943 - protein, 7 aa, homo sapiens
MVPGVCQ

SEQ ID NO: 4944 - DNA, 24 bp, homo sapiens
atggtgcctggggtatgtcagtaa

SEQ ID NO: 4945 - protein, 192 aa, homo sapiens [sequence omitted]

SEQ ID NO: 4946 - DNA, 579 bp, homo sapiens
atggacggggtgtgcctgtctggccagcagggacggcgggtgggggtaagcgaaatcattcgggggctttgctgccctccgcttggtggggctgaggctgggccagataccctcttggagggaactttcttttccttgtgtgtccagggtaccagtgtgcggagttcctgttgccaagctgaaggtggccctgggcaggcacaggtgtggtcatatcttcagccaacaggaccatcctccggagggccacctctggggacttcctacgggaagagagtgacagatttggtgcttctgtgtgtttctgccgcttcagtggggccgctgcgggagacagcgggtggatcctccagcagcctgtctgctgagcctgccttctcaagtctactgttaaaatcaggaccgggtcgtgtccgagcctacaggccctgtctccgctccccaggcctgcaggagttgagggctgcacctgctcgctggagagggagaggcagatttagtggacgcctggcatggactcggactggcctttggaagctccctgccctgacggggttgcctgtcaccactgcgaagtga

SEQ ID NO: 4947 - protein, 29 aa, homo sapiens
MDSDWPLEAPCPDGVACHHCEVRLGRTCT

SEQ ID NO: 4948 - DNA, 90 bp, homo sapiens
atggactcggactggcctttggaagctccctgccctgacggggttgcctgtcaccactgcgaagtgaggcttggcaggacctgcacctga

SEQ ID NO: 4949 - protein, 77 aa, homo sapiens
MSRNSGRGGSQRRPSIQPGSALCPYLHQVGSLPCIAWGLAGLGPALLWNWMFSGSPAFPHVNTVHNIVFKVQFKTQK

SEQ ID NO: 4950 - DNA, 234 bp, homo sapiens
atgagtaggaactctgggcgaggagggtcccagcgccgcccctcgatacagcctggctctgccctctgcccgtacttacaccaggtgggatccctgccctgcattgcctggggattggctgggcttgggcccgccctgctgtggaactggatgttttcagggagcccagcctttcctcatgtcaacacagttcacaatatagttttcaaagtacagtttaaaactcaaaagtaa

SEQ ID NO: 4951 - protein, 7 aa, homo sapiens
MSTQFTI

SEQ ID NO: 4952 - DNA, 24 bp, homo sapiens
atgtcaacacagttcacaatatag

SEQ ID NO: 4953 - protein, 55 aa, homo sapiens
MRAQAQVLTCSSWGLLLLKGGPSSPSSLPWPRRRLKEPELCPLHSTAVAGKLRCG

SEQ ID NO: 4954 - DNA, 168 bp, homo sapiens
atgagggcccaggcccaagtgctcacatgctcctcatggggactgctcctcttaaagggtgggccctcctcacccagctccctgccctggccaaggaggaggctgaaagagcctgagctgtgccctctccattccactgctgtggcaggtaagctcagatgcgggtaa

SEQ ID NO: 4955 - protein, 29 aa, homo sapiens
MLLMGTAPLKGWALLTQLPALAKEEAERA

SEQ ID NO: 4956 - DNA, 90 bp, homo sapiens
atgctcctcatggggactgctcctcttaaagggtgggccctcctcacccagctccctgccctggccaaggaggaggctgaaagagcctga

SEQ ID NO: 4957 - protein, 18 aa, homo sapiens
MRVSTGEGRSGAGILRCG

SEQ ID NO: 4958 - DNA, 57 bp, homo sapiens
atgcgggtaagcacaggtgaagggaggtcaggtgcaggtatcctcaggtgtgggtaa

SEQ ID NO: 4959 - protein, 13 aa, homo sapiens
MQLSSGVGNLRCR

SEQ ID NO: 4960 - DNA, 42 bp, homo sapiens
atgcagttaagctcaggtgttggtaacctcaggtgcaggtag

SEQ ID NO: 4961 - protein, 62 aa, homo sapiens
MHPCMLVCAQNCTHAPINNGCLEVGVRRKCEYPCPFVIDLFVNYCNFLHQALTLVDRWVGNR

SEQ ID NO: 4962 - DNA, 189 bp, homo sapiens
atgcatccgtgcatgttggtatgtgcccagaactgtacacacgcacccattaacaatggctgcctggaagtaggggtaagaaggaagtgtgagtatccatgtccctttgtgatagatttatttgtgaattactgtaacttcctacatcaggcactgacacttgtggacaggtgggtaggtaataggtag

SEQ ID NO: 4963 - protein, 10 aa, homo sapiens
MCPELYTRTH

SEQ ID NO: 4964 - DNA, 33 bp, homo sapiens
atgtgcccagaactgtacacacgcacccattaa

SEQ ID NO: 4965 - protein, 5 aa, homo sapiens
MAAWK

SEQ ID NO: 4966 - DNA, 18 bp, homo sapiens
atggctgcctggaagtag

SEQ ID NO: 4967 - protein, 12 aa, homo sapiens
MSLCDRFICELL

SEQ ID NO: 4968 - DNA, 39 bp, homo sapiens
atgtccctttgtgatagatttatttgtgaattactgtaa

SEQ ID NO: 4969 - protein, 12 aa, homo sapiens
MNEPPHEYYARL

SEQ ID NO: 4970 - DNA, 39 bp, homo sapiens; identical to SEQ ID NO: 4122

SEQ ID NO: 4971 - protein, 32 aa, homo sapiens; identical to SEQ ID NO: 4123

SEQ ID NO: 4972 - DNA, 99 bp, homo sapiens; identical to SEQ ID NO: 4124

SEQ ID NO: 4973 - protein, 203 aa, homo sapiens [sequence omitted]

SEQ ID NO: 4974 - DNA, 612 bp, homo sapiens; identical to SEQ ID NO: 4126

SEQ ID NO: 4975 - protein, 64 aa, homo sapiens; identical to SEQ ID NO: 4127

SEQ ID NO: 4976 - DNA, 195 bp, homo sapiens; identical to SEQ ID NO: 4128

SEQ ID NO: 4977 - protein, 19 aa, homo sapiens
MHKEGSVIFQGIALIARYI

SEQ ID NO: 4978 - DNA, 60 bp, homo sapiens; identical to SEQ ID NO: 4786

SEQ ID NO: 4979 - protein, 13 aa, homo sapiens
MCVCVCVCVCVCV

SEQ ID NO: 4980 - DNA, 42 bp, homo sapiens; identical to SEQ ID NO: 4788

SEQ ID NO: 4981 - protein, 15 aa, homo sapiens
MKSSGLDIFVFLVFI

SEQ ID NO: 4982 - DNA, 48 bp, homo sapiens; identical to SEQ ID NO: 4790

SEQ ID NO: 4983 - protein, 25 aa, homo sapiens
MVEKHLYFKRCFAKPLMLSKLLYEK

SEQ ID NO: 4984 - DNA, 78 bp, homo sapiens; identical to SEQ ID NO: 4792

SEQ ID NO: 4985 - protein, 40 aa, homo sapiens; identical to SEQ ID NO: 4705

SEQ ID NO: 4986 - DNA, 123 bp, homo sapiens; identical to SEQ ID NO: 4706

SEQ ID NO: 4987 - protein, 28 aa, homo sapiens
MLWTPSTCLSFVPVPFFHTKWMASLGFL

SEQ ID NO: 4988 - DNA, 87 bp, homo sapiens; identical to SEQ ID NO: 4708

SEQ ID NO: 4989 - protein, 13 aa, homo sapiens
MCKCLQAFVLTLK

SEQ ID NO: 4990 - DNA, 42 bp, homo sapiens; identical to SEQ ID NO: 4710

SEQ ID NO: 4991 - protein, 16 aa, homo sapiens
MAFVTIQMNNVKYFQK

SEQ ID NO: 4992 - DNA, 51 bp, homo sapiens; identical to SEQ ID NO: 4712

SEQ ID NO: 4993 - protein, 28 aa, homo sapiens
MLTLKLITSGNNGKKEKLLGCICLENAM

SEQ ID NO: 4994 - DNA, 87 bp, homo sapiens
atgctgactttaaaattgataacatctggaaataatggcaaaaaggaaaaactgttgggctgcatctgtcttgaaaatgctatgtaa

SEQ ID NO: 4995 - protein, 72 aa, homo sapiens [sequence omitted]

SEQ ID NO: 4996 - DNA, 219 bp, homo sapiens
atggcaaaaaggaaaaactgttgggctgcatctgtcttgaaaatgctatgtaataagatttacttaatatatttgaaaaaggaaaaatgttttgttccccaatttgttgcaacatctgaaagttcacgaggttatgacccctctttaagaaagcatctcccaccacctgcaaataccccaggaaaagcagttggaaacaataaaacacgtgctagttaa

SEQ ID NO: 4997 - protein, 10 aa, homo sapiens
MFCSPICCNI

SEQ ID NO: 4998 - DNA, 33 bp, homo sapiens
atgttttgttccccaatttgttgcaacatctga

SEQ ID NO: 4999 - protein, 4 aa, homo sapiens
MTPL

SEQ ID NO: 5000 - DNA, 15 bp, homo sapiens
atgacccctctttaa

SEQ ID NO: 5001 - protein, 28 aa, homo sapiens
MLTLKLITSGNNGKKEKLLGCICLENAM

SEQ ID NO: 5002 - DNA, 87 bp, homo sapiens; identical to SEQ ID NO: 4994

SEQ ID NO: 5003 - protein, 72 aa, homo sapiens [sequence omitted]

SEQ ID NO: 5004 - DNA, 219 bp, homo sapiens; identical to SEQ ID NO: 4996

SEQ ID NO: 5005 - protein, 10 aa, homo sapiens
MFCSPICCNI

SEQ ID NO: 5006 - DNA, 33 bp, homo sapiens; identical to SEQ ID NO: 4998

SEQ ID NO: 5007 - protein, 4 aa, homo sapiens
MTPL

SEQ ID NO: 5008 - DNA, 15 bp, homo sapiens
atgacccctctttaa

SEQ ID NO: 5009 - protein, 28 aa, homo sapiens
MLTLKLITSGNNGKKEKLLGCICLENAM

SEQ ID NO: 5010 - DNA, 87 bp, homo sapiens; identical to SEQ ID NO: 4994

SEQ ID NO: 5011 - protein, 72 aa, homo sapiens [sequence omitted]

SEQ ID NO: 5012 - DNA, 219 bp, homo sapiens; identical to SEQ ID NO: 4996

SEQ ID NO: 5013 - protein, 10 aa, homo sapiens
MFCSPICCNI

SEQ ID NO: 5014 - DNA, 33 bp, homo sapiens; identical to SEQ ID NO: 4998

SEQ ID NO: 5015 - protein, 4 aa, homo sapiens
MTPL

SEQ ID NO: 5016 - DNA, 15 bp, homo sapiens
atgacccctctttaa

SEQ ID NO: 5017 - protein, 18 aa, homo sapiens
MPSCPARSATGPLGFRAF

SEQ ID NO: 5018 - DNA, 57 bp, homo sapiens
atgcccagttgccccgcgcgctctgctacgggcccgctgggcttccgcgccttctag

SEQ ID NO: 5019 - protein, 60 aa, homo sapiens [sequence omitted]

SEQ ID NO: 5020 - DNA, 183 bp, homo sapiens
atgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactgtga

SEQ ID NO: 5021 - protein, 43 aa, homo sapiens
MRSSSSPLPIRAAHPCLHWRNLSAQGPVPGAALASSPPCTSWG

SEQ ID NO: 5022 - DNA, 132 bp, homo sapiens
atgcgctcttcgtcttcccctctccccatccgggccgcgcacccctgcctccactggaggaacctgtcagctcagggtcctgtgcctggggcagccctcgctagctctcccccatgcacatcctggggttga

SEQ ID NO: 5023 - protein, 56 aa, homo sapiens
MHILGLSSPGGHWPGKGLCPRRGGSAGSCASSPSPALVPPLAAPCWLVLWGWGAGR

SEQ ID NO: 5024 - DNA, 171 bp, homo sapiens
atgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagatag

SEQ ID NO: 5025 - protein, 32 aa, homo sapiens
MRSGAAPAPPMELLLLPPPPPGAPRSARAPCA

SEQ ID NO: 5026 - DNA, 99 bp, homo sapiens
atgcgcagcggggcagcgccggccccgccgatggagctgctgttgctgccgccgccgccgcccggagcgccccgctccgcccgcgccccgtgcgcctga

SEQ ID NO: 5027 - protein, 66 aa, homo sapiens [sequence omitted]

SEQ ID NO: 5028 - DNA, 201 bp, homo sapiens
atggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgcctgtga

SEQ ID NO: 5029 - protein, 113 aa, homo sapiens [sequence omitted]

SEQ ID NO: 5030 - DNA, 342 bp, homo sapiens
atgcagtctctattctcatcccttcctggatacgatccctcactctccgagctgggggtctgtaggcttggtcagatctggaaagagaggtctcgaaacccccagcgatgggcaaagagcagtgcctctccaggggtgagggttccagacgcagggcccgctgacagcttccaaggagtagctgaggagaggcgaggggaggcaagagcactgcagcctcaaggtcttagggtgagggtcaggggtctgcgctcgttaaaaaggggggcgggcgaaggagaaagctataggatgatgggccgtcaaggcgcggaggcgggagagagggcccgagactgttga

SEQ ID NO: 5031 - protein, 18 aa, homo sapiens
MGKEQCLSRGEGSRRRAR

SEQ ID NO: 5032 - DNA, 57 bp, homo sapiens
atgggcaaagagcagtgcctctccaggggtgagggttccagacgcagggcccgctga

SEQ ID NO: 5033 - protein, 127 aa, homo sapiens
MNQPMKGAGESRREGAGKRRRKGRGVCANRLWRPHKDWPRTEGEDREVGGNWGGGRGHPLLPCPRDRPPPGSRSPSPGASARAGTRCPSGSLTAPHPLALYPSHSLHSMGIALPLPLLFPPHPLRLL

SEQ ID NO: 5034 - DNA, 384 bp, homo sapiens
atgaaccagccgatgaaaggggctggagagagcaggagggagggggctgggaagaggaggaggaaggggaggggggtctgcgctaatcgactctggcgcccacataaggactggccacggactgaaggagaggacagggaagtaggggggaactggggtggggggcgagggcacccactgctgccttgtcccagggacaggccaccccctggcagccgcagcccaagtccgggagcctcagctcgggcggggacaagatgcccatcagggtctctaactgccccccaccccctcgccctgtatccctctcattccctacactcaatggggatcgctctgccccttcctcttctctttcctccccatccccttcgtttactctag

SEQ ID NO: 5035 - protein, 105 aa, homo sapiens
MPIRVSNCPPPPRPVSLSFPTLNGDRSAPSSSLSSPSPSFTLESSKRLLPTSHSRHSAPVYPTHTRTPPSQWELHLVYVPVSAWCLHSPFPPVRLPPFPAPGRGS

SEQ ID NO: 5036 - DNA, 318 bp, homo sapiens
atgcccatcagggtctctaactgccccccaccccctcgccctgtatccctctcattccctacactcaatggggatcgctctgccccttcctcttctctttcctccccatccccttcgtttactctagagtcctcgaagaggcttctgcccacttcccactccagacattctgcccctgtgtaccccacccacacgcgcacccccccttcccaatgggagctccatcttgtgtatgtccctgtttccgcgtggtgtctccattccccctttcctcccgtgcgcctccctcccttccccgccccgggccgcggctcctga

SEQ ID NO: 5037 - protein, 94 aa, homo sapiens
MGAPSCVCPCFRVVSPFPLSSRAPPSLPRPGPRLLIVQTQFSSLWLRPRVESGRPEPPPPNLERESGSEGLGRAKAEGGGSPQGGKGNPGHIGT

SEQ ID NO: 5038 - DNA, 285 bp, homo sapiens
atgggagctccatcttgtgtatgtccctgtttccgcgtggtgtctccattccccctttcctcccgtgcgcctccctcccttccccgccccgggccgcggctcctgattgtccaaacgcaattctcgagtctatggctccggccgagagttgagtctggacgtcccgagccgccgcccccaaacctcgagcgggagagcgggtcggagggtctagggagagccaaagcagagggtggagggagtccccagggtggtaaggggaatcccgggcacatcgggacctag

SEQ ID NO: 5039 - protein, 43 aa, homo sapiens
MSLFPRGVSIPPFLPCASLPSPPRAAAPDCPNAILESMAPAES

SEQ ID NO: 5040 - DNA, 132 bp, homo sapiens
atgtccctgtttccgcgtggtgtctccattccccctttcctcccgtgcgcctccctcccttccccgccccgggccgcggctcctgattgtccaaacgcaattctcgagtctatggctccggccgagagttga

SEQ ID NO: 5041 - protein, 27 aa, homo sapiens
MLVPGPGEGRGRWAKGSGRGSRRGIGS

SEQ ID NO: 5042 - DNA, 84 bp, homo sapiens
atgctggtgcctggcccaggagaagggagggggcgatgggcaaaggggtcaggccgagggagcaggcggggcatcgggagttga

SEQ ID NO: 5043 - protein, 48 aa, homo sapiens [sequence omitted]

SEQ ID NO: 5044 - DNA, 147 bp, homo sapiens
atgggcaaaggggtcaggccgagggagcaggcggggcatcgggagttgagggtgccgagtgggggtgggaggacgaggggtccggccggtgcagagggggaggcggcccccggggaggggcacgctatgtctttaagagctgcctga

SEQ ID NO: 5045 - protein, 67 aa, homo sapiens
MTIDGPVALFKSSTNCSRAPFSAPGPYCWSGPLKARPGPEPPEAPARVQPCASAARRLPVRLHGRCR

SEQ ID NO: 5046 - DNA, 204 bp, homo sapiens
atgaccattgatggccccgtggcgttattcaaatccagtaccaattgcagccgagcccctttctccgcgccaggcccgtattgttggagcggcccactaaaagcccgccccggccccgagccgccagaggcgcctgctcgggttcagccttgcgcctcggcagcccgccggctcccagtccggctccacgggcgctgcaggtga

SEQ ID NO: 5047 - protein, 29 aa, homo sapiens
MAPWRYSNPVPIAAEPLSPRQARIVGAAH

SEQ ID NO: 5048 - DNA, 90 bp, homo sapiens
atggccccgtggcgttattcaaatccagtaccaattgcagccgagcccctttctccgcgccaggcccgtattgttggagcggcccactaa

SEQ ID NO: 5049 - protein, 139 aa, homo sapiens
MEGESGVRAATPSPSGRRRGGGGRGASGRGAWTGRVSVSGATRKESGTGVVAEGLAEWRGAGGEPRGRRAGGGSPGGPRSEDTGAGHLAWGGSGPPERAARRCFASAGVHWVRASSAPWQGRGRWAGRPLLSFSPGDVM

SEQ ID NO: 5050 - DNA, 420 bp, homo sapiens
atggagggtgaaagtggggtccgggcggccacacccagcccttccgggaggagaaggggcggcgggggcaggggcgcctcggggagaggggcctggactggccgggttagtgtgtcaggagctacgaggaaagagtctgggacgggagtcgtggcggaagggctggcggagtggcggggggcggggggagagccgaggggccggagggccgggggcggctcacccggcggcccccggtctgaggatacaggggccggccatctagcctggggagggtctggaccccccgagcgggcggcgaggaggtgctttgcctctgccggcgttcactgggtcagggccagttcagcgccctggcagggaaggggtcgctgggcgggccggcccctcctctcgttctctccaggggatgttatgtaa

SEQ ID NO: 5051 - protein, 23 aa, homo sapiens
MLCKGGGERSRGRRCRGLMQPKG

SEQ ID NO: 5052 - DNA, 72 bp, homo sapiens
atgttatgtaaggggggaggggagaggagtagggggcggcggtgccggggccttatgcaacccaaaggttag

SEQ ID NO: 5053 - protein, 40 aa, homo sapiens
MASGEAVTPTSLRPWFQPPTPLACHPGCQIGLGAVRVPEG

SEQ ID NO: 5054 - DNA, 123 bp, homo sapiens
atggcctccggcgaggctgtcacccccacctccctccggccctggttccagcctccaactcctttggcctgtcatcctggctgtcagattgggctaggagctgtcagagtgccagagggttga

SEQ ID NO: 5055 - protein, 82 aa, homo sapiens [sequence omitted]

SEQ ID NO: 5056 - DNA, 249 bp, homo sapiens
atggagcagctggtcagagggtcagtgccctgggcccaccccgccctgcagccaagggcacctgcttggcacagactctcagcagctgctgagtcctctgggttgaacagagctatctcagacagaggaaggtcggacggagttggactggtcacccaggggaaggaagatacacaaagttcatgcctcccaagagggtttcggaatttgaaccgcaccccgtatcccccaatctttcttaccctctga

SEQ ID NO: 5057 - protein, 10 aa, homo sapiens
MSGVLETRIC

SEQ ID NO: 5058 - DNA, 33 bp, homo sapiens
atgtctggtgtcctagaaacaagaatatgctaa

SEQ ID NO: 5059 - protein, 33 aa, homo sapiens
MLTFEERTFCVIEDISQRDLSCNPSLIILESVY

SEQ ID NO: 5060 - DNA, 102 bp, homo sapiens
atgctaacctttgaagaaagaacattttgtgtaatagaagacatcagccagagagacctttcatgtaatccttctctaatcattttagaatcagtatattaa

SEQ ID NO: 5061 - protein, 28 aa, homo sapiens
MVIRNISRATSHCSLQDMSRGILTLPTG

SEQ ID NO: 5062 - DNA, 87 bp, homo sapiens
atggtcattaggaatatttcaagggctacatcccattgctccctgcaggatatgtccaggggaattctgactttgcctactggctaa

SEQ ID NO: 5063 - protein, 9 aa, homo sapiens
MSNMHSLPL

SEQ ID NO: 5064 - DNA, 30 bp, homo sapiens
atgtccaacatgcactctctgcctctgtga

SEQ ID NO: 5065 - protein, 34 aa, homo sapiens
MQTLQKTPPTPTFPRCLCCSVSGCRIGSTNEKCS

SEQ ID NO: 5066 - DNA, 105 bp, homo sapiens
atgcagacgctgcaaaaaacccctccaacccctacatttcccagatgcctttgctgctccgtttctggatgcagaattggttctaccaatgagaaatgctcatga

SEQ ID NO: 5067 - protein, 15 aa, homo sapiens
MPLLLRFWMQNWFYQ

SEQ ID NO: 5068 - DNA, 48 bp, homo sapiens
atgcctttgctgctccgtttctggatgcagaattggttctaccaatga

SEQ ID NO: 5069 - protein, 12 aa, homo sapiens
MRNAHERFRKWK

SEQ ID NO: 5070 - DNA, 39 bp, homo sapiens
atgagaaatgctcatgagagatttagaaagtggaagtga

SEQ ID NO: 5071 - protein, 33 aa, homo sapiens
MLMRDLESGSEAVWACVYILLRSRVVELYILFS

SEQ ID NO: 5072 - DNA, 102 bp, homo sapiens
atgctcatgagagatttagaaagtggaagtgaggcagtgtgggcttgtgtgtatatcttgctgagaagcagggttgtggagctatacattttattttcatga

SEQ ID NO: 5073 - protein, 25 aa, homo sapiens
MGRRRARVFLPRLLPSLLPFPVAPP

SEQ ID NO: 5074 - DNA, 78 bp, homo sapiens
atgggccgccgcagagcccgtgtcttcctcccccgcctgctcccctccctcctccccttcccagttgccccaccctga

SEQ ID NO: 5075 - protein, 4 aa, homo sapiens
MLFL

SEQ ID NO: 5076 - DNA, 15 bp, homo sapiens
atgctcttcctctag

SEQ ID NO: 5077 - protein, 12 aa, homo sapiens
MYYIILHYVIIC

SEQ ID NO: 5078 - DNA, 39 bp, homo sapiens
atgtattatattatattgcattatgttattatatgttaa

SEQ ID NO: 5079 - protein, 13 aa, homo sapiens
MLLYVKHINIKYN

SEQ ID NO: 5080 - DNA, 42 bp, homo sapiens
atgttattatatgttaaacatataaatattaaatataattaa

SEQ ID NO: 5081 - protein, 46 aa, homo sapiens
MRGFCYSFLSENDSHSILPFTLHQVSPSHTHTHTHTHTHTPFSCPP

SEQ ID NO: 5082 - DNA, 141 bp, homo sapiens
atgagagggttttgctattcctttttgagtgaaaacgactcccatagcatattgccattcacactccaccaggtctccccttcacacacacacacacacacacacacacacacacacacaccattctcttgtcctccctga

SEQ ID NO: 5083 - protein, 48 aa, homo sapiens
MNNLRFVMDSGCSPFLTFFLNLQELLLSLLPFPTFWFSLPGKLLILPS

SEQ ID NO: 5084 - DNA, 147 bp, homo sapiens
atgaataatcttcgctttgtcatggactccggatgctcaccttttctaacattttttttaaacctccaagagttactcctcagcctccttcccttccccaccttctggttttccctacctggtaaacttcttattctacctagttaa

SEQ ID NO: 5085 - protein, 30 aa, homo sapiens
MLTFSNIFFKPPRVTPQPPSLPHLLVFPTW

SEQ ID NO: 5086 - DNA, 93 bp, homo sapiens
atgctcaccttttctaacattttttttaaacctccaagagttactcctcagcctccttcccttccccaccttctggttttccctacctggtaa

SEQ ID NO: 5087 - protein, 6 aa, homo sapiens
MKLLPH

SEQ ID NO: 5088 - DNA, 21 bp, homo sapiens
atgaagctcttgcctcattga

SEQ ID NO: 5089 - protein, 46 aa, homo sapiens; identical to SEQ ID NO: 5081

SEQ ID NO: 5090 - DNA, 141 bp, homo sapiens; identical to SEQ ID NO: 5082

SEQ ID NO: 5091 - protein, 48 aa, homo sapiens; identical to SEQ ID NO: 5083

SEQ ID NO: 5092 - DNA, 147 bp, homo sapiens; identical to SEQ ID NO: 5084

SEQ ID NO: 5093 - protein, 30 aa, homo sapiens; identical to SEQ ID NO: 5085

SEQ ID NO: 5094 - DNA, 93 bp, homo sapiens; identical to SEQ ID NO: 5086

SEQ ID NO: 5095 - protein, 6 aa, homo sapiens
MKLLPH

SEQ ID NO: 5096 - DNA, 21 bp, homo sapiens
atgaagctcttgcctcattga

SEQ ID NO: 5097 - protein, 72 aa, homo sapiens
MGRLRPSPPPLAPSLAPYSASLSSSPLPQQWRGDTEQAEATSPRAHPPAPRPCSARARSCATPQPPRCLRLR

SEQ ID NO: 5098 - DNA, 219 bp, homo sapiens
atggggcgcctccgcccctctccgccgcctctggcgccttcgcttgcgccctactctgcctcgctcagcagcagccccctcccccaacaatggcgcggggacactgagcaagcagaggccacctcgcccagggctcacccgcccgccccgcggccctgctccgccagggctcggtcctgcgccacaccccagccgccacgctgcctccgcctccggtga

SEQ ID NO: 5099 - protein, 5 aa, homo sapiens
MARGH

SEQ ID NO: 5100 - DNA, 18 bp, homo sapiens
atggcgcggggacactga

SEQ ID NO: 5101 - protein, 19 aa, homo sapiens
MHVYIHPSTIHNTKDMEST

SEQ ID NO: 5102 - DNA, 60 bp, homo sapiens
atgcatgtgtatattcaccccagcactattcacaataccaaagacatggaatcaacctaa

SEQ ID NO: 5103 - protein, 32 aa, homo sapiens
MCIFTPALFTIPKTWNQPKCPSMTDCIKKMYI

SEQ ID NO: 5104 - DNA, 99 bp, homo sapiens
atgtgtatattcaccccagcactattcacaataccaaagacatggaatcaacctaaatgcccatcaatgacagactgcataaagaaaatgtacatataa

SEQ ID NO: 5105 - protein, 19 aa, homo sapiens
MLSKVLPVLLGILLILQSR

SEQ ID NO: 5106 - DNA, 60 bp, homo sapiens
atgttgtccaaagttcttccagtcctcctaggcatcttattgatcctccagtcgaggtga

SEQ ID NO: 5107 - protein, 17 aa, homo sapiens
MRAGLGPPHCRMGSRGP

SEQ ID NO: 5108 - DNA, 54 bp, homo sapiens
atgcgcgccggcctcggcccgcctcactgtaggatgggctcccggggtccttga

SEQ ID NO: 5109 - protein, 65 aa, homo sapiens
MCECCLVCSLLLTFFLRVPTEFQALRQATLTLLASHAAAPVGASLRHELWFSLRVPAPAMPPLHR

SEQ ID NO: 5110 - DNA, 198 bp, homo sapiens
atgtgtgagtgttgcctcgtgtgttctctgctgctcacattttttttaagagtgcctactgagttccaggcactgcgccaggcaactctgacattacttgcttcccatgccgctgctcctgttggtgccagtctcaggcacgagctttggtttagtctaagggttcccgcaccagctatgccccctctccaccgctga

SEQ ID NO: 5111 - protein, 17 aa, homo sapiens
MPLLLLVPVSGTSFGLV

SEQ ID NO: 5112 - DNA, 54 bp, homo sapiens
atgccgctgctcctgttggtgccagtctcaggcacgagctttggtttagtctaa

SEQ ID NO: 5113 - protein, 10 aa, homo sapiens
MAPFGLPRAQ

SEQ ID NO: 5114 - DNA, 33 bp, homo sapiens; identical to SEQ ID NO: 2842

SEQ ID NO: 5115 - protein, 151 aa, homo sapiens; identical to SEQ ID NO: 2843

SEQ ID NO: 5116 - DNA, 456 bp, homo sapiens; identical to SEQ ID NO: 2844

SEQ ID NO: 5117 - protein, 41 aa, homo sapiens; identical to SEQ ID NO: 2845

SEQ ID NO: 5118 - DNA, 126 bp, homo sapiens; identical to SEQ ID NO: 2846

SEQ ID NO: 5119 - protein, 101 aa, homo sapiens; identical to SEQ ID NO: 2847

SEQ ID NO: 5120 - DNA, 306 bp, homo sapiens; identical to SEQ ID NO: 2848

SEQ ID NO: 5121 - protein, 95 aa, homo sapiens
MVPWVPGDPAKGLSHGMRFPSPPAQPRLCGTPTCPPPARTARHWEGREAASGGLLSRLRLGLALLQAGRIRRLRRRQGEGAGYFYLPPGSRGDRK

SEQ ID NO: 5122 - DNA, 288 bp, homo sapiens
atggttccctgggttcctggtgacccagctaagggcctttctcatgggatgcgcttccccagtcccccagcgcagcctaggctctgtggcacccctacttgcccccctcctgccaggacagcgaggcactgggagggacgggaggcggcctcagggggcctcctctcccggctgaggctcggcctcgccctcctccaggctgggaggatccgccgtctgcgccgccggcagggggagggggcgggttatttttacctccctccaggcagccggggcgacaggaagtga

SEQ ID NO: 5123 - protein, 43 aa, homo sapiens
MGCASPVPQRSLGSVAPLLAPLLPGQRGTGRDGRRPQGASSPG

SEQ ID NO: 5124 - DNA, 132 bp, homo sapiens
atgggatgcgcttccccagtcccccagcgcagcctaggctctgtggcacccctacttgcccccctcctgccaggacagcgaggcactgggagggacgggaggcggcctcagggggcctcctctcccggctga

SEQ ID NO: 5125 - protein, 21 aa, homo sapiens
MWGARELGTATAGLAAGRERG

SEQ ID NO: 5126 - DNA, 66 bp, homo sapiens
atgtggggagccagggagctgggaacagccacagctggactggcggccggccgggagcggggttag

SEQ ID NO: 5127 - protein, 75 aa, homo sapiens
MWVVASLSLIWAPIPSLARGLSDPGQGGGPCPSPQGPPGPSRVGGKRGRRPLAGPACHRHCLPVGCLLGNLTRPR

SEQ ID NO: 5128 - DNA, 228 bp, homo sapiens
atgtgggtcgtggcctcgctgtccctcatctgggcgccaatcccctcgctggctcgagggctctcagatcctgggcagggagggggaccctgcccctcgccccagggacccccaggtcccagcagagtcgggggtaagagggggagacggcctctcgccggccccgcctgccaccgccattgtttacccgtcggctgcctcctaggaaacttaacccgcccgcggtaa

SEQ ID NO: 5129 - protein, 16 aa, homo sapiens
MRPRARVDDVTRRVPG

SEQ ID NO: 5130 - DNA, 51 bp, homo sapiens
atgcggccccgggcgcgtgtggatgacgtcacccggcgcgtgccggggtag

SEQ ID NO: 5131 - protein, 11 aa, homo sapiens
MTSPGACRGSP

SEQ ID NO: 5132 - DNA, 36 bp, homo sapiens
atgacgtcacccggcgcgtgccggggtagcccgtag

SEQ ID NO: 5133 - protein, 40 aa, homo sapiens
MAAGTASFRSEGDGEPSLTLTFARPARTRIPSSVLPDSWG

SEQ ID NO: 5134 - DNA, 123 bp, homo sapiens
atggcggcggggacagcatcattccgttctgaaggcgacggggaaccctcccttaccctcacttttgctcgaccagcgaggacccgcatcccctcctcagttctcccagactcctggggctga

SEQ ID NO: 5135 - protein, 12 aa, homo sapiens
MNACMGGEGVAQ

SEQ ID NO: 5136 - DNA, 39 bp, homo sapiens
atgaacgcatgcatgggcggggagggggtggcacagtaa

SEQ ID NO: 5137 - protein, 48 aa, homo sapiens
MPARAGGRPAGGGAAAIPLRQAPPPLGARPPARAAAQAPRPPPAPRLR

SEQ ID NO: 5138 - DNA, 147 bp, homo sapiens
atgccggcgcgggcgggagggcgacctgcgggaggcggcgcggccgctatacctttaaggcaggccccgcccccgctcggtgcccgcccgcccgcccgcgccgccgcccaggccccgcgcccgccgcccgcgccgcgcctgaggtga

SEQ ID NO: 5139 - protein, 31 aa, homo sapiens
MRTPGGRRARAPAPPLRPPRPRARYGAGTPS

SEQ ID NO: 5140 - DNA, 96 bp, homo sapiens
atgcggaccccgggcgggcgcagggcgcgggctccggcgccgccgctgcgtcctccccggccgcgggcgaggtacggggcgggcacgccgagttag

SEQ ID NO: 5141 - protein, 15 aa, homo sapiens
MAVRTLSPSLKCCGF

SEQ ID NO: 5142 - DNA, 48 bp, homo sapiens
atggccgtcaggaccctgtcgccttctttgaaatgctgtggtttttga

SEQ ID NO: 5143 - protein, 14 aa, homo sapiens
MLWFLNLRSRNGLE

SEQ ID NO: 5144 - DNA, 45 bp, homo sapiens
atgctgtggtttttgaacctcaggtcacgaaatggattggagtga

SEQ ID NO: 5145 - protein, 16 aa, homo sapiens
MRPRARVDDVTRRVPG

SEQ ID NO: 5146 - DNA, 51 bp, homo sapiens; identical to SEQ ID NO: 5130

SEQ ID NO: 5147 - protein, 11 aa, homo sapiens
MTSPGACRGSP

SEQ ID NO: 5148 - DNA, 36 bp, homo sapiens; identical to SEQ ID NO: 5132

SEQ ID NO: 5149 - protein, 40 aa, homo sapiens; identical to SEQ ID NO: 5133

SEQ ID NO: 5150 - DNA, 123 bp, homo sapiens; identical to SEQ ID NO: 5134

SEQ ID NO: 5151 - protein, 12 aa, homo sapiens
MNACMGGEGVAQ

SEQ ID NO: 5152 - DNA, 39 bp, homo sapiens; identical to SEQ ID NO: 5136

SEQ ID NO: 5153 - protein, 48 aa, homo sapiens; identical to SEQ ID NO: 5137

SEQ ID NO: 5154 - DNA, 147 bp, homo sapiens; identical to SEQ ID NO: 5138

SEQ ID NO: 5155 - protein, 31 aa, homo sapiens; identical to SEQ ID NO: 5139

SEQ ID NO: 5156 - DNA, 96 bp, homo sapiens; identical to SEQ ID NO: 5140

SEQ ID NO: 5157 - protein, 15 aa, homo sapiens
MAVRTLSPSLKCCGF

SEQ ID NO: 5158 - DNA, 48 bp, homo sapiens; identical to SEQ ID NO: 5142

SEQ ID NO: 5159 - protein, 14 aa, homo sapiens
MLWFLNLRSRNGLE

SEQ ID NO: 5160 - DNA, 45 bp, homo sapiens; identical to SEQ ID NO: 5144

SEQ ID NO: 5161 - protein, 10 aa, homo sapiens
MAPFGLPRAQ

SEQ ID NO: 5162 - DNA, 33 bp, homo sapiens; identical to SEQ ID NO: 2842

SEQ ID NO: 5163 - protein, 151 aa, homo sapiens; identical to SEQ ID NO: 2843

SEQ ID NO: 5164 - DNA, 456 bp, homo sapiens; identical to SEQ ID NO: 2844

SEQ ID NO: 5165 - protein, 41 aa, homo sapiens; identical to SEQ ID NO: 2845

SEQ ID NO: 5166 - DNA, 126 bp, homo sapiens; identical to SEQ ID NO: 2846

SEQ ID NO: 5167 - protein, 101 aa, homo sapiens; identical to SEQ ID NO: 2847

SEQ ID NO: 5168 - DNA, 306 bp, homo sapiens; identical to SEQ ID NO: 2848

SEQ ID NO: 5169 - protein, 95 aa, homo sapiens; identical to SEQ ID NO: 5121

SEQ ID NO: 5170 - DNA, 288 bp, homo sapiens; identical to SEQ ID NO: 5122

SEQ ID NO: 5171 - protein, 43 aa, homo sapiens; identical to SEQ ID NO: 5123

SEQ ID NO: 5172 - DNA, 132 bp, homo sapiens; identical to SEQ ID NO: 5124

SEQ ID NO: 5173 - protein, 21 aa, homo sapiens
MWGARELGTATAGLAAGRERG

SEQ ID NO: 5174 - DNA, 66 bp, homo sapiens; identical to SEQ ID NO: 5126

SEQ ID NO: 5175 - protein, 75 aa, homo sapiens; identical to SEQ ID NO: 5127

SEQ ID NO: 5176 - DNA, 228 bp, homo sapiens; identical to SEQ ID NO: 5128

SEQ ID NO: 5177 - protein, 89 aa, homo sapiens; identical to SEQ ID NO: 3913

SEQ ID NO: 5178 - DNA, 270 bp, homo sapiens; identical to SEQ ID NO: 3914

SEQ ID NO: 5179 - protein, 32 aa, homo sapiens [sequence omitted]

SEQ ID NO: 5180 - DNA, 99 bp, homo sapiens; identical to SEQ ID NO: 3916

SEQ ID NO: 5181 - protein, 5 aa, homo sapiens
MLKKS

SEQ ID NO: 5182 - DNA, 18 bp, homo sapiens
atgttgaagaaaagctag

SEQ ID NO: 5183 - protein, 17 aa, homo sapiens
MANGWTGSRPGRRNPEL

SEQ ID NO: 5184 - DNA, 54 bp, homo sapiens; identical to SEQ ID NO: 3920

SEQ ID NO: 5185 - protein, 84 aa, homo sapiens
MVTRRRPLEPSGGGGGSWGAGPGRLSQSAGPGGGRAQAAAASAPPRRAPAPPAPRPRALGLRGAGPAGGRRAAHPWTARPSSPR

SEQ ID NO: 5186 - DNA, 255 bp, homo sapiens
atggtgacgaggcggcggccgctcgagcccagcggcggcggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtga

SEQ ID NO: 5187 - protein, 84 aa, homo sapiens [sequence omitted]

SEQ ID NO: 5188 - DNA, 255 bp, homo sapiens
atggacggcccggccatcatcacccaggtgaccaaccccaaggaggacgagggccggttgccgggcgcgggcgagaaaggtgaggaggggcgcaggcggccgcgggctgggggcgagcgcacaccccgcgccgctggagttcactgccgggcgccggcatgggcctgggggaggggtgcacagggcccggagggtgcgtgggtgtggggtgcgcccggaggagagcgaggctgccagagtgcgtgtgccgactga

SEQ ID NO: 5189 - protein, 51 aa, homo sapiens
MGLGEGCTGPGGCVGVGCARRRARLPECVCRLSQCECAGAGGETGSECVCI

SEQ ID NO: 5190 - DNA, 156 bp, homo sapiens
atgggcctgggggaggggtgcacagggcccggagggtgcgtgggtgtggggtgcgcccggaggagagcgaggctgccagagtgcgtgtgccgactgagccagtgtgagtgtgcaggggctggcggagagactgggagcgagtgtgtgtgcatctaa

SEQ ID NO: 5191 - protein, 24 aa, homo sapiens
MCVCTRGQSDCKDMCAPHREVVRL

SEQ ID NO: 5192 - DNA, 75 bp, homo sapiens
atgtgtgtgtgcacacgcggacagagtgattgtaaggatatgtgtgcacctcacagagaggttgtgagattgtaa

SEQ ID NO: 5193 - protein, 9 aa, homo sapiens
MERNVWSLI

SEQ ID NO: 5194 - DNA, 30 bp, homo sapiens
atggaaagaaatgtgtggtcattgatttag

SEQ ID NO: 5195 - protein, 4 aa, homo sapiens
MCGH

SEQ ID NO: 5196 - DNA, 15 bp, homo sapiens
atgtgtggtcattga

SEQ ID NO: 5197 - protein, 10 aa, homo sapiens
MKHWCTVRLR

SEQ ID NO: 5198 - DNA, 33 bp, homo sapiens
atgaaacattggtgcacagttcgtttaaggtaa

SEQ ID NO: 5199 - protein, 5 aa, homo sapiens
MIFVI

SEQ ID NO: 5200 - DNA, 18 bp, homo sapiens
atgatctttgtgatttga

SEQ ID NO: 5201 - protein, 5 aa, homo sapiens
MLDPN

SEQ ID NO: 5202 - DNA, 18 bp, homo sapiens
atgttggacccaaactga

SEQ ID NO: 5203 - protein, 39 aa, homo sapiens
MEHGSIITQARREDALVLTKQGRGSNFPKLCVAPGRGGG

SEQ ID NO: 5204 - DNA, 120 bp, homo sapiens
atggaacacggctccatcatcacccaggcgcggagggaagacgccctggtgctcaccaagcaaggtaggggcagcaacttcccaaaactttgcgtcgcccccgggcgcggagggggctag

SEQ ID NO: 5205 - protein, 8 aa, homo sapiens
MASDPAWF

SEQ ID NO: 5206 - DNA, 27 bp, homo sapiens
atggcatcagacccggcgtggttctga

SEQ ID NO: 5207 - protein, 4 aa, homo sapiens
MCPK

SEQ ID NO: 5208 - DNA, 15 bp, homo sapiens
atgtgtccaaaatag

SEQ ID NO: 5209 - protein, 13 aa, homo sapiens
MFASASREGNSML

SEQ ID NO: 5210 - DNA, 42 bp, homo sapiens
atgtttgcatccgcctcgcgggaaggaaactccatgttgtaa

SEQ ID NO: 5211 - protein, 161 aa, homo sapiens
MDSSAVITQISKEEARGPLRGKGTGAAGRGPKPGRRGRREGAGIFPRGAAAAAPGGRLSCARSSQPEREQGESLNSEEAQRRGAGPGAFGALLFARGEETEAGIERELFGGFLAGIAWCMGAPPPLAPMGLGDGGAEEGAYGPPAETPPHPPPPPPRAAVR

SEQ ID NO: 5212 - DNA, 486 bp, homo sapiens
atggacagctcggccgtcattactcagatcagcaaggaggaggctcggggcccgctgcggggcaaaggtaccggggctgcggggagggggccgaagccggggcgccgtgggaggagagaaggggccgggatcttccccaggggagccgccgccgccgccccgggcggccgccttagctgtgcccgaagctcccagcccgagagggagcagggagagagtttgaactcagaggaggctcagagacgcggggcggggcctggcgcctttggggcgctcctgttcgctcgaggtgaggaaactgaggcaggaatagagagggaactcttcgggggtttcctggcaggcattgcgtggtgcatgggcgcccccccaccattggcgccaatggggctgggagatgggggagctgaggagggcgcctatgggccacccgctgagactccgccccaccccccacccccacccccccgggctgcggtccggtag

SEQ ID NO: 5213 - protein, 156 aa, homo sapiens
MGELRRAPMGHPLRLRPTPHPHPPGLRSGRVLGGGAEVTAGWGGLEGSPANTQLRSPQTSRHAWRRRPPRRHREDGRHFQESLGARGESRAPSGHAPPRKASPPRRGCVPQRGWAGVGGSVFSFSPCGPQDLDAAPRSAHPRLGLAAPELRARWKG

SEQ ID NO: 5214 - DNA, 471 bp, homo sapiens
atgggggagctgaggagggcgcctatgggccacccgctgagactccgccccaccccccacccccacccccccgggctgcggtccggtagggtcttgggagggggcgccgaggtgacagcaggctggggaggcttggagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtctgcccaccctcgcctgggtctggctgccccggaactgagggcaaggtggaaaggctag

SEQ ID NO: 5215 - protein, 21 aa, homo sapiens
MATGHWPQAAGLHPCLWAQPQ

SEQ ID NO: 5216 - DNA, 66 bp, homo sapiens
atggccactggacactggccccaggccgcgggactgcacccctgcctctgggcccagccgcagtga

SEQ ID NO: 5217 - protein, 10 aa, homo sapiens
MAPFGLPRAQ

SEQ ID NO: 5218 - DNA, 33 bp, homo sapiens; identical to SEQ ID NO: 2842

SEQ ID NO: 5219 - protein, 151 aa, homo sapiens; identical to SEQ ID NO: 2843

SEQ ID NO: 5220 - DNA, 456 bp, homo sapiens; identical to SEQ ID NO: 2844

SEQ ID NO: 5221 - protein, 41 aa, homo sapiens; identical to SEQ ID NO: 2845

SEQ ID NO: 5222 - DNA, 126 bp, homo sapiens; identical to SEQ ID NO: 2846

SEQ ID NO: 5223 - protein, 101 aa, homo sapiens; identical to SEQ ID NO: 2847

SEQ ID NO: 5224 - DNA, 306 bp, homo sapiens; identical to SEQ ID NO: 2848

SEQ ID NO: 5225 - protein, 95 aa, homo sapiens; identical to SEQ ID NO: 5121

SEQ ID NO: 5226 - DNA, 288 bp, homo sapiens; identical to SEQ ID NO: 5122

SEQ ID NO: 5227 - protein, 43 aa, homo sapiens; identical to SEQ ID NO: 5123

SEQ ID NO: 5228 - DNA, 132 bp, homo sapiens; identical to SEQ ID NO: 5124

SEQ ID NO: 5229 - protein, 21 aa, homo sapiens
MWGARELGTATAGLAAGRERG

SEQ ID NO: 5230 - DNA, 66 bp, homo sapiens; identical to SEQ ID NO: 5126

SEQ ID NO: 5231 - protein, 75 aa, homo sapiens; identical to SEQ ID NO: 5127

SEQ ID NO: 5232 - DNA, 228 bp, homo sapiens; identical to SEQ ID NO: 5128

SEQ ID NO: 5233 - protein, 16 aa, homo sapiens
MRPRARVDDVTRRVPG

SEQ ID NO: 5234 - DNA, 51 bp, homo sapiens; identical to SEQ ID NO: 5130

SEQ ID NO: 5235 - protein, 11 aa, homo sapiens
MTSPGACRGSP

SEQ ID NO: 5236 - DNA, 36 bp, homo sapiens; identical to SEQ ID NO: 5132

SEQ ID NO: 5237 - protein, 40 aa, homo sapiens; identical to SEQ ID NO: 5133

SEQ ID NO: 5238 - DNA, 123 bp, homo sapiens; identical to SEQ ID NO: 5134

SEQ ID NO: 5239 - protein, 12 aa, homo sapiens
MNACMGGEGVAQ

SEQ ID NO: 5240 - DNA, 39 bp, homo sapiens; identical to SEQ ID NO: 5136

SEQ ID NO: 5241 - protein, 48 aa, homo sapiens; identical to SEQ ID NO: 5137

SEQ ID NO: 5242 - DNA, 147 bp, homo sapiens; identical to SEQ ID NO: 5138

SEQ ID NO: 5243 - protein, 31 aa, homo sapiens; identical to SEQ ID NO: 5139

SEQ ID NO: 5244 - DNA, 96 bp, homo sapiens; identical to SEQ ID NO: 5140

SEQ ID NO: 5245 - protein, 15 aa, homo sapiens
MAVRTLSPSLKCCGF

SEQ ID NO: 5246 - DNA, 48 bp, homo sapiens; identical to SEQ ID NO: 5142

SEQ ID NO: 5247 - protein, 14 aa, homo sapiens
MLWFLNLRSRNGLE

SEQ ID NO: 5248 - DNA, 45 bp, homo sapiens; identical to SEQ ID NO: 5144

SEQ ID NO: 5249 - protein, 37 aa, homo sapiens
MVMGHVAGSAGHFYLGVWTAAFPGEYFLQWDFKTRSA

SEQ ID NO: 5250 - DNA, 114 bp, homo sapiens
atggtgatgggacacgttgctgggagtgctggtcacttttatttgggggtgtggacagctgctttcccaggggagtacttcttacagtgggatttcaagacaagatcggcctga

SEQ ID NO: 5251 - protein, 41 aa, homo sapiens [sequence omitted]

SEQ ID NO: 5252 - DNA, 126 bp, homo sapiens
atgattaaggctaaagcaacaagctggaagggatgtcgggatgtctgtggacatgtagggaggggtagttttagcttgaaaacagttatggtgggatttaagagtatgcaaaatgttgatgtgtag

SEQ ID NO: 5253 - protein, 11 aa, homo sapiens
MSGCLWTCREG

SEQ ID NO: 5254 - DNA, 36 bp, homo sapiens
atgtcgggatgtctgtggacatgtagggaggggtag

SEQ ID NO: 5255 - protein, 5 aa, homo sapiens
MSVDM

SEQ ID NO: 5256 - DNA, 18 bp, homo sapiens
atgtctgtggacatgtag

SEQ ID NO: 5257 - protein, 9 aa, homo sapiens
MIGLPRALR

SEQ ID NO: 5258 - DNA, 30 bp, homo sapiens
atgattggcttacctcgggctcttcgctag

SEQ ID NO: 5259 - protein, 96 aa, homo sapiens [sequence omitted]

SEQ ID NO: 5260 - DNA, 291 bp, homo sapiens
atgagaagtgaggaaacgcttagcgcaaaaggaaaaagagagaaagacatacagaaacaaggttacgcggaggccggcgaaaagcgattccccgctcccccaggccaagggccccgcttatttcccgggaggccccgccaccttccccgcgtgtcctccgcaccgcttgccgcagagcgcccgggcgcaggtaccaccagagtgtgcgaacagcgaaagttttttgcccgggccatggcgcaaaccacaacacagcccgttcccaagtacaagtacacagtcggcgggtaa

SEQ ID NO: 5261 - protein, 18 aa, homo sapiens
MHRRTQNMDTNTHQRQAV

SEQ ID NO: 5262 - DNA, 57 bp, homo sapiens
atgcacaggcgaacacagaatatggacaccaacacacaccaacgacaagctgtctga

SEQ ID NO: 5263 - protein, 29 aa, homo sapiens
MTPAHRGPHQPSQGSPGAPGPLPGSSWLT

SEQ ID NO: 5264 - DNA, 90 bp, homo sapiens
atgaccccagcccaccgtggaccccaccagcctagccaggggagtcccggggccccggggcccctccccggcagttcctggctcacctga

SEQ ID NO: 5265 - protein, 9 aa, homo sapiens
MIGLPRALR

SEQ ID NO: 5266 - DNA, 30 bp, homo sapiens; identical to SEQ ID NO: 5258

SEQ ID NO: 5267 - protein, 96 aa, homo sapiens [sequence omitted]

SEQ ID NO: 5268 - DNA, 291 bp, homo sapiens; identical to SEQ ID NO: 5260

SEQ ID NO: 5269 - protein, 18 aa, homo sapiens
MHRRTQNMDTNTHQRQAV

SEQ ID NO: 5270 - DNA, 57 bp, homo sapiens; identical to SEQ ID NO: 5262

SEQ ID NO: 5271 - protein, 29 aa, homo sapiens
MTPAHRGPHQPSQGSPGAPGPLPGSSWLT

SEQ ID NO: 5272 - DNA, 90 bp, homo sapiens; identical to SEQ ID NO: 5264

SEQ ID NO: 5273 - protein, 22 aa, homo sapiens
MDQGVEGGGCGPGVGRQSACSL

SEQ ID NO: 5274 - DNA, 69 bp, homo sapiens; identical to SEQ ID NO: 4146

SEQ ID NO: 5275 - protein, 28 aa, homo sapiens
MKDGKEGYRDRGRVGLRIARAAWHTVLG

SEQ ID NO: 5276 - DNA, 87 bp, homo sapiens; identical to SEQ ID NO: 4148

SEQ ID NO: 5277 - protein, 41 aa, homo sapiens; identical to SEQ ID NO: 4149

SEQ ID NO: 5278 - DNA, 126 bp, homo sapiens; identical to SEQ ID NO: 4150

SEQ ID NO: 5279 - protein, 16 aa, homo sapiens
MILFPLDPAPLVPFSL

SEQ ID NO: 5280 - DNA, 51 bp, homo sapiens; identical to SEQ ID NO: 4152

SEQ ID NO: 5281 - protein, 35 aa, homo sapiens
MCHTVFCNSSFCPSSLACIDPLKAMIRAGRRGSRL

SEQ ID NO: 5282 - DNA, 108 bp, homo sapiens
atgtgtcatactgtgttctgtaattcctctttttgtccatcttccctggcttgcattgaccccttaaaagccatgattagggccgggcgccgtggctcacgcctgtaa

SEQ ID NO: 5283 - protein, 16 aa, homo sapiens
MISVYFWINTRTHDRE

SEQ ID NO: 5284 - DNA, 51 bp, homo sapiens
atgatcagtgtttacttttggataaacacccggacacatgatagagaataa

SEQ ID NO: 5285 - protein, 19 aa, homo sapiens
MIENKCLRERNDLLGNTKN

SEQ ID NO: 5286 - DNA, 60 bp, homo sapiens
atgatagagaataaatgtttgagagagagaaatgacctactgggtaacaccaaaaactaa

SEQ ID NO: 5287 - protein, 6 aa, homo sapiens
MFEREK

SEQ ID NO: 5288 - DNA, 21 bp, homo sapiens
atgtttgagagagagaaatga

SEQ ID NO: 5289 - protein, 35 aa, homo sapiens; identical to SEQ ID NO: 5281

SEQ ID NO: 5290 - DNA, 108 bp, homo sapiens; identical to SEQ ID NO: 5282

SEQ ID NO: 5291 - protein, 16 aa, homo sapiens
MISVYFWINTRTHDRE

SEQ ID NO: 5292 - DNA, 51 bp, homo sapiens; identical to SEQ ID NO: 5284

SEQ ID NO: 5293 - protein, 19 aa, homo sapiens
MIENKCLRERNDLLGNTKN

SEQ ID NO: 5294 - DNA, 60 bp, homo sapiens; identical to SEQ ID NO: 5286

SEQ ID NO: 5295 - protein, 6 aa, homo sapiens
MFEREK

SEQ ID NO: 5296 - DNA, 21 bp, homo sapiens
atgtttgagagagagaaatga

SEQ ID NO: 5297 - protein, 22 aa, homo sapiens
MVTLALGAFLHTSPTQFPQRLL

SEQ ID NO: 5298 - DNA, 69 bp, homo sapiens
atggtaactctggctctaggagcattccttcatacctccccgacacagtttccccagaggctgttataa

SEQ ID NO: 5299 - protein, 6 aa, homo sapiens
MVLNLC

SEQ ID NO: 5300 - DNA, 21 bp, homo sapiens
atggtcttaaacttatgttga

SEQ ID NO: 5301 - protein, 6 aa, homo sapiens
MLRQLH

SEQ ID NO: 5302 - DNA, 21 bp, homo sapiens
atgttgagacaactgcactga

SEQ ID NO: 5303 - protein, 5 aa, homo sapiens
MAGAV

SEQ ID NO: 5304 - DNA, 18 bp, homo sapiens
atggcaggcgctgtgtga

SEQ ID NO: 5305 - protein, 22 aa, homo sapiens
MVTLALGAFLHTSPTQFPQRLL

SEQ ID NO: 5306 - DNA, 69 bp, homo sapiens; identical to SEQ ID NO: 5298

SEQ ID NO: 5307 - protein, 6 aa, homo sapiens
MVLNLC

SEQ ID NO: 5308 - DNA, 21 bp, homo sapiens
atggtcttaaacttatgttga

SEQ ID NO: 5309 - protein, 6 aa, homo sapiens
MLRQLH

SEQ ID NO: 5310 - DNA, 21 bp, homo sapiens
atgttgagacaactgcactga

SEQ ID NO: 5311 - protein, 5 aa, homo sapiens
MAGAV

SEQ ID NO: 5312 - DNA, 18 bp, homo sapiens
atggcaggcgctgtgtga

SEQ ID NO: 5313 - protein, 22 aa, homo sapiens
MDQGVEGGGCGPGVGRQSACSL

SEQ ID NO: 5314 - DNA, 69 bp, homo sapiens; identical to SEQ ID NO: 4146

SEQ ID NO: 5315 - protein, 28 aa, homo sapiens
MKDGKEGYRDRGRVGLRIARAAWHTVLG

SEQ ID NO: 5316 - DNA, 87 bp, homo sapiens; identical to SEQ ID NO: 4148

SEQ ID NO: 5317 - protein, 41 aa, homo sapiens; identical to SEQ ID NO: 4149

SEQ ID NO: 5318 - DNA, 126 bp, homo sapiens; identical to SEQ ID NO: 4150

SEQ ID NO: 5319 - protein, 16 aa, homo sapiens
MILFPLDPAPLVPFSL

SEQ ID NO: 5320 - DNA, 51 bp, homo sapiens; identical to SEQ ID NO: 4152

SEQ ID NO: 5321 - protein, 51 aa, homo sapiens
MGGSRWNGGANECEMLSDSCPMEALRASTACGLSAAAVCGMSTIQHGGGGR

SEQ ID NO: 5322 - DNA, 156 bp, homo sapiens
atgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataa

SEQ ID NO: 5323 - protein, 5 aa, homo sapiens
MSARC

SEQ ID NO: 5324 - DNA, 18 bp, homo sapiens
atgagtgcgagatgttga

SEQ ID NO: 5325 - protein, 15 aa, homo sapiens
MEAEVDKLELMVSAK

SEQ ID NO: 5326 - DNA, 48 bp, homo sapiens
atggaggcggaggtcgataagctggaactgatggtgagtgcaaagtga

SEQ ID NO: 5327 - protein, 43 aa, homo sapiens
MASEVGHNLESPETPGGGGWTRVEFPPPAPKGAATVWCLNRLG

SEQ ID NO: 5328 - DNA, 132 bp, homo sapiens
atggcctcggaggtggggcacaatttggagtcgccggaaactccgggcggcggaggctggaccagagtcgagttccctcctcctgcaccaaagggagccgccaccgtctggtgtctaaaccgcctcgggtaa

SEQ ID NO: 5329 - protein, 25 aa, homo sapiens
MPGAGPTIYTASHLLLATASPMGQV

SEQ ID NO: 5330 - DNA, 78 bp, homo sapiens; identical to SEQ ID NO: 2598

SEQ ID NO: 5331 - protein, 38 aa, homo sapiens; identical to SEQ ID NO: 2599

SEQ ID NO: 5332 - DNA, 117 bp, homo sapiens; identical to SEQ ID NO: 2600

SEQ ID NO: 5333 - protein, 69 aa, homo sapiens; identical to SEQ ID NO: 4117

SEQ ID NO: 5334 - DNA, 210 bp, homo sapiens; identical to SEQ ID NO: 4118

SEQ ID NO: 5335 - protein, 64 aa, homo sapiens; identical to SEQ ID NO: 4119

SEQ ID NO: 5336 - DNA, 195 bp, homo sapiens; identical to SEQ ID NO: 4120

SEQ ID NO: 5337 - protein, 30 aa, homo sapiens
MVLAVNIDICILQKKKKGSRPTQDHTFPES

SEQ ID NO: 5338 - DNA, 93 bp, homo sapiens
atggttttagctgttaacattgacatctgtatacttcaaaaaaaaaaaaaaggatccagacccacccaggatcatacattccctgagagctga

SEQ ID NO: 5339 - protein, 10 aa, homo sapiens
MPFCFLSPQL

SEQ ID NO: 5340 - DNA, 33 bp, homo sapiens
atgccattttgttttctttctcctcagctctaa

SEQ ID NO: 5341 - protein, 15 aa, homo sapiens
MLGGLPSTLTWKCFL

SEQ ID NO: 5342 - DNA, 48 bp, homo sapiens
atgttgggtgggctcccttcaactttaacatggaagtgctttctgtga

SEQ ID NO: 5343 - protein, 15 aa, homo sapiens
MEVLSVTLKVSASMF

SEQ ID NO: 5344 - DNA, 48 bp, homo sapiens
atggaagtgctttctgtgactttaaaagtaagtgcttccatgttttag

SEQ ID NO: 5345 - protein, 30 aa, homo sapiens; identical to SEQ ID NO: 5337

SEQ ID NO: 5346 - DNA, 93 bp, homo sapiens; identical to SEQ ID NO: 5338

SEQ ID NO: 5347 - protein, 10 aa, homo sapiens
MPFCFLSPQL

SEQ ID NO: 5348 - DNA, 33 bp, homo sapiens; identical to SEQ ID NO: 5340

SEQ ID NO: 5349 - protein, 15 aa, homo sapiens
MLGGLPSTLTWKCFL

SEQ ID NO: 5350 - DNA, 48 bp, homo sapiens; identical to SEQ ID NO: 5342

SEQ ID NO: 5351 - protein, 15 aa, homo sapiens
MEVLSVTLKVSASMF

SEQ ID NO: 5352 - DNA, 48 bp, homo sapiens; identical to SEQ ID NO: 5344

SEQ ID NO: 5353 - protein, 30 aa, homo sapiens; identical to SEQ ID NO: 5337

SEQ ID NO: 5354 - DNA, 93 bp, homo sapiens; identical to SEQ ID NO: 5338

SEQ ID NO: 5355 - protein, 10 aa, homo sapiens
MPFCFLSPQL

SEQ ID NO: 5356 - DNA, 33 bp, homo sapiens; identical to SEQ ID NO: 5340

SEQ ID NO: 5357 - protein, 15 aa, homo sapiens
MLGGLPSTLTWKCFL

SEQ ID NO: 5358 - DNA, 48 bp, homo sapiens; identical to SEQ ID NO: 5342

SEQ ID NO: 5359 - protein, 15 aa, homo sapiens
MEVLSVTLKVSASMF

SEQ ID NO: 5360 - DNA, 48 bp, homo sapiens; identical to SEQ ID NO: 5344

SEQ ID NO: 5361 - protein, 30 aa, homo sapiens; identical to SEQ ID NO: 5337

SEQ ID NO: 5362 - DNA, 93 bp, homo sapiens; identical to SEQ ID NO: 5338

SEQ ID NO: 5363 - protein, 10 aa, homo sapiens
MPFCFLSPQL

SEQ ID NO: 5364 - DNA, 33 bp, homo sapiens; identical to SEQ ID NO: 5340

SEQ ID NO: 5365 - protein, 15 aa, homo sapiens
MLGGLPSTLTWKCFL

SEQ ID NO: 5366 - DNA, 48 bp, homo sapiens; identical to SEQ ID NO: 5342

SEQ ID NO: 5367 - protein, 15 aa, homo sapiens
MEVLSVTLKVSASMF

SEQ ID NO: 5368 - DNA, 48 bp, homo sapiens; identical to SEQ ID NO: 5344

SEQ ID NO: 5369 - protein, 46 aa, homo sapiens [sequence omitted]

SEQ ID NO: 5370 - DNA, 141 bp, homo sapiens
atgtcaagtgactttagctgcacagatggtgaagctgtgctttctgtggggcagccaccagccctgtgtggctatgaagcatttaaatgtggcaagtccagattgagatctgcagaagcatttagtacacattggatttaa

SEQ ID NO: 5371 - protein, 26 aa, homo sapiens
MVKLCFLWGSHQPCVAMKHLNVASPD

SEQ ID NO: 5372 - DNA, 81 bp, homo sapiens
atggtgaagctgtgctttctgtggggcagccaccagccctgtgtggctatgaagcatttaaatgtggcaagtccagattga

SEQ ID NO: 5373 - protein, 12 aa, homo sapiens
MWQVQIEICRSI

SEQ ID NO: 5374 - DNA, 39 bp, homo sapiens
atgtggcaagtccagattgagatctgcagaagcatttag

SEQ ID NO: 5375 - protein, 8 aa, homo sapiens
MKKYKISH

SEQ ID NO: 5376 - DNA, 27 bp, homo sapiens
atgaaaaaatacaaaatatctcattaa

SEQ ID NO: 5377 - protein, 117 aa, homo sapiens
MYTRAHSRSPSDTLEGKVKLKAREQRDRREPLPPPRAMTDAAEAAFSVRTPPIPSSRRAPCPPPLARPSPWRWRVPAPSPPAAPGAPRARGAGRWEREGGGRGGPAASSPDPRPRAR

SEQ ID NO: 5378 - DNA, 354 bp, homo sapiens
atgtacacgcgcgcgcacagccgctctccctcagacacactggagggaaaggtcaaactaaaggcgagggagcagagagaccggagggagccgctgccgccgccgcgcgccatgacggacgcggcggaggctgctttctcagtgcggacgccgccgatccccagctctcgccgcgccccctgccccccgcccctcgcgcgcccctcaccctggcgctggcgcgtccccgcgccctctcccccggccgctccaggcgcgcctcgggctcggggcgcggggcgctgggagcgggagggtgggggccgcggcgggccggcggcctcctcgcccgacccccgaccccgggccaggtga

SEQ ID NO: 5379 - protein, 15 aa, homo sapiens
MGRAAGGRWAPPRGS

SEQ ID NO: 5380 - DNA, 48 bp, homo sapiens; identical to SEQ ID NO: 676

SEQ ID NO: 5381 - protein, 42 aa, homo sapiens; identical to SEQ ID NO: 677

SEQ ID NO: 5382 - DNA, 129 bp, homo sapiens; identical to SEQ ID NO: 678

SEQ ID NO: 5383 - protein, 37 aa, homo sapiens; identical to SEQ ID NO: 679

SEQ ID NO: 5384 - DNA, 114 bp, homo sapiens; identical to SEQ ID NO: 680

SEQ ID NO: 5385 - protein, 69 aa, homo sapiens
MLCSCLARCCRRRRARGVRVPRRPGPRAFSHWRKATAGGLARDWSVAGRPRTWHLIGRASSGLGGDEGI

SEQ ID NO: 5386 - DNA, 210 bp, homo sapiens
atgttgtgctcttgcctggcccgctgctgtcgccgccgccgcgctcgtggggtccgtgtgcctcgtcggcccggcccgcgggctttctcccattggcggaaggcgacggcgggggggctcgctcgtgattggtcggtggcggggaggccgcggacctggcaccttattggacgcgccagctccggtctagggggtgatgaaggaatctga

SEQ ID NO: 5387 - protein, 52 aa, homo sapiens [sequence omitted]

SEQ ID NO: 5388 - DNA, 159 bp, homo sapiens
atgaaggaatctgaggctgcggggatgcgcgcgtcttgggctagggcggctggggcaatgaccccctgcggcgcaggcgtggggttgcggcgagagggcgagcctagaggctttaagggggaagagagggtgatggcctggcaggtactttgggggtag

SEQ ID NO: 5389 - protein, 39 aa, homo sapiens [sequence omitted]

SEQ ID NO: 5390 - DNA, 120 bp, homo sapiens
atggcctgggaatgggggacactcactttcagaggtgcttttcctggtacatgcatggcccaagattggggtgtgcaggccctcagggttccaggcttggaaacaccgaaacccaagtga

SEQ ID NO: 5391 - protein, 38 aa, homo sapiens
MGDTHFQRCFSWYMHGPRLGCAGPQGSRLGNTETQVTG

SEQ ID NO: 5392 - DNA, 117 bp, homo sapiens
atgggggacactcactttcagaggtgcttttcctggtacatgcatggcccaagattggggtgtgcaggccctcagggttccaggcttggaaacaccgaaacccaagtgacaggctga

SEQ ID NO: 5393 - protein, 40 aa, homo sapiens
MANSLLGGGRTAVRVFSGVDIPDSCFCISCCLLFPPSFGG

SEQ ID NO: 5394 - DNA, 123 bp, homo sapiens
atggcgaatagtttgttggggggtgggaggacagctgttcgggttttcagtggagtggacattccagactcatgtttctgcatctcctgctgccttttgtttcctccgtcctttggggggtag

SEQ ID NO: 5395 - protein, 22 aa, homo sapiens
MFLHLLLPFVSSVLWGVGIGVT

SEQ ID NO: 5396 - DNA, 69 bp, homo sapiens
atgtttctgcatctcctgctgccttttgtttcctccgtcctttggggggtagggataggagtgacttaa

SEQ ID NO: 5397 - protein, 14 aa, homo sapiens
MQFPVSLILCFVLK

SEQ ID NO: 5398 - DNA, 45 bp, homo sapiens
atgcagttcccggtaagtttaattctttgttttgtgttgaaatga

SEQ ID NO: 5399 - protein, 5 aa, homo sapiens
MIETV

SEQ ID NO: 5400 - DNA, 18 bp, homo sapiens
atgatagaaactgtttag

SEQ ID NO: 5401 - protein, 46 aa, homo sapiens [sequence omitted]

SEQ ID NO: 5402 - DNA, 141 bp, homo sapiens; identical to SEQ ID NO: 5370

SEQ ID NO: 5403 - protein, 26 aa, homo sapiens
MVKLCFLWGSHQPCVAMKHLNVASPD

SEQ ID NO: 5404 - DNA, 81 bp, homo sapiens; identical to SEQ ID NO: 5372

SEQ ID NO: 5405 - protein, 12 aa, homo sapiens
MWQVQIEICRSI

SEQ ID NO: 5406 - DNA, 39 bp, homo sapiens; identical to SEQ ID NO: 5374

SEQ ID NO: 5407 - protein, 8 aa, homo sapiens
MKKYKISH

SEQ ID NO: 5408 - DNA, 27 bp, homo sapiens
atgaaaaaatacaaaatatctcattaa

SEQ ID NO: 5409 - protein, 117 aa, homo sapiens; identical to SEQ ID NO: 5377

SEQ ID NO: 5410 - DNA, 354 bp, homo sapiens; identical to SEQ ID NO: 5378

SEQ ID NO: 5411 - protein, 15 aa, homo sapiens
MGRAAGGRWAPPRGS

SEQ ID NO: 5412 - DNA, 48 bp, homo sapiens; identical to SEQ ID NO: 676

SEQ ID NO: 5413 - protein, 42 aa, homo sapiens; identical to SEQ ID NO: 677

SEQ ID NO: 5414 - DNA, 129 bp, homo sapiens; identical to SEQ ID NO: 678

SEQ ID NO: 5415 - protein, 37 aa, homo sapiens; identical to SEQ ID NO: 679

SEQ ID NO: 5416 - DNA, 114 bp, homo sapiens; identical to SEQ ID NO: 680

SEQ ID NO: 5417 - protein, 69 aa, homo sapiens; identical to SEQ ID NO: 5385

SEQ ID NO: 5418 - DNA, 210 bp, homo sapiens; identical to SEQ ID NO: 5386

SEQ ID NO: 5419 - protein, 52 aa, homo sapiens [sequence omitted]

SEQ ID NO: 5420 - DNA, 159 bp, homo sapiens; identical to SEQ ID NO: 5388

SEQ ID NO: 5421 - protein, 39 aa, homo sapiens [sequence omitted]

SEQ ID NO: 5422 - DNA, 120 bp, homo sapiens; identical to SEQ ID NO: 5390

SEQ ID NO: 5423 - protein, 38 aa, homo sapiens; identical to SEQ ID NO: 5391

SEQ ID NO: 5424 - DNA, 117 bp, homo sapiens; identical to SEQ ID NO: 5392

SEQ ID NO: 5425 - protein, 40 aa, homo sapiens; identical to SEQ ID NO: 5393

SEQ ID NO: 5426 - DNA, 123 bp, homo sapiens; identical to SEQ ID NO: 5394

SEQ ID NO: 5427 - protein, 22 aa, homo sapiens
MFLHLLLPFVSSVLWGVGIGVT

SEQ ID NO: 5428 - DNA, 69 bp, homo sapiens; identical to SEQ ID NO: 5396

SEQ ID NO: 5429 - protein, 14 aa, homo sapiens
MQFPVSLILCFVLK

SEQ ID NO: 5430 - DNA, 45 bp, homo sapiens; identical to SEQ ID NO: 5398

SEQ ID NO: 5431 - protein, 5 aa, homo sapiens
MIETV

SEQ ID NO: 5432 - DNA, 18 bp, homo sapiens
atgatagaaactgtttag

SEQ ID NO: 5433 - protein, 112 aa, homo sapiens
MGRRCGNVHSRAPLSGTRAASQEELGEQLRPVHNLGRRQGLAGSTSGAWRRKTRVPGRGAEAGWGTAWSRARAGRRCSVSRLVWGAGGGKRPLRVRLGEAGRRFCPPTRTRR

SEQ ID NO: 5434 - DNA, 339 bp, homo sapiens
atggggcgaaggtgcgggaacgtccactcccgcgcgcccctctcggggaccagggcggcctcccaggaggagcttggtgagcagctgcgacctgtgcataacttggggcgccgccaggggctcgcaggttccacgtccggcgcctggagaaggaagacgcgcgtccccggccgcggcgccgaagccggctgggggaccgcctggtcccgggccagagctgggaggcggtgttccgtgagccgcctggtctggggtgcggggggcgggaagcggccccttcgtgtgcgcttgggcgaggccgggcggcgcttctgtcctcctactcggacccgcaggtaa

SEQ ID NO: 5435 - protein, 53 aa, homo sapiens
MRRGVRRIPERRPPLALRGTAASSCPNLRSSSWPEVTGSLSVPKPRGRSCVCP

SEQ ID NO: 5436 - DNA, 162 bp, homo sapiens
atgcgccgcggggtccggcgcatcccggagcgccggccgcccttggctcttcgcggaaccgccgcctcctcttgtccaaatctcaggtcgtcatcctggcccgaagtcacaggttcgctctctgtccctaaacctcgaggaaggagttgtgtgtgtccatga

SEQ ID NO: 5437 - protein, 15 aa, homo sapiens
MSVLAESAFIQRCLS

SEQ ID NO: 5438 - DNA, 48 bp, homo sapiens
atgagcgtgttggcggagagcgctttcatacagcgatgtttgagttga

SEQ ID NO: 5439 - protein, 15 aa, homo sapiens
MFELSSFYHLKLLSL

SEQ ID NO: 5440 - DNA, 48 bp, homo sapiens
atgtttgagttgagctcattttaccacctaaaattactgtcactttaa

SEQ ID NO: 5441 - protein, 256 aa, homo sapiens [sequence omitted]

SEQ ID NO: 5442 - DNA, 771 bp, homo sapiens
atggccgacggcggcggccctaaggacgcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtgggtgagtgagcggcagtccgcccccgtcccccgcccgtggtcccggcgctctggggtgcaatcctgcagctgttcctcccggtgcaggggcgacgaggggccacacctgtgctgcagtgaccgtccgtctccgctttccttctcacacctcaggaatttggcggacattcttccaaaaagggggcgggcgtga

SEQ ID NO: 5443 - protein, 106 aa, homo sapiens
MRHFSAPLQELADAPGPPLAAAPAPRAHAHRPGRAAPAALLRRLRRRGPGRAGAAPPPPAPAARRRRPAPVRPLLPRQLLGRAGAAGARCHAHLPRAGLLQQPVGE

SEQ ID NO: 5444 - DNA, 321 bp, homo sapiens
atgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtgggtgagtga

SEQ ID NO: 5445 - protein, 33 aa, homo sapiens
MAVGLGFTSGWRGRGCFGHPQFCASECQSWKGP

SEQ ID NO: 5446 - DNA, 102 bp, homo sapiens
atggcagtggggcttggttttacttctggttggagagggcgggggtgcttcggccaccctcagttctgcgcatctgaatgtcagagctggaagggaccttag

SEQ ID NO: 5447 - protein, 30 aa, homo sapiens
MSELEGTLEILGQLAILQIGKVTSYQARAT

SEQ ID NO: 5448 - DNA, 93 bp, homo sapiens
atgtcagagctggaagggaccttagagattctaggccaacttgccatcctgcagataggaaaggtgacctcttaccaggctagggctacttag

SEQ ID NO: 5449 - protein, 5 aa, homo sapiens
MGEQL

SEQ ID NO: 5450 - DNA, 18 bp, homo sapiens
atgggggaacagctctag

SEQ ID NO: 5451 - protein, 11 aa, homo sapiens
MDCHHNFPRQS

SEQ ID NO: 5452 - DNA, 36 bp, homo sapiens
atggactgtcaccacaattttccaaggcaaagttag

SEQ ID NO: 5453 - protein, 9 aa, homo sapiens
MAGRCGSCL

SEQ ID NO: 5454 - DNA, 30 bp, homo sapiens
atggctgggcgttgtggctcatgcctgtaa

SEQ ID NO: 5455 - protein, 38 aa, homo sapiens
MPVIPALWEAKVGGSRGQEFKISLAKMVKPVSTKNYKK

SEQ ID NO: 5456 - DNA, 117 bp, homo sapiens
atgcctgtaatcccagcactttgggaggccaaggtgggtggatcacgaggtcaggagttcaagatcagcctggccaagatggtgaaacccgtctctactaaaaactacaaaaagtag

SEQ ID NO: 5457 - protein, 18 aa, homo sapiens
MIQMSNCLYLTLFVYLQK

SEQ ID NO: 5458 - DNA, 57 bp, homo sapiens
atgatccagatgtccaattgcctctacttaaccttattcgtctaccttcagaagtaa

SEQ ID NO: 5459 - protein, 4 aa, homo sapiens
MVKL

SEQ ID NO: 5460 - DNA, 15 bp, homo sapiens
atggtgaagttataa

SEQ ID NO: 5461 - protein, 15 aa, homo sapiens
MVQNVRRCYTPSWGR

SEQ ID NO: 5462 - DNA, 48 bp, homo sapiens
atggttcaaaacgtgaggcgctgctataccccctcgtggggaaggtag

SEQ ID NO: 5463 - protein, 15 aa, homo sapiens
MMLHFGTPFPCSGRM

SEQ ID NO: 5464 - DNA, 48 bp, homo sapiens
atgatgcttcattttggcaccccctttccctgctcaggtagaatgtaa

SEQ ID NO: 5465 - protein, 22 aa, homo sapiens
MDQGVEGGGCGPGVGRQSACSL

SEQ ID NO: 5466 - DNA, 69 bp, homo sapiens; identical to SEQ ID NO: 4146

SEQ ID NO: 5467 - protein, 28 aa, homo sapiens
MKDGKEGYRDRGRVGLRIARAAWHTVLG

SEQ ID NO: 5468 - DNA, 87 bp, homo sapiens; identical to SEQ ID NO: 4148

SEQ ID NO: 5469 - protein, 41 aa, homo sapiens; identical to SEQ ID NO: 4149

SEQ ID NO: 5470 - DNA, 126 bp, homo sapiens; identical to SEQ ID NO: 4150

SEQ ID NO: 5471 - protein, 16 aa, homo sapiens
MILFPLDPAPLVPFSL

SEQ ID NO: 5472 - DNA, 51 bp, homo sapiens; identical to SEQ ID NO: 4152

SEQ ID NO: 5473 - protein, 54 aa, homo sapiens
MAAQRWSTRAWPSEEGKQKGDDSHSPLLFLIISAAVCTDSLRVVNKAEWALLCL

SEQ ID NO: 5474 - DNA, 165 bp, homo sapiens
atggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttttgtgtttatag

SEQ ID NO: 5475 - protein, 54 aa, homo sapiens [sequence omitted]

SEQ ID NO: 5476 - DNA, 165 bp, homo sapiens
atggtccgtttcctgaaggcacaggccagcttagcctgggtgctcagaggacctcggctggggtacacgtttgggggctgggagaccgttgctgaaggcagcgatcatgtggcgggggcactaggcggagtcagacggtcacgtgattgggaggggatcacgtga

SEQ ID NO: 5477 - protein, 5 aa, homo sapiens
MWRGH

SEQ ID NO: 5478 - DNA, 18 bp, homo sapiens
atgtggcgggggcactag

SEQ ID NO: 5479 - protein, 93 aa, homo sapiens
MRRGGRVPGGSSRRRWRWRAAAAETGALSRTPRPAPRRHPRRSVLFPLCFSPVLGQSCPRSRVGLRVCAGAAGAISPLGGRWSPGARGRDHGG

SEQ ID NO: 5480 - DNA, 282 bp, homo sapiens
atgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtag

SEQ ID NO: 5481 - protein, 7 aa, homo sapiens
MGDKGTR

SEQ ID NO: 5482 - DNA, 24 bp, homo sapiens
atgggcgacaaagggacccggtga

SEQ ID NO: 5483 - protein, 89 aa, homo sapiens [sequence omitted]

SEQ ID NO: 5484 - DNA, 270 bp, homo sapiens
atgtgggccgcagctcctggcccggacacacagctcgctgacacccagcattggccggcagccgcagagacgcacgggggcaggttgacacacaatacacgcacgggcacactaacccgtggcacaggcatgctggcgcacacactggcaaccgctagcacacgctcatcacacgcagtggcacgccgtcatacacgcctcggtcaacacattcttgctgacagccttgttggcatgcacagctcacaatccaacacacaccaattctag

SEQ ID NO: 5485 - protein, 35 aa, homo sapiens
MSHQHSGAQGHTNTDPHRHNQTDALKDWHPTGTSC

SEQ ID NO: 5486 - DNA, 108 bp, homo sapiens
atgtctcaccaacacagcggagcgcaaggccacaccaacactgacccccacagacacaatcagactgatgccctcaaagactggcaccccacaggcacgagctgctag

SEQ ID NO: 5487 - protein, 70 aa, homo sapiens
MPSKTGTPQARAASPRPADTHASGPTWPEVETHTSHRVERPPPPPAWGKQIAFHPNRSHPSTLFPFPLTS

SEQ ID NO: 5488 - DNA, 213 bp, homo sapiens
atgccctcaaagactggcaccccacaggcacgagctgctagcccaaggcccgctgacacacacgcttcaggccccacatggccagaagtggaaacacacacatcacacagggtagagcgccccccgccacccccagcctggggaaaacagatcgcatttcatccaaatagatcccatccatctactctgttccctttccctctgacctcctga

SEQ ID NO: 5489 - protein, 24 aa, homo sapiens
MACKQSQDQVGVRSYLQTMGLPQL

SEQ ID NO: 5490 - DNA, 75 bp, homo sapiens
atggcctgcaagcaatcacaggatcaggttggggtcagaagttacctccaaaccatgggtctccctcaactctga

SEQ ID NO: 5491 - protein, 4 aa, homo sapiens
MIRR

SEQ ID NO: 5492 - DNA, 15 bp, homo sapiens
atgatccgcaggtag

SEQ ID NO: 5493 - protein, 36 aa, homo sapiens
MMRCRQEATVLLILPTSLVSYRAPSATQPGPRSAET

SEQ ID NO: 5494 - DNA, 111 bp, homo sapiens
atgatgagatgccgtcaggaggccacggtcctcctcattctccccaccagcctggtgagctatagagctccatccgcaactcagccaggtccccgtagtgcagaaacctag

SEQ ID NO: 5495 - protein, 18 aa, homo sapiens
MPSGGHGPPHSPHQPGEL

SEQ ID NO: 5496 - DNA, 57 bp, homo sapiens
atgccgtcaggaggccacggtcctcctcattctccccaccagcctggtgagctatag

SEQ ID NO: 5497 - protein, 22 aa, homo sapiens
MDQGVEGGGCGPGVGRQSACSL

SEQ ID NO: 5498 - DNA, 69 bp, homo sapiens; identical to SEQ ID NO: 4146

SEQ ID NO: 5499 - protein, 28 aa, homo sapiens
MKDGKEGYRDRGRVGLRIARAAWHTVLG

SEQ ID NO: 5500 - DNA, 87 bp, homo sapiens; identical to SEQ ID NO: 4148

SEQ ID NO: 5501 - protein, 41 aa, homo sapiens; identical to SEQ ID NO: 4149

SEQ ID NO: 5502 - DNA, 126 bp, homo sapiens; identical to SEQ ID NO: 4150

SEQ ID NO: 5503 - protein, 16 aa, homo sapiens
MILFPLDPAPLVPFSL

SEQ ID NO: 5504 - DNA, 51 bp, homo sapiens; identical to SEQ ID NO: 4152

SEQ ID NO: 5505 - protein, 22 aa, homo sapiens
MDQGVEGGGCGPGVGRQSACSL

SEQ ID NO: 5506 - DNA, 69 bp, homo sapiens; identical to SEQ ID NO: 4146

SEQ ID NO: 5507 - protein, 28 aa, homo sapiens
MKDGKEGYRDRGRVGLRIARAAWHTVLG

SEQ ID NO: 5508 - DNA, 87 bp, homo sapiens; identical to SEQ ID NO: 4148

SEQ ID NO: 5509 - protein, 41 aa, homo sapiens; identical to SEQ ID NO: 4149

SEQ ID NO: 5510 - DNA, 126 bp, homo sapiens; identical to SEQ ID NO: 4150

SEQ ID NO: 5511 - protein, 16 aa, homo sapiens
MILFPLDPAPLVPFSL

SEQ ID NO: 5512 - DNA, 51 bp, homo sapiens; identical to SEQ ID NO: 4152

SEQ ID NO: 5513 - protein, 7 aa, homo sapiens
MSSFGAG

SEQ ID NO: 5514 - DNA, 24 bp, homo sapiens
atgagtagctttggagctgggtga

SEQ ID NO: 5515 - protein, 6 aa, homo sapiens
MVSPLF

SEQ ID NO: 5516 - DNA, 21 bp, homo sapiens
atggtttctccccttttctga

SEQ ID NO: 5517 - protein, 12 aa, homo sapiens
MGKGSVEACLLG

SEQ ID NO: 5518 - DNA, 39 bp, homo sapiens
atggggaagggctcggtggaagcttgcttgttggggtga

SEQ ID NO: 5519 - protein, 124 aa, homo sapiens [sequence omitted]

SEQ ID NO: 5520 - DNA, 375 bp, homo sapiens
atggggctggtgtcagtgcctgacctctgggggtgtcctggcagaggatggctccgtgaaaatgttcctgaggggccgccctgtgcccatgatgatcccagacgagctggcacccacctacagcctggacacacgctcggagctgccttcttgccggctcaagctggagtgggtgtatccttttgctggaatctccttggtgctcccatccccccaggaggaaatagaaaggcggtcaaggcagctcaggcctgtaatctcagcactttgggaggatcgtttgaggccaagagtttgagacctgcctgggcaacacacaaaacaagcacagcacgttcaagggctatgtggccagagtgggattggtgcatttga

SEQ ID NO: 5521 - protein, 32 aa, homo sapiens
MAGASSTPCPRLSYHLYFHQAGNQGFLGCGQQ

SEQ ID NO: 5522 - DNA, 99 bp, homo sapiens
atggcaggggcgagctccacgccctgtccccgtctaagctaccacctttacttccaccaggctgggaaccagggcttccttggttgtggtcagcaatga

SEQ ID NO: 5523 - protein, 57 aa, homo sapiens
MSLGMSILREKGERGHFGLRPSHFGKMSGVGGATRGVILAAPIGWRAKSGARGTEAK

SEQ ID NO: 5524 - DNA, 174 bp, homo sapiens
atgagtctgggtatgagtattctgcgggaaaagggggagaggggccacttcggtctccgcccctcccactttgggaaaatgagcggggttgggggggcgactcggggagtcattttggctgcacccataggctggagagccaaatctggggcgcggggtacagaggcgaaataa

SEQ ID NO: 5525 - protein, 79 aa, homo sapiens [sequence omitted]

SEQ ID NO: 5526 - DNA, 240 bp, homo sapiens
atgcctgctggggaagagtttggttgtcaatccggtctgcatctcccttgggtcttctgggtctgccatgcgctgcctgcaacccccaagtccgccgccaggggccgccgaagctctgtccttgcagctggctctagggtcgaaccccagggtgaggagaggaggggaaacggggaggctaggcatgaccttttggcttggaaagtcttagaaacagtgaagagacgttggtattcataa

SEQ ID NO: 5527 - protein, 47 aa, homo sapiens
MRCLQPPSPPPGAAEALSLQLALGSNPRVRRGGETGRLGMTFWLGKS

SEQ ID NO: 5528 - DNA, 144 bp, homo sapiens
atgcgctgcctgcaacccccaagtccgccgccaggggccgccgaagctctgtccttgcagctggctctagggtcgaaccccagggtgaggagaggaggggaaacggggaggctaggcatgaccttttggcttggaaagtcttag

SEQ ID NO: 5529 - protein, 43 aa, homo sapiens
MFIISETFQGRGLITILPKCQNNPEWLTVALPTKLPLRTRSGD

SEQ ID NO: 5530 - DNA, 132 bp, homo sapiens
atgtttattatatctgaaacatttcaaggaagaggtctcataactatactcccaaaatgtcagaataatccagagtggctcacagttgcactaccaacaaaactgcctctgagaacccggagcggtgactaa

SEQ ID NO: 5531 - protein, 67 aa, homo sapiens
MMTYLEHLKLWFLQPWELPFQSPSSSGLAVRPFSSGVSQCHSLHPHPVSSSGFFYSLCQASETQLAE

SEQ ID NO: 5532 - DNA, 204 bp, homo sapiens
atgatgacctatctggaacacctaaagctatggtttctccagccatgggaacttcccttccagtctccttcatcttcaggtttggctgttcgtcctttctcctctggggtttctcagtgccactccttacaccctcatccagtctcctcctctggtttcttctactcactctgccaggcatcagaaactcaattagccgaatga

SEQ ID NO: 5533 - protein, 100 aa, homo sapiens
MVSPAMGTSLPVSFIFRFGCSSFLLWGFSVPLLTPSSSLLLWFLLLTLPGIRNSISRMMQLAKENGEGKREGIGIRRKGGRETHCLLIPSHYPTLPPYHS

SEQ ID NO: 5534 - DNA, 303 bp, homo sapiens
atggtttctccagccatgggaacttcccttccagtctccttcatcttcaggtttggctgttcgtcctttctcctctggggtttctcagtgccactccttacaccctcatccagtctcctcctctggtttcttctactcactctgccaggcatcagaaactcaattagccgaatgatgcagttagcaaaggagaacggggagggaaagagagaagggattggaataagaagaaaaggaggtagagaaactcactgcctactaattcccagccactaccctacccttcccccttatcactcctga

SEQ ID NO: 5535 - protein, 13 aa, homo sapiens
MHAHTHTHIHSQR

SEQ ID NO: 5536 - DNA, 42 bp, homo sapiens
atgcacgcgcacacacacacacacatacacagtcagagataa

SEQ ID NO: 5537 - protein, 90 aa, homo sapiens [sequence omitted]

SEQ ID NO: 5538 - DNA, 273 bp, homo sapiens
atgccggaggctattgtcgaagccacggcctgccatttcataccctttgcaataggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctga

SEQ ID NO: 5539 - protein, 16 aa, homo sapiens
MLGSGAMGLCADLATL

SEQ ID NO: 5540 - DNA, 51 bp, homo sapiens
atgctgggctcgggggcgatgggcttgtgcgcggacctggcgacgctctag

SEQ ID NO: 5541 - protein, 42 aa, homo sapiens
MRNRFSETWSPVGKVLPESGKRRAGKEWSLPVHPRSPLQEWD

SEQ ID NO: 5542 - DNA, 129 bp, homo sapiens
atgcgcaaccggttctccgaaacatggagtcctgtaggcaaggtcttacctgaatcaggtaagaggcgggcggggaaggagtggagcctccccgtgcaccctcgcagcccgctccaggagtgggactag

SEQ ID NO: 5543 - protein, 37 aa, homo sapiens
MWEGSNRKKKKKRERATVPVLKPFPPPSSQAARKLPV

SEQ ID NO: 5544 - DNA, 114 bp, homo sapiens
atgtgggaaggtagtaacaggaaaaaaaaaaaaaagcgagaaagagcgactgtgcctgtgctgaagccctttcctcctcctagctcccaggcagctagaaaattgcctgtctga

SEQ ID NO: 5545 - protein, 9 aa, homo sapiens
MVRRDRLRR

SEQ ID NO: 5546 - DNA, 30 bp, homo sapiens
atggtgcgccgagatcgcctccgcaggtga

SEQ ID NO: 5547 - protein, 11 aa, homo sapiens
MECSERGTSLG

SEQ ID NO: 5548 - DNA, 36 bp, homo sapiens
atggaatgttcagaacgcgggacctccttgggttag

SEQ ID NO: 5549 - protein, 34 aa, homo sapiens
MFRTRDLLGLGFLDPGIVVVRFRISGPQRHLDMT

SEQ ID NO: 5550 - DNA, 105 bp, homo sapiens
atgttcagaacgcgggacctccttgggttaggatttctagaccccgggatcgtcgtggtgagatttaggatttctggaccccagcgtcatcttgatatgacttag

SEQ ID NO: 5551 - protein, 6 aa, homo sapiens
MTLVSP

SEQ ID NO: 5552 - DNA, 21 bp, homo sapiens
atgaccctggtctcaccctga

SEQ ID NO: 5553 - protein, 8 aa, homo sapiens
MVNPILCT

SEQ ID NO: 5554 - DNA, 27 bp, homo sapiens
atggttaatccaattctgtgcacctga

SEQ ID NO: 5555 - protein, 11 aa, homo sapiens
MTERMNGHMND

SEQ ID NO: 5556 - DNA, 36 bp, homo sapiens; identical to SEQ ID NO: 4068

SEQ ID NO: 5557 - protein, 48 aa, homo sapiens [sequence omitted]

SEQ ID NO: 5558 - DNA, 147 bp, homo sapiens; identical to SEQ ID NO: 4070

SEQ ID NO: 5559 - protein, 25 aa, homo sapiens
MKLNESERENKEKPIKKRTNTWVYL

SEQ ID NO: 5560 - DNA, 78 bp, homo sapiens; identical to SEQ ID NO: 4072

SEQ ID NO: 5561 - protein, 83 aa, homo sapiens
MGDPGRNIGEGMAPQRPGQPAALSTWYSPRQVETQPGSSFMAVAARYRSRPVCKASHPHSTSTGATQRAWGGGAAASRLETCK

SEQ ID NO: 5562 - DNA, 252 bp, homo sapiens
atgggggatcctgggagaaacataggggaagggatggcccctcagcgcccaggccaacctgctgccctaagcacctggtacagtccacggcaggtggagactcagccaggttcttccttcatggctgtcgcagcacggtacaggagcaggcctgtgtgcaaagccagccacccccactccaccagcacaggtgccacccaaagggcatggggtgggggggcggctgccagccgcctcgaaacctgcaagtga

SEQ ID NO: 5563 - protein, 37 aa, homo sapiens
MGWGGGCQPPRNLQVRRGPLSTKTRPGCAPGFPHLSP

SEQ ID NO: 5564 - DNA, 114 bp, homo sapiens
atggggtgggggggcggctgccagccgcctcgaaacctgcaagtgaggcgagggcccctgagcaccaagacccgccctgggtgtgctcccgggttcccccacctgtctccctga

SEQ ID NO: 5565 - protein, 118 aa, homo sapiens
MPPLRVPPPSPLLCPPLRAPLCLPLRVPLSVLPPCHPGRGGPPPPPRRSARAPARVFGLHQRSPAAPGPGGAPRLSPPPPPVRALRLRRGARGAGAGALRTCGGRWVMRRLGPGPRAS

SEQ ID NO: 5566 - DNA, 357 bp, homo sapiens
atgcctcccctccgtgtcccccctccaagcccccttctgtgtcccccactccgtgctcccctctgtctccccctccgtgtccccctctccgtgctccccccatgccaccccggccgcggagggcccccccctcccccgcgccgctccgcgcgcgctcccgcccgcgttttcggactgcaccagcggagccccgcggcgccagggccgggcggagcgcctcgtctgtcgccgccgcccccaccggtgcgggctctgcggctgcggcggggggcgcggggcgcgggggccggcgcgctccgcacctgcggcggccgctgggtgatgcggcggctcgggccggggccgcgggcgtcctga

SEQ ID NO: 5567 - protein, 194 aa, homo sapiens
MPPRPRRAPPSPAPLRARSRPRFRTAPAEPRGARAGRSASSVAAAPTGAGSAAAAGGAGRGGRRAPHLRRPLGDAAARAGAAGVLSAAPSRDARRPLARPCRRPSSTPASPSARTSTPVSPWRPGLRAAASLRCGRDAPGPHGSRFAWKLTLSPPRAQQQKQPDPLAAPDLGGAGPGPQHKPASACGLASPAWS

SEQ ID NO: 5568 - DNA, 585 bp, homo sapiens
atgccaccccggccgcggagggcccccccctcccccgcgccgctccgcgcgcgctcccgcccgcgttttcggactgcaccagcggagccccgcggcgccagggccgggcggagcgcctcgtctgtcgccgccgcccccaccggtgcgggctctgcggctgcggcggggggcgcggggcgcgggggccggcgcgctccgcacctgcggcggccgctgggtgatgcggcggctcgggccggggccgcgggcgtcctgagcgcagcgccctcccgggatgcccgccggccgctggcccggccatgtcgtcgtccttcttcaaccccagcttcgccttcagctcgcacttcgaccccggtgagtccctggcggcccggcctgcgcgccgctgcctccctccgctgcggacgtgatgcccctgggccccacggctcccggtttgcatggaaattaaccctttccccgccccgagcccagcagcagaagcagccggaccccctggcggccccagatctcggaggggcaggccctgggccccagcacaaaccggcctccgcctgtgggctggcgtcccccgcgtggtcgtga

SEQ ID NO: 5569 - protein, 60 aa, homo sapiens
MGEVGPYHTPNLLCSATSEYTELCPQASAAVSPSPTLGGPQLTPEPVSCAPVVPGQSPPP

SEQ ID NO: 5570 - DNA, 183 bp, homo sapiens
atgggcgaggtcggtccgtatcacacccccaacctcttgtgctctgcgacctcagaatacacggagctgtgtccacaggcctcagcggctgtgagcccctcgcctacactggggggtcctcagctgacacctgagccagtgtcctgtgccccagtggtgccagggcagagtccccctccctga

SEQ ID NO: 5571 - protein, 48 aa, homo sapiens
MKPLADWPLQSSAGRCLASPASTLAQSCLLSSGSQPACPWGWVSSSQD

SEQ ID NO: 5572 - DNA, 147 bp, homo sapiens
atgaagccgttagcagactggcctctgcagagctctgcggggaggtgcctggcttctccggcctccaccctggcccagagctgcctcctgagcagcggatcccaacctgcctgcccctggggctgggtctccagcagtcaggactga

SEQ ID NO: 5573 - protein, 12 aa, homo sapiens
MSPLAASPRLPL

SEQ ID NO: 5574 - DNA, 39 bp, homo sapiens
atgtccccattggcagcatctccacgccttcccttgtga

SEQ ID NO: 5575 - protein, 35 aa, homo sapiens
MWEPAPAPPAPRGRLLPAPSVLHTEECAPAGDGHV

SEQ ID NO: 5576 - DNA, 108 bp, homo sapiens
atgtgggagcccgcacctgctcccccagcgccccggggtcgtcttctgcctgctccttctgtcctccacactgaagagtgtgctccagctggggatgggcatgtgtga

SEQ ID NO: 5577 - protein, 33 aa, homo sapiens
MRSVEALRLLEARAGRCALRAHPCPGAVRARGT

SEQ ID NO: 5578 - DNA, 102 bp, homo sapiens
atgcgcagtgtggaggcgctgaggctgctggaggcgcgggccgggcggtgcgcactgcgggcgcatccctgccccggcgccgtccgtgcccgcgggacctga

SEQ ID NO: 5579 - protein, 134 aa, homo sapiens
MGGALPQPRPAATGGRSRGRPWRPDAAAGPAPPCRPRAGRAALLGAPLRAGPRAGPGRSRALLPLTLLGAQGRAAGGRVGVQALQALRALERPRNRPGSPALWGRTGPPAAMQQPPGETRALRTLGGLESSAAA

SEQ ID NO: 5580 - DNA, 405 bp, homo sapiens
atgggaggggccctgccccagccccgccccgcggcgacaggtgggcgctcccgtgggaggccgtggcgtccagacgctgctgcgggccccgctccgccctgcagaccccgggccggccgagccgcgcttctcggggctccgctgcgcgccggtccccgagcaggccctggacggtcccgcgccctcctcccacttactctcctgggggcgcagggccgggccgcgggtggcagggtgggggtccaggccctgcaggcactgcgagccctcgagcggccccgcaaccggccaggctcccctgcgctgtgggggcggaccgggcccccagccgcgatgcagcagcccccgggggagacacgagctctgaggaccctgggtgggctggagtcgtcggccgccgcgtga

SEQ ID NO: 5581 - protein, 123 aa, homo sapiens [sequence omitted]

SEQ ID NO: 5582 - DNA, 372 bp, homo sapiens
atgatgaaaacaattgggatagcttcactcgggagccttcctgaggacggcggagcaggccggcagctccttcaagaggctctgccgctgctgcgtcggggctcagccgggtttgggttggagagcgcagaggtgcttggagtaggtcttttatcttctgaggaggcggtggcccgggcaggtggcggccccgtgctggtcctgcgctgtgtcctcggagcgtcctcagctgctgcgcgcacagccgggggccgtggaccaggcgtccgcacggacacgcgaaccgggctgcctagcctgctgctgggcctcacggctgcagagacggcgggaatggtgaccgttgcttcagagtcctttgcttatgagtaa

SEQ ID NO: 5583 - protein, 6 aa, homo sapiens
MSNSPN

SEQ ID NO: 5584 - DNA, 21 bp, homo sapiens
atgagtaactcaccgaattga

SEQ ID NO: 5585 - protein, 21 aa, homo sapiens
MLSRDLYSGSTQISCLHPGVF

SEQ ID NO: 5586 - DNA, 66 bp, homo sapiens
atgctgagccgtgatctgtactcgggaagcacacagatctcctgtctccaccctggcgtgttctga

SEQ ID NO: 5587 - protein, 72 aa, homo sapiens
MFCEVHPVAAPVPGGSISLTSSIPSMRRPHLFICPPVDVQLGCFQCWALMSKAAVNICIQVLVWTSVPIFLG

SEQ ID NO: 5588 - DNA, 219 bp, homo sapiens
atgttttgtgaggttcaccctgttgccgcgcctgtccccggtgggtccatttcgctgacgagtagcattccttcgatgcgcaggccacatctgtttatctgtccacctgttgatgtgcagttgggttgtttccagtgttgggctcttatgagcaaagctgccgtgaacatttgtatacaggtgcttgtgtggacttccgttcccatttttcttgggtaa

SEQ ID NO: 5589 - protein, 12 aa, homo sapiens
MCSWVVSSVGLL

SEQ ID NO: 5590 - DNA, 39 bp, homo sapiens
atgtgcagttgggttgtttccagtgttgggctcttatga

SEQ ID NO: 5591 - protein, 14 aa, homo sapiens
MSGIGTAGTDVNHV

SEQ ID NO: 5592 - DNA, 45 bp, homo sapiens
atgtctggaattgggacagcggggacagatgttaaccatgtttaa

SEQ ID NO: 5593 - protein, 132 aa, homo sapiens [sequence omitted]

SEQ ID NO: 5594 - DNA, 399 bp, homo sapiens
atgggaggctccgcactcctgaaggcgggactaacgcttacctggggcgcgggtccctgccggaaggcggcgtccgcgacgcagctgttcacgcttaggtgggcgacgtgggcgcaggtgggcgcaggtaggcgcgtggggcggcggcggggtggccggcgggtcagggcgccaggagacccagagccccggggcgggctcccgcggggctccgccccctccacgtgggtgcgcggaggcccggcgcggcgcgaccgggcggcggccctggggtccgcggtgctggggaggctggtgcggccggtgcggccggtgcgtcccggcgcgggctccgacacccgcacccgcctctgggttaactcagcgcgggcgagtggaagggactcagctggctcctag

SEQ ID NO: 5595 - protein, 10 aa, homo sapiens
MRAPPHPDNF

SEQ ID NO: 5596 - DNA, 33 bp, homo sapiens
atgcgcgcgccaccacacccggataatttttaa

SEQ ID NO: 5597 - protein, 90 aa, homo sapiens
MFFVEMGSHHVTQAGLEFLGSSDGSSCLGLPKCWDYRSEPTRLASLSIISMLSVSFLPSFIHSFLKNVHWVPPALFGALGYSCQQVETSL

SEQ ID NO: 5598 - DNA, 273 bp, homo sapiens
atgttttttgtagaaatggggtctcaccatgttacccaggctggtctcgaattcttgggctcaagcgatggatcctcctgcctcggcctcccaaagtgctgggattacaggagtgagccaacgcgcttggcctcactttccatcataagcatgctttccgtttccttccttccgtcattcattcattcatttttaaaaaacgttcattgggttcctcctgcactgttcggggcattgggctacagctgtcaacaagtggagacaagtctgtga

SEQ ID NO: 5599 - protein, 39 aa, homo sapiens
MLPRLVSNSWAQAMDPPASASQSAGITGVSQRAWPHFPS

SEQ ID NO: 5600 - DNA, 120 bp, homo sapiens
atgttacccaggctggtctcgaattcttgggctcaagcgatggatcctcctgcctcggcctcccaaagtgctgggattacaggagtgagccaacgcgcttggcctcactttccatcataa

SEQ ID NO: 5601 - protein, 117 aa, homo sapiens
MSLVPLTTNRGARGLEAGPQGARAGAGESRPALSVRRPGATQTWRRVAPVGEAVPGGGCRVSWAVATAPPPRLPERDGRGGFCAEPGDGRQRRAGWSGDHGDPHGAGRRADPGRHRR

SEQ ID NO: 5602 - DNA, 354 bp, homo sapiens
atgagcctggtcccattgacaacaaacaggggggcgcgcggcctggaggcggggccgcagggggcgcgggctggggcgggggaatcccgccccgccctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacggtga

SEQ ID NO: 5603 - protein, 8 aa, homo sapiens
MAAGGTRR

SEQ ID NO: 5604 - DNA, 27 bp, homo sapiens
atggcggcgggtggcacccgtcggtga

SEQ ID NO: 5605 - protein, 12 aa, homo sapiens
MGGGDGTAPASP

SEQ ID NO: 5606 - DNA, 39 bp, homo sapiens
atgggcggtggcgacggcaccgcccccgcgtctccctga

SEQ ID NO: 5607 - protein, 85 aa, homo sapiens [sequence omitted]

SEQ ID NO: 5608 - DNA, 258 bp, homo sapiens
atggacgacagcggcgagctgggtggtctggagaccatggagaccctcacggagctgggcgacgagctgaccctgggagacatcgacggtgagtggtgggtgggtgggagtgcgggggccgcgcggggaggaaggggttacggcggcgcgcccgggtgcgcgtgcgcccaccccccgacagccccggttcgcgcgggaagaaccccgtgcgcacggtgcccccggcggtcctcaacccttccggcgctgcgagcgtga

SEQ ID NO: 5609 - protein, 171 aa, homo sapiens
MDCTFEGIFGGLPTSPLYNASVSCRFSWGGRACGLRNLSRKEPLPEGEGVTVTSSLGKWRATSNQISVPCNSRGKGLLRDPKAASRPKRVWRERVVFSTFSAPALGQDQEEAGRRARCPSATASALFSTPAYCGHLRLFRKTVGALDCQNCQFFFQASVSPIYRRGSHGLG

SEQ ID NO: 5610 - DNA, 516 bp, homo sapiens
atggattgcactttcgaaggtatttttggaggcctccccaccagccctttatacaatgcctccgtctcctgcaggttctcctggggtgggcgggcatgcgggctacgcaacttgagcaggaaagagccccttcccgagggagaaggtgtgacagttaccagctcgctggggaagtggagggctacctccaaccaaattagtgtcccctgcaactcaagggggaagggtttgcttagagacccaaaagcagcatcccgacctaagagggtttggagggagagggtggtcttctctacattctctgcacccgctttgggacaggaccaggaggaagcagggaggagggcccgttgtccctctgccacagcgtctgccctattcagcacccctgcctattgtgggcatcttagacttttcaggaagacagtgggagccctagattgtcaaaattgtcagtttttctttcaggcctcagtttcccccatctatcgaagaggctcacacggactggggtaa

SEQ ID NO: 5611 - protein, 19 aa, homo sapiens
MPPSPAGSPGVGGHAGYAT

SEQ ID NO: 5612 - DNA, 60 bp, homo sapiens
atgcctccgtctcctgcaggttctcctggggtgggcgggcatgcgggctacgcaacttga

SEQ ID NO: 5613 - protein, 34 aa, homo sapiens
MRATQLEQERAPSRGRRCDSYQLAGEVEGYLQPN

SEQ ID NO: 5614 - DNA, 105 bp, homo sapiens
atgcgggctacgcaacttgagcaggaaagagccccttcccgagggagaaggtgtgacagttaccagctcgctggggaagtggagggctacctccaaccaaattag

SEQ ID NO: 5615 - protein, 10 aa, homo sapiens
MGNPAVESPL

SEQ ID NO: 5616 - DNA, 33 bp, homo sapiens
atgggaaaccctgcagttgaaagtccattatga

SEQ ID NO: 5617 - protein, 75 aa, homo sapiens [sequence omitted]

SEQ ID NO: 5618 - DNA, 228 bp, homo sapiens
atggacgagccacccttcagcgaggcggctttggagcaggcgctgggcgagccgtgcgatctggacgcggcgctgctgaccgacatcgaaggtgcgtcagggcgggcagggcttgaagctgcgccgggtggcgcgagtagggggcgcgcaggtgtctccctggcctttgtctcccccacgggcgccagctccgtgctgtgctcgcgcgggacttcccggtgtctctga

SEQ ID NO: 5619 - protein, 20 aa, homo sapiens
MATAEAGDPGVAEAPPQPQP

SEQ ID NO: 5620 - DNA, 63 bp, homo sapiens
atggccacggctgaagctggggacccaggcgtcgccgaagctccgccccagccccagccgtga

SEQ ID NO: 5621 - protein, 39 aa, homo sapiens
MRMGAASRPSPASCRVLPVCDGHSLRTHSLTSTECQAPS

SEQ ID NO: 5622 - DNA, 120 bp, homo sapiens
atgcgcatgggcgctgcctcgcgcccttcccccgcctcgtgtcgggttctcccggtctgcgacgggcacagcctccgcactcattcactgacatccaccgaatgccaggccccgtcttag

SEQ ID NO: 5623 - protein, 33 aa, homo sapiens
MPGPVLGTEGLQTDLGTPSFREHKNLPGNQTGI

SEQ ID NO: 5624 - DNA, 102 bp, homo sapiens
atgccaggccccgtcttaggcaccgagggtttacagacagacctgggtaccccctcttttagggaacacaaaaatctcccgggaaaccaaacgggtatttag

SEQ ID NO: 5625 - protein, 150 aa, homo sapiens
MRSGRDCALGLRVAARPAGGRGGGGHAPQAAAAREGLCVPLTLLGALPPVPPFPSPAASLRGASHSVGPTRGDGGGTLLQPSWDPEETPACDLRRRPRRGPMGASPQAGSGREGGERRGRGVQEGRARARPRAGRARALPPPPGPRPPRL

SEQ ID NO: 5626 - DNA, 453 bp, homo sapiens
atgcgctcggggcgggactgcgccttaggcctgcgcgttgccgctagaccagcgggggggcggggcggcggcggacacgcgcctcaggcggcagccgcgcgagagggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctag

SEQ ID NO: 5627 - protein, 20 aa, homo sapiens
MEGARFYNPPGTPKRRPRAT

SEQ ID NO: 5628 - DNA, 63 bp, homo sapiens
atggagggggcacgcttctacaaccctcctgggaccccgaagagacgcccgcgtgcgacctga

SEQ ID NO: 5629 - protein, 98 aa, homo sapiens [sequence omitted]

SEQ ID NO: 5630 - DNA, 297 bp, homo sapiens
atgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggaggtgagtgccggcccgggggcggcgggcggtggtcgctgcatcccgcgtag

SEQ ID NO: 5631 - protein, 23 aa, homo sapiens
MGRTSQPVFWKRQVPQITDLRLR

SEQ ID NO: 5632 - DNA, 72 bp, homo sapiens
atggggaggacgtctcagcctgtattttggaagcggcaggttcctcaaatcacggacttaaggctgcgctag

SEQ ID NO: 5633 - protein, 19 aa, homo sapiens
MAGAGAQLSVAAAAALPRS

SEQ ID NO: 5634 - DNA, 60 bp, homo sapiens
atggcaggggccggggcccagctgtcagtcgccgccgccgcggcccttccccgcagctag

SEQ ID NO: 5635 - protein, 23 aa, homo sapiens
MSPRCPPQPSQTRSRRARGRLPR

SEQ ID NO: 5636 - DNA, 72 bp, homo sapiens
atgagcccccgctgccccccgcagcccagtcagacgcggagccgccgcgcccggggccggctcccccgctag

SEQ ID NO: 5637 - protein, 160 aa, homo sapiens [sequence omitted]

SEQ ID NO: 5638 - DNA, 483 bp, homo sapiens
atggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcgtttgggcttttacaggtgtagtttcccctcgacttggagcccgtcaaccccttcgtctcctaattctcaaccccccttttttttcttcttgcacgccagtaaagtgcaaggcccccaaatgtaccgctcgttgatgtatcacccagctcgggagcctgctgattatcaggccaagaaataa

SEQ ID NO: 5639 - protein, 4 aa, homo sapiens
MTMK

SEQ ID NO: 5640 - DNA, 15 bp, homo sapiens
atgacaatgaaataa

SEQ ID NO: 5641 - protein, 4 aa, homo sapiens
MATR

SEQ ID NO: 5642 - DNA, 15 bp, homo sapiens
atggccacaaggtga

SEQ ID NO: 5643 - protein, 8 aa, homo sapiens
MSRGNLES

SEQ ID NO: 5644 - DNA, 27 bp, homo sapiens
atgtcaagaggaaacctagaatcttaa

SEQ ID NO: 5645 - protein, 10 aa, homo sapiens
MGCRNYLRSP

SEQ ID NO: 5646 - DNA, 33 bp, homo sapiens
atgggctgtagaaattatctcaggtccccttag

SEQ ID NO: 5647 - protein, 43 aa, homo sapiens
MTRGQGAYMRLHSRLVTVCSLSSRWSFHYTGLCLLMPVTFNGF

SEQ ID NO: 5648 - DNA, 132 bp, homo sapiens
atgaccagagggcagggggcttacatgaggttacacagcaggttagtgacagtctgctccctctctagccgctggtctttccattacacaggcctgtgtctcttgatgcctgtgacctttaatggcttctga

SEQ ID NO: 5649 - protein, 137 aa, homo sapiens
MDMISPRWAYEDGQRRTFQARRLRERRAEETTDVPGGAKQACFQVKCSCPKPRCFQEGSTDGSATAEGTLPIRGKNPHSPKPGRRCWPGDSPSPPPAGADSGWGARVEQTARSEAGGEGENGIRRGHAPSVSRAPSD

SEQ ID NO: 5650 - DNA, 414 bp, homo sapiens
atggatatgatctctcccaggtgggcctatgaggatgggcagcgaaggacattccaggcaaggaggctgcgcgagcgacgtgcagaggagaccacagatgtgccgggaggcgccaagcaggcctgctttcaggtgaagtgttcctgccccaaaccccggtgtttccaggagggcagcacggacggtagcgccactgcagaaggaactctgcccatccggggaaagaatccccactccccaaagcctggaaggaggtgttggcctggggacagcccttcacccccacccgctggagctgatagtgggtggggagcaagggtggagcaaacagcgagatcagaagcgggaggggaaggtgagaatggaatccgcagaggacacgccccctctgtctccagggcacccagcgattag

SEQ ID NO: 5651 - protein, 35 aa, homo sapiens
MRMGSEGHSRQGGCASDVQRRPQMCREAPSRPAFR

SEQ ID NO: 5652 - DNA, 108 bp, homo sapiens
atgaggatgggcagcgaaggacattccaggcaaggaggctgcgcgagcgacgtgcagaggagaccacagatgtgccgggaggcgccaagcaggcctgctttcaggtga

SEQ ID NO: 5653 - protein, 69 aa, homo sapiens
MESAEDTPPLSPGHPAISSKFWALCPAASHWVTDREVLTPLSAQHLPNTLPFQRVSPPRSRLRRHRFNT

SEQ ID NO: 5654 - DNA, 210 bp, homo sapiens
atggaatccgcagaggacacgccccctctgtctccagggcacccagcgattagcagcaaattctgggctttgtgccccgcagcttcccactgggtaaccgaccgggaagttctaactcccctcagcgcacaacacctccccaacacactcccttttcaacgagtctctcccccaagaagcaggctccgacgccacagatttaatacttaa

SEQ ID NO: 5655 - protein, 4 aa, homo sapiens
MKRR

SEQ ID NO: 5656 - DNA, 15 bp, homo sapiens
atgaagaggcggtga

SEQ ID NO: 5657 - protein, 80 aa, homo sapiens
MTSCRARRSPTPSRSSRPTTHSRLCRKVSDRCAQGPLGHGLRGVAAVGTGGVGTSWAAQGTLCSSAAAVPCAVARLPRPT

SEQ ID NO: 5658 - DNA, 243 bp, homo sapiens
atgacatcctgcagagcgagaagatcacctactccatcaaggtcatcgaggccaacaacccattccaggctgtgcaggaaggtgagtgaccgctgtgcccagggcccactgggacacggcctgcgaggcgtcgcagcagtgggcaccggaggggttgggacgagctgggctgcgcagggcaccctctgttcctcggcagccgcggtgccatgcgcggtggcgcgccttccccggcccacctag

SEQ ID NO: 5659 - protein, 115 aa, homo sapiens
MRGGAPSPAHLGSGAGTALRCGPARRACERGELVFLRVAWRPSGCVGAGVRPALAAQACVARGSLCFSVFGGGRVCVPGTCIGRTSPDLSGPVFSSLRGEERPAAGARPVSFSRA

SEQ ID NO: 5660 - DNA, 348 bp, homo sapiens
atgcgcggtggcgcgccttccccggcccacctaggcagcggcgccgggactgctctgcgctgcgggccggcacggagagcctgcgagcgcggggagctggtgttcttgcgggttgcgtggcgcccttcgggctgtgtgggcgcgggtgtgcgcccagcgctggccgcgcaggcgtgcgtggctcggggcagtctttgtttctcggtgtttgggggtgggcgtgtctgcgtgccgggtacctgtatcgggcgcacctcccctgatctcagtggcccggtgttttcctcgcttcgaggtgaggagcgcccagcggctggagcccgacctgtctccttctcccgggcataa

SEQ ID NO: 5661 - protein, 14 aa, homo sapiens
MGTLGPAPLSAGAS

SEQ ID NO: 5662 - DNA, 45 bp, homo sapiens
atggggactctggggccagcgcccctcagtgctggggcaagttag

SEQ ID NO: 5663 - protein, 13 aa, homo sapiens
MQGFLAGGTGREV

SEQ ID NO: 5664 - DNA, 42 bp, homo sapiens
atgcagggattccttgctggaggaactggtagagaagtgtag

SEQ ID NO: 5665 - protein, 34 aa, homo sapiens
MSRAPGGHGSADAVASPLDMPVRVGAGRLHHPHR

SEQ ID NO: 5666 - DNA, 105 bp, homo sapiens
atgagccgcgcgcccgggggacatggaagcgctgacgctgtggcttctcccctggatatgccagtgcgtgtcggtgcgggccgactccatcatccacatcggtaa

SEQ ID NO: 5667 - protein, 107 aa, homo sapiens [sequence omitted]

SEQ ID NO: 5668 - DNA, 324 bp, homo sapiens
atggaagcgctgacgctgtggcttctcccctggatatgccagtgcgtgtcggtgcgggccgactccatcatccacatcggtaagcgcggctggaggccgggccgaggctgggcgggggccccaacggggcagggggtgcgcggcgtccaaacttggcgtttccctgggccgaggggctcggcgggcggtgctcccccgaagggccgcgccgcgccgcccggcggaggagctgtgcaccggccgcgccgcgctcccgctggctgcttgccgctccccggggctccgatctccgcgcggggccccgcggcctctaccgacacttag

SEQ ID NO: 5669 - protein, 9 aa, homo sapiens
MDARRDPRP

SEQ ID NO: 5670 - DNA, 30 bp, homo sapiens
atggacgcgcgtcgagacccgcgcccttag

SEQ ID NO: 5671 - protein, 22 aa, homo sapiens
MCVGACCQRVSLCAPGTVSVLL

SEQ ID NO: 5672 - DNA, 69 bp, homo sapiens
atgtgtgtgggtgcgtgttgtcagcgtgtgtcgctgtgtgcgcctggcacggtgtcggtgttactgtga

SEQ ID NO: 5673 - protein, 43 aa, homo sapiens
MLAAAGPLWLPSCPGAWPGAPPRSLFLLPRSHSTRNGLFRPGT

SEQ ID NO: 5674 - DNA, 132 bp, homo sapiens
atgcttgcggcggccggccccctctggctccccagctgtcctggggcctggcccggcgccccgccccggtctctcttcttgctccccaggtcccactccacgaggaacggtctgtttcggccggggacatga

SEQ ID NO: 5675 - protein, 260 aa, homo sapiens [sequence omitted]

SEQ ID NO: 5676 - DNA, 783 bp, homo sapiens
atgacccgagacgcgcggctgctgaggtcgccagggcgcttcgggagcccctcgagggcagttagcggccggccctcctccattctcccgcccctggcgaaccggagaaggaggcccgaaccgtcagagctcggcgcgccgcagcccaggccggtccccgccgctgtgccggtctccgagcgtcccccgagccgggagcgtggagcacccggcgccccctccgagccgcgagcgggcgagagccgcgcggcgaggctgaggctccgcagtcacgtggtagagaggcgggcggaggggagggaggcgggcagggaggggagggggagcggagctgagggggagggggaggggagggggcgtcctccgcagttcgctcctcgccggggctcagacacacagccagcccagagccgccacgccggcccggccgccgccgccaccgcctcagcctcccccgaagccgctctagccgcgggaagcgccgctgccacagccgcgggccgcccccgccgcgccggcctgggctcaagctgccagcaccgccgcagccgccaccggagccggagcgggagcccgaccgcgctgggctgggctgggctgggctggggcgggcgcagggcgcaggggcgggcgcgcgggggaagacgcacgggcgggctcggctctcccggggagcggcccgggactgcaccgggaccagcgcctccccgcttcgcgctgccctcggcctcgccccgggcccgggtggatgagccgcgcgcccgggggacatggaagcgctga

SEQ ID NO: 5677 - protein, 34 aa, homo sapiens; identical to SEQ ID NO: 5665

SEQ ID NO: 5678 - DNA, 105 bp, homo sapiens; identical to SEQ ID NO: 5666

SEQ ID NO: 5679 - protein, 107 aa, homo sapiens [sequence omitted]

SEQ ID NO: 5680 - DNA, 324 bp, homo sapiens; identical to SEQ ID NO: 5668

SEQ ID NO: 5681 - protein, 111 aa, homo sapiens [sequence omitted]

SEQ ID NO: 5682 - DNA, 336 bp, homo sapiens
atgcgccctgcctggcccccacctggtcctctttccttttcaggtggaggagatgccgctgtcccgtcggtctggggacagcccagctccccggatcccgggctggagagacgcgtcgcggccccggggcctggtggcacgagcaggaaggaggacccggcggcgggctctgcctgggcttgcctgggcttgttccgagccgggctgcttctcggtgaccacgcagatcgggggcatttggagattttgcgggagtcctgcagccaagctccggggcaggagaggcctggaagcctgcactacctgctcgccccgtcccagcatgcacccaggtaa

SEQ ID NO: 5683 - protein, 112 aa, homo sapiens
MPLSRRSGDSPAPRIPGWRDASRPRGLVARAGRRTRRRALPGLAWACSEPGCFSVTTQIGGIWRFCGSPAAKLRGRRGLEACTTCSPRPSMHPGKRLCFSVRAKVCKEGGGN

SEQ ID NO: 5684 - DNA, 339 bp, homo sapiens
atgccgctgtcccgtcggtctggggacagcccagctccccggatcccgggctggagagacgcgtcgcggccccggggcctggtggcacgagcaggaaggaggacccggcggcgggctctgcctgggcttgcctgggcttgttccgagccgggctgcttctcggtgaccacgcagatcgggggcatttggagattttgcgggagtcctgcagccaagctccggggcaggagaggcctggaagcctgcactacctgctcgccccgtcccagcatgcacccaggtaaacgcttgtgtttctcagtccgtgcgaaagtttgcaaagaaggaggcgggaactag

SEQ ID NO: 5685 - protein, 23 aa, homo sapiens
MKTLFNCVASVRGRISKKQQNVL

SEQ ID NO: 5686 - DNA, 72 bp, homo sapiens
atgaaaaccctgttcaattgtgtagcctccgtaaggggaagaatttccaagaagcaacaaaatgttctttga

SEQ ID NO: 5687 - protein, 70 aa, homo sapiens
MFFDFIISGEKGFLFWGFARLVLSSLLYLQRGARKADWFMGGKWGPWLSCAAGHGDIAANAQPPQFLSSP

SEQ ID NO: 5688 - DNA, 213 bp, homo sapiens
atgttctttgatttcataatctctggggagaaaggattccttttttggggttttgctcggctagttctttcttccctcctctatctccagcgtggggcgaggaaggccgactggttcatgggtggcaaatggggaccctggctctcttgcgctgctggccacggtgatattgcagcaaatgctcaacctccccagttcctctcctcaccttga

SEQ ID NO: 5689 - protein, 52 aa, homo sapiens; identical to SEQ ID NO: 777

SEQ ID NO: 5690 - DNA, 159 bp, homo sapiens; identical to SEQ ID NO: 778

SEQ ID NO: 5691 - protein, 36 aa, homo sapiens; identical to SEQ ID NO: 779

SEQ ID NO: 5692 - DNA, 111 bp, homo sapiens; identical to SEQ ID NO: 780

SEQ ID NO: 5693 - protein, 34 aa, homo sapiens; identical to SEQ ID NO: 781

SEQ ID NO: 5694 - DNA, 105 bp, homo sapiens; identical to SEQ ID NO: 782

SEQ ID NO: 5695 - protein, 44 aa, homo sapiens; identical to SEQ ID NO: 783

SEQ ID NO: 5696 - DNA, 135 bp, homo sapiens; identical to SEQ ID NO: 784

SEQ ID NO: 5697 - protein, 52 aa, homo sapiens; identical to SEQ ID NO: 777

SEQ ID NO: 5698 - DNA, 159 bp, homo sapiens; identical to SEQ ID NO: 778

SEQ ID NO: 5699 - protein, 36 aa, homo sapiens; identical to SEQ ID NO: 779

SEQ ID NO: 5700 - DNA, 111 bp, homo sapiens; identical to SEQ ID NO: 780

SEQ ID NO: 5701 - protein, 34 aa, homo sapiens; identical to SEQ ID NO: 781

SEQ ID NO: 5702 - DNA, 105 bp, homo sapiens; identical to SEQ ID NO: 782

SEQ ID NO: 5703 - protein, 44 aa, homo sapiens; identical to SEQ ID NO: 783

SEQ ID NO: 5704 - DNA, 135 bp, homo sapiens; identical to SEQ ID NO: 784

SEQ ID NO: 5705 - protein, 15 aa, homo sapiens
MHCFLFRLPRRECLT

SEQ ID NO: 5706 - DNA, 48 bp, homo sapiens
atgcactgttttcttttccgccttccacggagggaatgcctaacttga

SEQ ID NO: 5707 - protein, 13 aa, homo sapiens
MPNLISFPQVIVT

SEQ ID NO: 5708 - DNA, 42 bp, homo sapiens
atgcctaacttgatctcatttccacaagtaatagtcacatga

SEQ ID NO: 5709 - protein, 17 aa, homo sapiens
MTRFPSRWRILSLRSLM

SEQ ID NO: 5710 - DNA, 54 bp, homo sapiens
atgacacgtttcccgtcaagatggcggatactctcccttcggagtttgatgtga

SEQ ID NO: 5711 - protein, 55 aa, homo sapiens
MADTLPSEFDVIVIGTGMCSLVLPGQSLGRLSCFCFFCQWRVLGQTSWVESGREN

SEQ ID NO: 5712 - DNA, 168 bp, homo sapiens
atggcggatactctcccttcggagtttgatgtgatcgtaatagggacgggtatgtgtagcctggtgcttcctggacaaagtttaggaagactgtcttgtttctgttttttctgtcagtggcgagttttgggacaaacatcgtgggtcgagagtgggagggagaactga

SEQ ID NO: 5713 - protein, 16 aa, homo sapiens
MSRAPASLPLLPGWAV

SEQ ID NO: 5714 - DNA, 51 bp, homo sapiens; identical to SEQ ID NO: 4618

SEQ ID NO: 5715 - protein, 41 aa, homo sapiens; identical to SEQ ID NO: 4619

SEQ ID NO: 5716 - DNA, 126 bp, homo sapiens; identical to SEQ ID NO: 4620

SEQ ID NO: 5717 - protein, 13 aa, homo sapiens
MGLPRARRWQPGA

SEQ ID NO: 5718 - DNA, 42 bp, homo sapiens; identical to SEQ ID NO: 4622

SEQ ID NO: 5719 - protein, 36 aa, homo sapiens; identical to SEQ ID NO: 4623

SEQ ID NO: 5720 - DNA, 111 bp, homo sapiens; identical to SEQ ID NO: 4624

SEQ ID NO: 5721 - protein, 5 aa, homo sapiens
MGGGE

SEQ ID NO: 5722 - DNA, 18 bp, homo sapiens
atggggggtggcgaatag

SEQ ID NO: 5723 - protein, 7 aa, homo sapiens
MSCLMNC

SEQ ID NO: 5724 - DNA, 24 bp, homo sapiens
atgtcttgtttaatgaactgctaa

SEQ ID NO: 5725 - protein, 15 aa, homo sapiens
MSLLGSYFYLFPLIG

SEQ ID NO: 5726 - DNA, 48 bp, homo sapiens; identical to SEQ ID NO: 3910

SEQ ID NO: 5727 - protein, 16 aa, homo sapiens
MISSFPTFFCLSNQDT

SEQ ID NO: 5728 - DNA, 51 bp, homo sapiens; identical to SEQ ID NO: 3912

SEQ ID NO: 5729 - protein, 49 aa, homo sapiens; identical to SEQ ID NO: 393

SEQ ID NO: 5730 - DNA, 150 bp, homo sapiens; identical to SEQ ID NO: 394

SEQ ID NO: 5731 - protein, 77 aa, homo sapiens; identical to SEQ ID NO: 395

SEQ ID NO: 5732 - DNA, 234 bp, homo sapiens; identical to SEQ ID NO: 396

SEQ ID NO: 5733 - protein, 15 aa, homo sapiens
MGGGACGGRAPGIPD

SEQ ID NO: 5734 - DNA, 48 bp, homo sapiens; identical to SEQ ID NO: 398

SEQ ID NO: 5735 - protein, 13 aa, homo sapiens
MRRLCPLRTHPYL

SEQ ID NO: 5736 - DNA, 42 bp, homo sapiens; identical to SEQ ID NO: 400

SEQ ID NO: 5737 - protein, 25 aa, homo sapiens
MALKGPDPAPVGHAVFSPRFTRRIF

SEQ ID NO: 5738 - DNA, 78 bp, homo sapiens
atggcgttaaaaggtccagacccggcacctgtaggccatgccgtatttagccctaggttcacccggagaatattttag

SEQ ID NO: 5739 - protein, 116 aa, homo sapiens
MPYLALGSPGEYFRCYLKEEIWALVAGCHMARVESLPHRPGRDGRVLTGTGAQSPCQSFGAMRRVPRSQLATGASVLCGDAFSPRSQSEGSESTSIHRTHRGLSSLRWPSVISQAA

SEQ ID NO: 5740 - DNA, 351 bp, homo sapiens
atgccgtatttagccctaggttcacccggagaatattttaggtgctacttgaaagaagagatctgggccctagttgccggctgtcacatggcaagggtagaatcgctccctcacagacctggccgagatggccgggtgctcactggtacaggtgcccagagtccctgccagagcttcggggccatgcgacgggtgccaaggagccagctagcgactggggcgtcggttctgtgtggggatgccttttcaccccgttctcaatctgaaggcagtgaatccacttccattcacagaactcacagaggcctctcctctctgagatggcccagtgtgatatcccaggctgcgtag

SEQ ID NO: 5741 - protein, 27 aa, homo sapiens
MAGCSLVQVPRVPARASGPCDGCQGAS

SEQ ID NO: 5742 - DNA, 84 bp, homo sapiens
atggccgggtgctcactggtacaggtgcccagagtccctgccagagcttcggggccatgcgacgggtgccaaggagccagctag

SEQ ID NO: 5743 - protein, 26 aa, homo sapiens
MPFHPVLNLKAVNPLPFTELTEASPL

SEQ ID NO: 5744 - DNA, 81 bp, homo sapiens
atgccttttcaccccgttctcaatctgaaggcagtgaatccacttccattcacagaactcacagaggcctctcctctctga

SEQ ID NO: 5745 - protein, 49 aa, homo sapiens
MPWGRHPELLSPQILVAEPRDGTWDLSSKTRPLFFETVSYSVAQAGVQW

SEQ ID NO: 5746 - DNA, 150 bp, homo sapiens
atgccttggggaagacaccctgaactccttagtcctcagatcttagtggctgaaccaagagatggcacctgggaccttagcagtaaaacccgtccccttttttttgagacagtgtcttactctgttgcccaggctggagtgcagtggtga

SEQ ID NO: 5747 - protein, 47 aa, homo sapiens
MAPGTLAVKPVPFFLRQCLTLLPRLECSGEHSSLQPELPRLKPHPPE

SEQ ID NO: 5748 - DNA, 144 bp, homo sapiens
atggcacctgggaccttagcagtaaaacccgtccccttttttttgagacagtgtcttactctgttgcccaggctggagtgcagtggtgagcacagctcactgcagcctgaacttcctaggctcaagcctcatcctcctgagtag

SEQ ID NO: 5749 - protein, 43 aa, homo sapiens
MRVWNSHLKFGGNVTSPMMRLALGNNPCIHFGNLLWDSRSVVF

SEQ ID NO: 5750 - DNA, 132 bp, homo sapiens
atgagggtctggaacagtcatctgaagtttgggggaaacgtcacgtctcctatgatgcgcctggctttagggaataatccttgtatccattttgggaacctgctctgggattccagatctgtggttttctga

SEQ ID NO: 5751 - protein, 5 aa, homo sapiens
MRSLS

SEQ ID NO: 5752 - DNA, 18 bp, homo sapiens
atgaggtccctttcgtga

SEQ ID NO: 5753 - protein, 60 aa, homo sapiens; identical to SEQ ID NO: 4681

SEQ ID NO: 5754 - DNA, 183 bp, homo sapiens; identical to SEQ ID NO: 4682

SEQ ID NO: 5755 - protein, 38 aa, homo sapiens; identical to SEQ ID NO: 4683

SEQ ID NO: 5756 - DNA, 117 bp, homo sapiens; identical to SEQ ID NO: 4684

SEQ ID NO: 5757 - protein, 38 aa, homo sapiens; identical to SEQ ID NO: 4685

SEQ ID NO: 5758 - DNA, 117 bp, homo sapiens; identical to SEQ ID NO: 4686

SEQ ID NO: 5759 - protein, 72 aa, homo sapiens; identical to SEQ ID NO: 4687

SEQ ID NO: 5760 - DNA, 219 bp, homo sapiens; identical to SEQ ID NO: 4688

SEQ ID NO: 5761 - protein, 38 aa, homo sapiens; identical to SEQ ID NO: 4683

SEQ ID NO: 5762 - DNA, 117 bp, homo sapiens; identical to SEQ ID NO: 4684

SEQ ID NO: 5763 - protein, 38 aa, homo sapiens; identical to SEQ ID NO: 4685

SEQ ID NO: 5764 - DNA, 117 bp, homo sapiens; identical to SEQ ID NO: 4686

SEQ ID NO: 5765 - protein, 72 aa, homo sapiens; identical to SEQ ID NO: 4687

SEQ ID NO: 5766 - DNA, 219 bp, homo sapiens; identical to SEQ ID NO: 4688

SEQ ID NO: 5767 - protein, 32 aa, homo sapiens; identical to SEQ ID NO: 4695

SEQ ID NO: 5768 - DNA, 99 bp, homo sapiens; identical to SEQ ID NO: 4696

SEQ ID NO: 5769 - protein, 30 aa, homo sapiens; identical to SEQ ID NO: 5337

SEQ ID NO: 5770 - DNA, 93 bp, homo sapiens; identical to SEQ ID NO: 5338

SEQ ID NO: 5771 - protein, 10 aa, homo sapiens
MPFCFLSPQL

SEQ ID NO: 5772 - DNA, 33 bp, homo sapiens; identical to SEQ ID NO: 5340

SEQ ID NO: 5773 - protein, 15 aa, homo sapiens
MLGGLPSTLTWKCFL

SEQ ID NO: 5774 - DNA, 48 bp, homo sapiens; identical to SEQ ID NO: 5342

SEQ ID NO: 5775 - protein, 15 aa, homo sapiens
MEVLSVTLKVSASMF

SEQ ID NO: 5776 - DNA, 48 bp, homo sapiens; identical to SEQ ID NO: 5344

SEQ ID NO: 5777 - protein, 22 aa, homo sapiens
MDQGVEGGGCGPGVGRQSACSL

SEQ ID NO: 5778 - DNA, 69 bp, homo sapiens; identical to SEQ ID NO: 4146

SEQ ID NO: 5779 - protein, 28 aa, homo sapiens
MKDGKEGYRDRGRVGLRIARAAWHTVLG

SEQ ID NO: 5780 - DNA, 87 bp, homo sapiens; identical to SEQ ID NO: 4148

SEQ ID NO: 5781 - protein, 41 aa, homo sapiens; identical to SEQ ID NO: 4149

SEQ ID NO: 5782 - DNA, 126 bp, homo sapiens; identical to SEQ ID NO: 4150

SEQ ID NO: 5783 - protein, 16 aa, homo sapiens
MILFPLDPAPLVPFSL

SEQ ID NO: 5784 - DNA, 51 bp, homo sapiens; identical to SEQ ID NO: 4152

SEQ ID NO: 5785 - protein, 22 aa, homo sapiens
MDQGVEGGGCGPGVGRQSACSL

SEQ ID NO: 5786 - DNA, 69 bp, homo sapiens; identical to SEQ ID NO: 4146

SEQ ID NO: 5787 - protein, 28 aa, homo sapiens
MKDGKEGYRDRGRVGLRIARAAWHTVLG

SEQ ID NO: 5788 - DNA, 87 bp, homo sapiens; identical to SEQ ID NO: 4148

SEQ ID NO: 5789 - protein, 41 aa, homo sapiens; identical to SEQ ID NO: 4149

SEQ ID NO: 5790 - DNA, 126 bp, homo sapiens; identical to SEQ ID NO: 4150

SEQ ID NO: 5791 - protein, 16 aa, homo sapiens
MILFPLDPAPLVPFSL

SEQ ID NO: 5792 - DNA, 51 bp, homo sapiens; identical to SEQ ID NO: 4152

SEQ ID NO: 5793 - protein, 22 aa, homo sapiens
MDQGVEGGGCGPGVGRQSACSL

SEQ ID NO: 5794 - DNA, 69 bp, homo sapiens; identical to SEQ ID NO: 4146

SEQ ID NO: 5795 - protein, 28 aa, homo sapiens
MKDGKEGYRDRGRVGLRIARAAWHTVLG

SEQ ID NO: 5796 - DNA, 87 bp, homo sapiens; identical to SEQ ID NO: 4148

SEQ ID NO: 5797 - protein, 41 aa, homo sapiens; identical to SEQ ID NO: 4149

SEQ ID NO: 5798 - DNA, 126 bp, homo sapiens; identical to SEQ ID NO: 4150

SEQ ID NO: 5799 - protein, 16 aa, homo sapiens
MILFPLDPAPLVPFSL

SEQ ID NO: 5800 - DNA, 51 bp, homo sapiens; identical to SEQ ID NO: 4152

SEQ ID NO: 5801 - protein, 4 aa, homo sapiens
MAEL

SEQ ID NO: 5802 - DNA, 15 bp, homo sapiens
atggctgagctgtaa

SEQ ID NO: 5803 - protein, 26 aa, homo sapiens
MESGSITQAGVQWRDVSSLQPLPPGF

SEQ ID NO: 5804 - DNA, 81 bp, homo sapiens
atggagtctggctctatcacccaggctggagtgcagtggcgtgatgtgagctcactgcaacctctgcctcctgggttctag

SEQ ID NO: 5805 - protein, 65 aa, homo sapiens
MLFAVSFLSLAILCSKCCTFSLMKELGLTRKVEHVLPQLARITNGKETLASWGPKSSPSLSHSLF

SEQ ID NO: 5806 - DNA, 198 bp, homo sapiens
atgctatttgctgtctcatttctatctctcgccatcctttgcagcaaatgctgtacattttcattgatgaaggaactaggtttaaccagaaaggttgagcacgtactcccgcagctggctaggattacaaatgggaaggaaaccctggcctcctggggccccaagtcttccccttccttgagtcattcattattttga

SEQ ID NO: 5807 - protein, 16 aa, homo sapiens
MLYIFIDEGTRFNQKG

SEQ ID NO: 5808 - DNA, 51 bp, homo sapiens
atgctgtacattttcattgatgaaggaactaggtttaaccagaaaggttga

SEQ ID NO: 5809 - protein, 44 aa, homo sapiens [sequence omitted]

SEQ ID NO: 5810 - DNA, 135 bp, homo sapiens
atgagagggtgggaaggggtgggctttaatcctatcaaagttgagtgggctctcaccctatataagaacgcagctgcagtgaaccttgttctttctggcagacctgaggtgtggacgtatcattggcctctgtga

SEQ ID NO: 5811 - protein, 12 aa, homo sapiens
MLFYFLSFYFIF

SEQ ID NO: 5812 - DNA, 39 bp, homo sapiens
atgttattttattttctttcattttactttattttttag

SEQ ID NO: 5813 - protein, 70 aa, homo sapiens
MKCTGRMMAPCSLDLLGLTLLASSSWDHRRAPPFPCAFFCFFFFFFRRDGVFYVIQAGLELLGSRAILPP

SEQ ID NO: 5814 - DNA, 213 bp, homo sapiens
atgaagtgcacaggtaggatgatggcgccttgcagcctcgacctcctgggactcacccttttagcctccagtagctgggaccacaggcgcgcaccaccattcccatgtgcgtttttctgcttttttttttttttttttaggagagatggggttttctatgttatccaagctggtctcgaactcctgggctcaagagcaatcctaccaccgtag

SEQ ID NO: 5815 - protein, 11 aa, homo sapiens
MCVFLLFFFFF

SEQ ID NO: 5816 - DNA, 36 bp, homo sapiens
atgtgcgtttttctgcttttttttttttttttttag

SEQ ID NO: 5817 - protein, 4 aa, homo sapiens
MAEL

SEQ ID NO: 5818 - DNA, 15 bp, homo sapiens
atggctgagctgtaa

SEQ ID NO: 5819 - protein, 26 aa, homo sapiens
MESGSITQAGVQWRDVSSLQPLPPGF

SEQ ID NO: 5820 - DNA, 81 bp, homo sapiens; identical to SEQ ID NO: 5804

SEQ ID NO: 5821 - protein, 65 aa, homo sapiens; identical to SEQ ID NO: 5805

SEQ ID NO: 5822 - DNA, 198 bp, homo sapiens; identical to SEQ ID NO: 5806

SEQ ID NO: 5823 - protein, 16 aa, homo sapiens
MLYIFIDEGTRFNQKG

SEQ ID NO: 5824 - DNA, 51 bp, homo sapiens; identical to SEQ ID NO: 5808

SEQ ID NO: 5825 - protein, 44 aa, homo sapiens [sequence omitted]

SEQ ID NO: 5826 - DNA, 135 bp, homo sapiens; identical to SEQ ID NO: 5810

SEQ ID NO: 5827 - protein, 12 aa, homo sapiens
MLFYFLSFYFIF

SEQ ID NO: 5828 - DNA, 39 bp, homo sapiens; identical to SEQ ID NO: 5812

SEQ ID NO: 5829 - protein, 70 aa, homo sapiens; identical to SEQ ID NO: 5813

SEQ ID NO: 5830 - DNA, 213 bp, homo sapiens; identical to SEQ ID NO: 5814

SEQ ID NO: 5831 - protein, 11 aa, homo sapiens
MCVFLLFFFFF

SEQ ID NO: 5832 - DNA, 36 bp, homo sapiens; identical to SEQ ID NO: 5816

SEQ ID NO: 5833 - protein, 4 aa, homo sapiens
MAEL

SEQ ID NO: 5834 - DNA, 15 bp, homo sapiens
atggctgagctgtaa

SEQ ID NO: 5835 - protein, 26 aa, homo sapiens
MESGSITQAGVQWRDVSSLQPLPPGF

SEQ ID NO: 5836 - DNA, 81 bp, homo sapiens; identical to SEQ ID NO: 5804

SEQ ID NO: 5837 - protein, 65 aa, homo sapiens; identical to SEQ ID NO: 5805

SEQ ID NO: 5838 - DNA, 198 bp, homo sapiens; identical to SEQ ID NO: 5806

SEQ ID NO: 5839 - protein, 16 aa, homo sapiens
MLYIFIDEGTRFNQKG

SEQ ID NO: 5840 - DNA, 51 bp, homo sapiens; identical to SEQ ID NO: 5808

SEQ ID NO: 5841 - protein, 44 aa, homo sapiens [sequence omitted]

SEQ ID NO: 5842 - DNA, 135 bp, homo sapiens; identical to SEQ ID NO: 5810

SEQ ID NO: 5843 - protein, 12 aa, homo sapiens
MLFYFLSFYFIF

SEQ ID NO: 5844 - DNA, 39 bp, homo sapiens; identical to SEQ ID NO: 5812

SEQ ID NO: 5845 - protein, 70 aa, homo sapiens; identical to SEQ ID NO: 5813

SEQ ID NO: 5846 - DNA, 213 bp, homo sapiens; identical to SEQ ID NO: 5814

SEQ ID NO: 5847 - protein, 11 aa, homo sapiens
MCVFLLFFFFF

SEQ ID NO: 5848 - DNA, 36 bp, homo sapiens; identical to SEQ ID NO: 5816

SEQ ID NO: 5849 - protein, 23 aa, homo sapiens
MCGNIFFLFLRWGLTLLPRLATS

SEQ ID NO: 5850 - DNA, 72 bp, homo sapiens
atgtgtggaaatattttttttctttttttgagatggggtctcactctgttgcccaggctggcaacatcatag

SEQ ID NO: 5851 - protein, 36 aa, homo sapiens
MGSHSVAQAGNIIAGTIIAHCSLDFLGSSDSSTSAF

SEQ ID NO: 5852 - DNA, 111 bp, homo sapiens
atggggtctcactctgttgcccaggctggcaacatcatagctggcacaatcatagctcactgtagcctcgacttcctgggctcgagtgattcttccacctcagccttctga

SEQ ID NO: 5853 - protein, 9 aa, homo sapiens
MSPELVSNS

SEQ ID NO: 5854 - DNA, 30 bp, homo sapiens
atgtcacccgagctggtctcgaactcctga

SEQ ID NO: 5855 - protein, 40 aa, homo sapiens [sequence omitted]

SEQ ID NO: 5856 - DNA, 123 bp, homo sapiens
atgggagagggattgacgaaagaagtatgggctgagggagggatgatggtggaggccagtgtgaccgaggggaggggaaaggtggaagaagcagagtgggatagcgtcctgggaaagaagtga

SEQ ID NO: 5857 - protein, 23 aa, homo sapiens
MCGNIFFLFLRWGLTLLPRLATS

SEQ ID NO: 5858 - DNA, 72 bp, homo sapiens; identical to SEQ ID NO: 5850

SEQ ID NO: 5859 - protein, 36 aa, homo sapiens; identical to SEQ ID NO: 5851

SEQ ID NO: 5860 - DNA, 111 bp, homo sapiens; identical to SEQ ID NO: 5852

SEQ ID NO: 5861 - protein, 9 aa, homo sapiens
MSPELVSNS

SEQ ID NO: 5862 - DNA, 30 bp, homo sapiens; identical to SEQ ID NO: 5854

SEQ ID NO: 5863 - protein, 40 aa, homo sapiens [sequence omitted]

SEQ ID NO: 5864 - DNA, 123 bp, homo sapiens; identical to SEQ ID NO: 5856

SEQ ID NO: 5865 - protein, 32 aa, homo sapiens [sequence omitted]

SEQ ID NO: 5866 - DNA, 99 bp, homo sapiens
atgatccagaacatcctggtggaggcgagccgcggggaggtggtactcacctcgcggccacgcgtcatcgccctgccgccgttctgcgtgcccaggtaa

SEQ ID NO: 5867 - protein, 25 aa, homo sapiens
MPAPSLSDMPLGVTPGPLSTASKSI

SEQ ID NO: 5868 - DNA, 78 bp, homo sapiens
atgcccgcgcccagcctctccgacatgccgctaggggtcacgcctggccccctctccaccgccagtaaaagcatctag

SEQ ID NO: 5869 - protein, 35 aa, homo sapiens
MAGSSPGGLQRRGGNLGPGRMHLSAHTAAGLRPGR

SEQ ID NO: 5870 - DNA, 108 bp, homo sapiens
atggcagggagcagcccgggcggactgcagaggcgcggcgggaacttagggcccgggaggatgcacctctccgcccacactgcagctggactgagacctggccgctag

SEQ ID NO: 5871 - protein, 75 aa, homo sapiens
MDTHLSVPPNPRPGASVLCFSAPPSQRQVGGKVTSGVVPEAPRVPSTLPSAPATKASEKLRSQSPGGGGGSAPPP

SEQ ID NO: 5872 - DNA, 228 bp, homo sapiens
atggatacccacctctcggttcctcctaacccccgcccgggagcttctgtcctctgcttctcggctcctccctcccagaggcaggtgggtggaaaagtgacatctggtgttgttccagaggcgcccagggtccccagcaccctcccctccgcccccgccaccaaggcctcggagaagctccggtctcagagcccgggcgggggaggggggagcgctccgcctccatga

SEQ ID NO: 5873 - protein, 22 aa, homo sapiens
MDQGVEGGGCGPGVGRQSACSL

SEQ ID NO: 5874 - DNA, 69 bp, homo sapiens; identical to SEQ ID NO: 4146

SEQ ID NO: 5875 - protein, 28 aa, homo sapiens
MKDGKEGYRDRGRVGLRIARAAWHTVLG

SEQ ID NO: 5876 - DNA, 87 bp, homo sapiens; identical to SEQ ID NO: 4148

SEQ ID NO: 5877 - protein, 41 aa, homo sapiens; identical to SEQ ID NO: 4149

SEQ ID NO: 5878 - DNA, 126 bp, homo sapiens; identical to SEQ ID NO: 4150

SEQ ID NO: 5879 - protein, 16 aa, homo sapiens
MILFPLDPAPLVPFSL

SEQ ID NO: 5880 - DNA, 51 bp, homo sapiens; identical to SEQ ID NO: 4152

SEQ ID NO: 5881 - protein, 22 aa, homo sapiens
MDQGVEGGGCGPGVGRQSACSL

SEQ ID NO: 5882 - DNA, 69 bp, homo sapiens; identical to SEQ ID NO: 4146

SEQ ID NO: 5883 - protein, 28 aa, homo sapiens
MKDGKEGYRDRGRVGLRIARAAWHTVLG

SEQ ID NO: 5884 - DNA, 87 bp, homo sapiens; identical to SEQ ID NO: 4148

SEQ ID NO: 5885 - protein, 41 aa, homo sapiens; identical to SEQ ID NO: 4149

SEQ ID NO: 5886 - DNA, 126 bp, homo sapiens; identical to SEQ ID NO: 4150

SEQ ID NO: 5887 - protein, 16 aa, homo sapiens
MILFPLDPAPLVPFSL

SEQ ID NO: 5888 - DNA, 51 bp, homo sapiens; identical to SEQ ID NO: 4152

SEQ ID NO: 5889 - protein, 22 aa, homo sapiens
MDQGVEGGGCGPGVGRQSACSL

SEQ ID NO: 5890 - DNA, 69 bp, homo sapiens; identical to SEQ ID NO: 4146

SEQ ID NO: 5891 - protein, 28 aa, homo sapiens
MKDGKEGYRDRGRVGLRIARAAWHTVLG

SEQ ID NO: 5892 - DNA, 87 bp, homo sapiens; identical to SEQ ID NO: 4148

SEQ ID NO: 5893 - protein, 41 aa, homo sapiens; identical to SEQ ID NO: 4149

SEQ ID NO: 5894 - DNA, 126 bp, homo sapiens; identical to SEQ ID NO: 4150

SEQ ID NO: 5895 - protein, 16 aa, homo sapiens
MILFPLDPAPLVPFSL

SEQ ID NO: 5896 - DNA, 51 bp, homo sapiens; identical to SEQ ID NO: 4152

SEQ ID NO: 5897 - protein, 22 aa, homo sapiens
MDQGVEGGGCGPGVGRQSACSL

SEQ ID NO: 5898 - DNA, 69 bp, homo sapiens; identical to SEQ ID NO: 4146

SEQ ID NO: 5899 - protein, 28 aa, homo sapiens
MKDGKEGYRDRGRVGLRIARAAWHTVLG

SEQ ID NO: 5900 - DNA, 87 bp, homo sapiens; identical to SEQ ID NO: 4148

SEQ ID NO: 5901 - protein, 41 aa, homo sapiens; identical to SEQ ID NO: 4149

SEQ ID NO: 5902 - DNA, 126 bp, homo sapiens; identical to SEQ ID NO: 4150

SEQ ID NO: 5903 - protein, 16 aa, homo sapiens
MILFPLDPAPLVPFSL

SEQ ID NO: 5904 - DNA, 51 bp, homo sapiens; identical to SEQ ID NO: 4152

SEQ ID NO: 5905 - protein, 60 aa, homo sapiens [sequence omitted]

SEQ ID NO: 5906 - DNA, 183 bp, homo sapiens
atggcggggaacgactgcggcgcgctgctggacgaagagctctcctccttcttcctcaactatctcgctgacacgcaggtacggccggctggggctgcgggcccggggccaggggtgctgagctgcgggggccgcagctgcagccgcggaggccgggaggcagcggtgggagccctggggtaa

SEQ ID NO: 5907 - protein, 133 aa, homo sapiens
MRSVTGAGSRRSPGACRSAGGATAAGEGLALAAWSLPPRGQNWGVPRFLWEVEARHGVGYPQAGAGCWRRAVSARHLLPYFHVDLWPRHGCMPGSPESPSPPGCSPQSAVAGPPRLSTRARSAEFPASCRLKA

SEQ ID NO: 5908 - DNA, 402 bp, homo sapiens
atgcgctccgttaccggggcagggagccggaggtctcccggcgcgtgccggagcgctgggggcgctacggccgctggggagggtctagccttggccgcttggagtctgccaccccgcgggcaaaactggggggtaccgcgcttcctttgggaggtggaggcgcgccacggtgtggggtaccctcaggctggcgctgggtgctggaggcgcgccgtcagcgcccggcacttgctgccgtactttcacgtggacttgtggccccggcacgggtgcatgcccgggtctccggagtcccctagtcctccaggctgtagtccccagagtgctgttgctggccccccgcggctttctacccgcgcccgcagcgcggagtttcctgccagttgccggctaaaggcataa

SEQ ID NO: 5909 - protein, 130 aa, homo sapiens
MRAETASSWFRYRAEPPGGKSQAGWGRKDCLGAPGSPCGARPRCALHDAGGREGEAESQALAEPGSPTGDTRVTGEGALVCRGAGERGSWWLGDWERGAAGTSSHQKCQHEACAAPTPSPIFPTQCLLQA

SEQ ID NO: 5910 - DNA, 393 bp, homo sapiens
atgcgggcggagacagcgtcttcctggtttcgctatcgggcggagccccctggggggaaaagccaggctggatgggggcggaaggactgtctgggggcgcctgggtccccctgcggtgcgcggccccggtgcgcgctccacgatgcagggggaagggaaggcgaggcggagtcccaggcactggctgagcccgggagccccactggcgacacgcgcgtgacaggagagggtgctctggtgtgccggggcgcgggggagcgaggaagctggtggcttggagactgggagaggggtgctgctgggacaagcagccaccaaaaatgtcagcacgaggcgtgcgcggcccccaccccttcccccattttccccacccaatgcctgttgcaagcataa

SEQ ID NO: 5911 - protein, 38 aa, homo sapiens
MGAEGLSGGAWVPLRCAAPVRAPRCRGKGRRGGVPGTG

SEQ ID NO: 5912 - DNA, 117 bp, homo sapiens
atgggggcggaaggactgtctgggggcgcctgggtccccctgcggtgcgcggccccggtgcgcgctccacgatgcagggggaagggaaggcgaggcggagtcccaggcactggctga

SEQ ID NO: 5913 - protein, 22 aa, homo sapiens
MDQGVEGGGCGPGVGRQSACSL

SEQ ID NO: 5914 - DNA, 69 bp, homo sapiens; identical to SEQ ID NO: 4146

SEQ ID NO: 5915 - protein, 28 aa, homo sapiens
MKDGKEGYRDRGRVGLRIARAAWHTVLG

SEQ ID NO: 5916 - DNA, 87 bp, homo sapiens; identical to SEQ ID NO: 4148

SEQ ID NO: 5917 - protein, 41 aa, homo sapiens; identical to SEQ ID NO: 4149

SEQ ID NO: 5918 - DNA, 126 bp, homo sapiens; identical to SEQ ID NO: 4150

SEQ ID NO: 5919 - protein, 16 aa, homo sapiens
MILFPLDPAPLVPFSL

SEQ ID NO: 5920 - DNA, 51 bp, homo sapiens; identical to SEQ ID NO: 4152

SEQ ID NO: 5921 - protein, 22 aa, homo sapiens
MDQGVEGGGCGPGVGRQSACSL

SEQ ID NO: 5922 - DNA, 69 bp, homo sapiens; identical to SEQ ID NO: 4146

SEQ ID NO: 5923 - protein, 28 aa, homo sapiens
MKDGKEGYRDRGRVGLRIARAAWHTVLG

SEQ ID NO: 5924 - DNA, 87 bp, homo sapiens; identical to SEQ ID NO: 4148

SEQ ID NO: 5925 - protein, 41 aa, homo sapiens; identical to SEQ ID NO: 4149

SEQ ID NO: 5926 - DNA, 126 bp, homo sapiens; identical to SEQ ID NO: 4150

SEQ ID NO: 5927 - protein, 16 aa, homo sapiens
MILFPLDPAPLVPFSL

SEQ ID NO: 5928 - DNA, 51 bp, homo sapiens; identical to SEQ ID NO: 4152

SEQ ID NO: 5929 - protein, 22 aa, homo sapiens
MDQGVEGGGCGPGVGRQSACSL

SEQ ID NO: 5930 - DNA, 69 bp, homo sapiens; identical to SEQ ID NO: 4146

SEQ ID NO: 5931 - protein, 28 aa, homo sapiens
MKDGKEGYRDRGRVGLRIARAAWHTVLG

SEQ ID NO: 5932 - DNA, 87 bp, homo sapiens; identical to SEQ ID NO: 4148

SEQ ID NO: 5933 - protein, 41 aa, homo sapiens; identical to SEQ ID NO: 4149

SEQ ID NO: 5934 - DNA, 126 bp, homo sapiens; identical to SEQ ID NO: 4150

SEQ ID NO: 5935 - protein, 16 aa, homo sapiens
MILFPLDPAPLVPFSL

SEQ ID NO: 5936 - DNA, 51 bp, homo sapiens; identical to SEQ ID NO: 4152

SEQ ID NO: 5937 - protein, 22 aa, homo sapiens
MDQGVEGGGCGPGVGRQSACSL

SEQ ID NO: 5938 - DNA, 69 bp, homo sapiens; identical to SEQ ID NO: 4146

SEQ ID NO: 5939 - protein, 28 aa, homo sapiens
MKDGKEGYRDRGRVGLRIARAAWHTVLG

SEQ ID NO: 5940 - DNA, 87 bp, homo sapiens; identical to SEQ ID NO: 4148

SEQ ID NO: 5941 - protein, 41 aa, homo sapiens; identical to SEQ ID NO: 4149

SEQ ID NO: 5942 - DNA, 126 bp, homo sapiens; identical to SEQ ID NO: 4150

SEQ ID NO: 5943 - protein, 16 aa, homo sapiens
MILFPLDPAPLVPFSL

SEQ ID NO: 5944 - DNA, 51 bp, homo sapiens; identical to SEQ ID NO: 4152

SEQ ID NO: 5945 - protein, 92 aa, homo sapiens [sequence omitted]

SEQ ID NO: 5946 - DNA, 279 bp, homo sapiens
atgagggacaaagagggagggagatacataaaacattatacatgtgcttggcaatacagaacttcatcatttggtttgttcctacttattgtttcccgtaaagaccctctggcctatctttcattttctctgcaagatggacctgagagtagccatttatttattgaatgttccagaagatggaattcatattgcaaaagaaaatacactacccctggagagagtatagttttagtatttcaggattgttttagactcatttggatcctgatttattga

SEQ ID NO: 5947 - protein, 19 aa, homo sapiens
MCLAIQNFIIWFVPTYCFP

SEQ ID NO: 5948 - DNA, 60 bp, homo sapiens
atgtgcttggcaatacagaacttcatcatttggtttgttcctacttattgtttcccgtaa

SEQ ID NO: 5949 - protein, 30 aa, homo sapiens
MDLRVAIYLLNVPEDGIHIAKENTLPLERV

SEQ ID NO: 5950 - DNA, 93 bp, homo sapiens
atggacctgagagtagccatttatttattgaatgttccagaagatggaattcatattgcaaaagaaaatacactacccctggagagagtatag

SEQ ID NO: 5951 - protein, 28 aa, homo sapiens
MFQKMEFILQKKIHYPWREYSFSISGLF

SEQ ID NO: 5952 - DNA, 87 bp, homo sapiens
atgttccagaagatggaattcatattgcaaaagaaaatacactacccctggagagagtatagttttagtatttcaggattgttttag

SEQ ID NO: 5953 - protein, 22 aa, homo sapiens
MDQGVEGGGCGPGVGRQSACSL

SEQ ID NO: 5954 - DNA, 69 bp, homo sapiens; identical to SEQ ID NO: 4146

SEQ ID NO: 5955 - protein, 28 aa, homo sapiens
MKDGKEGYRDRGRVGLRIARAAWHTVLG

SEQ ID NO: 5956 - DNA, 87 bp, homo sapiens; identical to SEQ ID NO: 4148

SEQ ID NO: 5957 - protein, 41 aa, homo sapiens; identical to SEQ ID NO: 4149

SEQ ID NO: 5958 - DNA, 126 bp, homo sapiens; identical to SEQ ID NO: 4150

SEQ ID NO: 5959 - protein, 16 aa, homo sapiens
MILFPLDPAPLVPFSL

SEQ ID NO: 5960 - DNA, 51 bp, homo sapiens; identical to SEQ ID NO: 4152

SEQ ID NO: 5961 - protein, 22 aa, homo sapiens
MDQGVEGGGCGPGVGRQSACSL

SEQ ID NO: 5962 - DNA, 69 bp, homo sapiens; identical to SEQ ID NO: 4146

SEQ ID NO: 5963 - protein, 28 aa, homo sapiens
MKDGKEGYRDRGRVGLRIARAAWHTVLG

SEQ ID NO: 5964 - DNA, 87 bp, homo sapiens; identical to SEQ ID NO: 4148

SEQ ID NO: 5965 - protein, 41 aa, homo sapiens; identical to SEQ ID NO: 4149

SEQ ID NO: 5966 - DNA, 126 bp, homo sapiens; identical to SEQ ID NO: 4150

SEQ ID NO: 5967 - protein, 16 aa, homo sapiens
MILFPLDPAPLVPFSL

SEQ ID NO: 5968 - DNA, 51 bp, homo sapiens; identical to SEQ ID NO: 4152

SEQ ID NO: 5969 - protein, 22 aa, homo sapiens
MDQGVEGGGCGPGVGRQSACSL

SEQ ID NO: 5970 - DNA, 69 bp, homo sapiens; identical to SEQ ID NO: 4146

SEQ ID NO: 5971 - protein, 28 aa, homo sapiens
MKDGKEGYRDRGRVGLRIARAAWHTVLG

SEQ ID NO: 5972 - DNA, 87 bp, homo sapiens; identical to SEQ ID NO: 4148

SEQ ID NO: 5973 - protein, 41 aa, homo sapiens; identical to SEQ ID NO: 4149

SEQ ID NO: 5974 - DNA, 126 bp, homo sapiens; identical to SEQ ID NO: 4150

SEQ ID NO: 5975 - protein, 16 aa, homo sapiens
MILFPLDPAPLVPFSL

SEQ ID NO: 5976 - DNA, 51 bp, homo sapiens; identical to SEQ ID NO: 4152

SEQ ID NO: 5977 - protein, 22 aa, homo sapiens
MDQGVEGGGCGPGVGRQSACSL

SEQ ID NO: 5978 - DNA, 69 bp, homo sapiens; identical to SEQ ID NO: 4146

SEQ ID NO: 5979 - protein, 28 aa, homo sapiens
MKDGKEGYRDRGRVGLRIARAAWHTVLG

SEQ ID NO: 5980 - DNA, 87 bp, homo sapiens; identical to SEQ ID NO: 4148

SEQ ID NO: 5981 - protein, 41 aa, homo sapiens; identical to SEQ ID NO: 4149

SEQ ID NO: 5982 - DNA, 126 bp, homo sapiens; identical to SEQ ID NO: 4150

SEQ ID NO: 5983 - protein, 16 aa, homo sapiens
MILFPLDPAPLVPFSL

SEQ ID NO: 5984 - DNA, 51 bp, homo sapiens; identical to SEQ ID NO: 4152

SEQ ID NO: 5985 - protein, 7 aa, homo sapiens
MTITKNV

SEQ ID NO: 5986 - DNA, 24 bp, homo sapiens
atgacaattacaaagaatgtttaa

SEQ ID NO: 5987 - protein, 9 aa, homo sapiens
MFNMDMRML

SEQ ID NO: 5988 - DNA, 30 bp, homo sapiens
atgtttaacatggacatgcgcatgttataa

SEQ ID NO: 5989 - protein, 9 aa, homo sapiens
MLKTKHNIK

SEQ ID NO: 5990 - DNA, 30 bp, homo sapiens
atgttaaaaacaaaacacaatataaaatag

SEQ ID NO: 5991 - protein, 5 aa, homo sapiens
MQRMK

SEQ ID NO: 5992 - DNA, 18 bp, homo sapiens
atgcagagaatgaagtga

SEQ ID NO: 5993 - protein, 30 aa, homo sapiens
MVGRGAHKYHFLRIVPDHVIRISSFKSISR

SEQ ID NO: 5994 - DNA, 93 bp, homo sapiens
atggtggggagaggagcacacaagtaccattttctgaggattgtgccagaccatgtcatacgtataagctcattcaaatcgatttccagataa

SEQ ID NO: 5995 - protein, 4 aa, homo sapiens
MSYV

SEQ ID NO: 5996 - DNA, 15 bp, homo sapiens
atgtcatacgtataa

SEQ ID NO: 5997 - protein, 140 aa, homo sapiens
MCAVEPVGTRRGSCYRLSPLSRESGSPEVSPTRPGSWALAPGLSGGGSSRGRPEPRPGQPGAPPAGAWDGAGRSAPSAPRLLGGRVPGALGGEDCRAEPSAPRRVPRSRRARRARRARRARRSRRACRGRDRGSSASRRE

SEQ ID NO: 5998 - DNA, 423 bp, homo sapiens
atgtgcgcggtagagccggtagggacgcgcagagggtcttgctaccgactctccccgctctcccgggagtctgggagccctgaggtgtcccctacccggccgggaagctgggctctcgccccgggactgtccggagggggctccagcagggggcgccccgagccccgtcccgggcagccgggcgcgcctccagccggcgcctgggacggggctggccgctccgccccctcggctcctaggctgctcggcgggcgggtgccgggcgctctgggaggagaggactgcagggccgagcccagcgcaccccgccgcgtcccccgttcccgccgcgcccgccgcgcccgccgcgcccgccgcgcccgccgctcccgccgcgcctgccgcggccgcgaccgcggcagctcagcctcccgccgtgagtag

SEQ ID NO: 5999 - protein, 8 aa, homo sapiens
MGGTGRAA

SEQ ID NO: 6000 - DNA, 27 bp, homo sapiens
atgggcgggacggggcgcgcggcctga

SEQ ID NO: 6001 - protein, 7 aa, homo sapiens
MAIPGRQ

SEQ ID NO: 6002 - DNA, 24 bp, homo sapiens
atggcgattccgggcaggcagtga

SEQ ID NO: 6003 - protein, 26 aa, homo sapiens
MRNYGDCIFGRGVLNALEVKGLCRQG

SEQ ID NO: 6004 - DNA, 81 bp, homo sapiens
atgagaaactacggcgactgtatctttggccgaggagttttaaatgcgctggaagtgaagggactgtgtcgtcaagggtag

SEQ ID NO: 6005 - protein, 4 aa, homo sapiens
MRWK

SEQ ID NO: 6006 - DNA, 15 bp, homo sapiens
atgcgctggaagtga

SEQ ID NO: 6007 - protein, 13 aa, homo sapiens
MEARSLREKLVRK

SEQ ID NO: 6008 - DNA, 42 bp, homo sapiens
atggaagcccgaagtttgagggagaaacttgtgaggaaataa

SEQ ID NO: 6009 - protein, 18 aa, homo sapiens
MIQMSNCLYLTLFVYLQK

SEQ ID NO: 6010 - DNA, 57 bp, homo sapiens; identical to SEQ ID NO: 5458

SEQ ID NO: 6011 - protein, 4 aa, homo sapiens
MVKL

SEQ ID NO: 6012 - DNA, 15 bp, homo sapiens
atggtgaagttataa

SEQ ID NO: 6013 - protein, 15 aa, homo sapiens
MVQNVRRCYTPSWGR

SEQ ID NO: 6014 - DNA, 48 bp, homo sapiens; identical to SEQ ID NO: 5462

SEQ ID NO: 6015 - protein, 15 aa, homo sapiens
MMLHFGTPFPCSGRM

SEQ ID NO: 6016 - DNA, 48 bp, homo sapiens; identical to SEQ ID NO: 5464

SEQ ID NO: 6017 - protein, 9 aa, homo sapiens
MGEVYKLLC

SEQ ID NO: 6018 - DNA, 30 bp, homo sapiens; identical to SEQ ID NO: 4658

SEQ ID NO: 6019 - protein, 10 aa, homo sapiens
MLISKISAKG

SEQ ID NO: 6020 - DNA, 33 bp, homo sapiens; identical to SEQ ID NO: 4660

SEQ ID NO: 6021 - protein, 10 aa, homo sapiens
MRAAPVTRPS

SEQ ID NO: 6022 - DNA, 33 bp, homo sapiens; identical to SEQ ID NO: 4662

SEQ ID NO: 6023 - protein, 22 aa, homo sapiens
MTQEVEGGTGIGLQRKGQHQPV

SEQ ID NO: 6024 - DNA, 69 bp, homo sapiens; identical to SEQ ID NO: 4664

SEQ ID NO: 6025 - protein, 107 aa, homo sapiens; identical to SEQ ID NO: 4665

SEQ ID NO: 6026 - DNA, 324 bp, homo sapiens; identical to SEQ ID NO: 4666

SEQ ID NO: 6027 - protein, 67 aa, homo sapiens; identical to SEQ ID NO: 4667

SEQ ID NO: 6028 - DNA, 204 bp, homo sapiens; identical to SEQ ID NO: 4668

SEQ ID NO: 6029 - protein, 7 aa, homo sapiens
MFPNKEP

SEQ ID NO: 6030 - DNA, 24 bp, homo sapiens
atgtttccaaacaaagagccctag

SEQ ID NO: 6031 - protein, 40 aa, homo sapiens; identical to SEQ ID NO: 4671

SEQ ID NO: 6032 - DNA, 123 bp, homo sapiens; identical to SEQ ID NO: 4672

SEQ ID NO: 6033 - protein, 87 aa, homo sapiens; identical to SEQ ID NO: 441

SEQ ID NO: 6034 - DNA, 264 bp, homo sapiens; identical to SEQ ID NO: 442

SEQ ID NO: 6035 - protein, 85 aa, homo sapiens [sequence omitted]

SEQ ID NO: 6036 - DNA, 258 bp, homo sapiens; identical to SEQ ID NO: 444

SEQ ID NO: 6037 - protein, 96 aa, homo sapiens; identical to SEQ ID NO: 445

SEQ ID NO: 6038 - DNA, 291 bp, homo sapiens; identical to SEQ ID NO: 446

SEQ ID NO: 6039 - protein, 14 aa, homo sapiens
MTGVGATSLVRFFT

SEQ ID NO: 6040 - DNA, 45 bp, homo sapiens; identical to SEQ ID NO: 448

SEQ ID NO: 6041 - protein, 8 aa, homo sapiens
MVNPILCT

SEQ ID NO: 6042 - DNA, 27 bp, homo sapiens
atggttaatccaattctgtgcacctga

SEQ ID NO: 6043 - protein, 11 aa, homo sapiens
MTERMNGHMND

SEQ ID NO: 6044 - DNA, 36 bp, homo sapiens; identical to SEQ ID NO: 4068

SEQ ID NO: 6045 - protein, 48 aa, homo sapiens [sequence omitted]

SEQ ID NO: 6046 - DNA, 147 bp, homo sapiens; identical to SEQ ID NO: 4070

SEQ ID NO: 6047 - protein, 25 aa, homo sapiens
MKLNESERENKEKPIKKRTNTWVYL

SEQ ID NO: 6048 - DNA, 78 bp, homo sapiens; identical to SEQ ID NO: 4072

SEQ ID NO: 6049 - protein, 8 aa, homo sapiens
MVNPILCT

SEQ ID NO: 6050 - DNA, 27 bp, homo sapiens
atggttaatccaattctgtgcacctga

SEQ ID NO: 6051 - protein, 11 aa, homo sapiens
MTERMNGHMND

SEQ ID NO: 6052 - DNA, 36 bp, homo sapiens; identical to SEQ ID NO: 4068

SEQ ID NO: 6053 - protein, 48 aa, homo sapiens [sequence omitted]

SEQ ID NO: 6054 - DNA, 147 bp, homo sapiens; identical to SEQ ID NO: 4070

SEQ ID NO: 6055 - protein, 25 aa, homo sapiens
MKLNESERENKEKPIKKRTNTWVYL

SEQ ID NO: 6056 - DNA, 78 bp, homo sapiens; identical to SEQ ID NO: 4072

SEQ ID NO: 6057 - protein, 8 aa, homo sapiens
MVNPILCT

SEQ ID NO: 6058 - DNA, 27 bp, homo sapiens
atggttaatccaattctgtgcacctga

SEQ ID NO: 6059 - protein, 11 aa, homo sapiens
MTERMNGHMND

SEQ ID NO: 6060 - DNA, 36 bp, homo sapiens; identical to SEQ ID NO: 4068

SEQ ID NO: 6061 - protein, 48 aa, homo sapiens [sequence omitted]

SEQ ID NO: 6062 - DNA, 147 bp, homo sapiens; identical to SEQ ID NO: 4070

SEQ ID NO: 6063 - protein, 25 aa, homo sapiens
MKLNESERENKEKPIKKRTNTWVYL

SEQ ID NO: 6064 - DNA, 78 bp, homo sapiens; identical to SEQ ID NO: 4072

SEQ ID NO: 6065 - protein, 54 aa, homo sapiens
MLSADWLLLAPPLIPLLAQERGADSPARGRRSGACGGRFLPQMHRSSRYCLWSG

SEQ ID NO: 6066 - DNA, 165 bp, homo sapiens
atgctgagtgctgattggctgctcttggctcctcccctcatcccgcttttggcccaagagcgtggtgcagattcacccgcgcgaggtaggcgctctggtgcttgcggaggacgcttccttcctcagatgcaccgatcttcccgatactgcctttggagcggctag

SEQ ID NO: 6067 - protein, 31 aa, homo sapiens
MNSSSVCTSLSSESSRSSWRSCDGLRPFRVV

SEQ ID NO: 6068 - DNA, 96 bp, homo sapiens
atgaactcttcttctgtctgtacatcgttgtcgtcggagtcgtcgcgatcgtcgtggcgctcgtgtgatggccttcgtccgtttagagtagtgtag

SEQ ID NO: 6069 - protein, 7 aa, homo sapiens
MAFVRLE

SEQ ID NO: 6070 - DNA, 24 bp, homo sapiens
atggccttcgtccgtttagagtag

SEQ ID NO: 6071 - protein, 7 aa, homo sapiens
MLEVVSY

SEQ ID NO: 6072 - DNA, 24 bp, homo sapiens
atgctggaggtggtcagttactaa

SEQ ID NO: 6073 - protein, 21 aa, homo sapiens
MVPWGTPCSGGGRSGGPGGRW

SEQ ID NO: 6074 - DNA, 66 bp, homo sapiens
atggtaccctggggaacaccttgcagcggcggtgggaggagtgggggacctggagggaggtggtga

SEQ ID NO: 6075 - protein, 10 aa, homo sapiens
MVLGDGTPGV

SEQ ID NO: 6076 - DNA, 33 bp, homo sapiens
atggtcctgggggacgggactccaggggtttga

SEQ ID NO: 6077 - protein, 42 aa, homo sapiens
MEWKLERTAPRRVRTEEEMLWVSNTLFCILPNSLMRGRRPRS

SEQ ID NO: 6078 - DNA, 129 bp, homo sapiens
atggagtggaaactggagcgcaccgcgcctcggagggtccgcacggaagaggagatgctgtgggtgagtaacacccttttctgcattctccctaactctctaatgcggggccgaaggccccgttcataa

SEQ ID NO: 6079 - protein, 59 aa, homo sapiens [sequence omitted]

SEQ ID NO: 6080 - DNA, 180 bp, homo sapiens
atgattttcctaaatagtttctccctcaatatgttatctgtgttttcaaaggaaagtatcatgcgtgtgctctccaaagacttgaagcagaagagaagtcaagattccgccaacgtgagtccagggcttgttcttgttctctgttttaattctgatcttgaacaaacgaattcttggtaa

SEQ ID NO: 6081 - protein, 21 aa, homo sapiens
MVPWGTPCSGGGRSGGPGGRW

SEQ ID NO: 6082 - DNA, 66 bp, homo sapiens; identical to SEQ ID NO: 6074

SEQ ID NO: 6083 - protein, 10 aa, homo sapiens
MVLGDGTPGV

SEQ ID NO: 6084 - DNA, 33 bp, homo sapiens; identical to SEQ ID NO: 6076

SEQ ID NO: 6085 - protein, 42 aa, homo sapiens; identical to SEQ ID NO: 6077

SEQ ID NO: 6086 - DNA, 129 bp, homo sapiens; identical to SEQ ID NO: 6078

SEQ ID NO: 6087 - protein, 59 aa, homo sapiens [sequence omitted]

SEQ ID NO: 6088 - DNA, 180 bp, homo sapiens; identical to SEQ ID NO: 6080

SEQ ID NO: 6089 - protein, 18 aa, homo sapiens
MIQMSNCLYLTLFVYLQK

SEQ ID NO: 6090 - DNA, 57 bp, homo sapiens; identical to SEQ ID NO: 5458

SEQ ID NO: 6091 - protein, 4 aa, homo sapiens
MVKL

SEQ ID NO: 6092 - DNA, 15 bp, homo sapiens
atggtgaagttataa

SEQ ID NO: 6093 - protein, 15 aa, homo sapiens
MVQNVRRCYTPSWGR

SEQ ID NO: 6094 - DNA, 48 bp, homo sapiens; identical to SEQ ID NO: 5462

SEQ ID NO: 6095 - protein, 15 aa, homo sapiens
MMLHFGTPFPCSGRM

SEQ ID NO: 6096 - DNA, 48 bp, homo sapiens; identical to SEQ ID NO: 5464

SEQ ID NO: 6097 - protein, 18 aa, homo sapiens
MIQMSNCLYLTLFVYLQK

SEQ ID NO: 6098 - DNA, 57 bp, homo sapiens; identical to SEQ ID NO: 5458

SEQ ID NO: 6099 - protein, 4 aa, homo sapiens
MVKL

SEQ ID NO: 6100 - DNA, 15 bp, homo sapiens
atggtgaagttataa

SEQ ID NO: 6101 - protein, 15 aa, homo sapiens
MVQNVRRCYTPSWGR

SEQ ID NO: 6102 - DNA, 48 bp, homo sapiens; identical to SEQ ID NO: 5462

SEQ ID NO: 6103 - protein, 15 aa, homo sapiens
MMLHFGTPFPCSGRM

SEQ ID NO: 6104 - DNA, 48 bp, homo sapiens; identical to SEQ ID NO: 5464

SEQ ID NO: 6105 - protein, 18 aa, homo sapiens
MIQMSNCLYLTLFVYLQK

SEQ ID NO: 6106 - DNA, 57 bp, homo sapiens; identical to SEQ ID NO: 5458

SEQ ID NO: 6107 - protein, 4 aa, homo sapiens
MVKL

SEQ ID NO: 6108 - DNA, 15 bp, homo sapiens
atggtgaagttataa

SEQ ID NO: 6109 - protein, 15 aa, homo sapiens
MVQNVRRCYTPSWGR

SEQ ID NO: 6110 - DNA, 48 bp, homo sapiens; identical to SEQ ID NO: 5462

SEQ ID NO: 6111 - protein, 15 aa, homo sapiens
MMLHFGTPFPCSGRM

SEQ ID NO: 6112 - DNA, 48 bp, homo sapiens; identical to SEQ ID NO: 5464

SEQ ID NO: 6113 - protein, 31 aa, homo sapiens; identical to SEQ ID NO: 4249

SEQ ID NO: 6114 - DNA, 96 bp, homo sapiens; identical to SEQ ID NO: 4250

SEQ ID NO: 6115 - protein, 20 aa, homo sapiens
MLPLAKAQLELWQPAPQAKE

SEQ ID NO: 6116 - DNA, 63 bp, homo sapiens; identical to SEQ ID NO: 4252

SEQ ID NO: 6117 - protein, 69 aa, homo sapiens; identical to SEQ ID NO: 4253

SEQ ID NO: 6118 - DNA, 210 bp, homo sapiens; identical to SEQ ID NO: 4254

SEQ ID NO: 6119 - protein, 7 aa, homo sapiens
MAKPHLY

SEQ ID NO: 6120 - DNA, 24 bp, homo sapiens
atggcgaaaccccatctctactaa

SEQ ID NO: 6121 - protein, 19 aa, homo sapiens
MLSKVLPVLLGILLILQSR

SEQ ID NO: 6122 - DNA, 60 bp, homo sapiens; identical to SEQ ID NO: 5106

SEQ ID NO: 6123 - protein, 17 aa, homo sapiens
MRAGLGPPHCRMGSRGP

SEQ ID NO: 6124 - DNA, 54 bp, homo sapiens; identical to SEQ ID NO: 5108

SEQ ID NO: 6125 - protein, 65 aa, homo sapiens; identical to SEQ ID NO: 5109

SEQ ID NO: 6126 - DNA, 198 bp, homo sapiens; identical to SEQ ID NO: 5110

SEQ ID NO: 6127 - protein, 17 aa, homo sapiens
MPLLLLVPVSGTSFGLV

SEQ ID NO: 6128 - DNA, 54 bp, homo sapiens; identical to SEQ ID NO: 5112

SEQ ID NO: 6129 - protein, 22 aa, homo sapiens
MDQGVEGGGCGPGVGRQSACSL

SEQ ID NO: 6130 - DNA, 69 bp, homo sapiens; identical to SEQ ID NO: 4146

SEQ ID NO: 6131 - protein, 28 aa, homo sapiens
MKDGKEGYRDRGRVGLRIARAAWHTVLG

SEQ ID NO: 6132 - DNA, 87 bp, homo sapiens; identical to SEQ ID NO: 4148

SEQ ID NO: 6133 - protein, 41 aa, homo sapiens; identical to SEQ ID NO: 4149

SEQ ID NO: 6134 - DNA, 126 bp, homo sapiens; identical to SEQ ID NO: 4150

SEQ ID NO: 6135 - protein, 16 aa, homo sapiens
MILFPLDPAPLVPFSL

SEQ ID NO: 6136 - DNA, 51 bp, homo sapiens; identical to SEQ ID NO: 4152

SEQ ID NO: 6137 - protein, 51 aa, homo sapiens; identical to SEQ ID NO: 5321

SEQ ID NO: 6138 - DNA, 156 bp, homo sapiens; identical to SEQ ID NO: 5322

SEQ ID NO: 6139 - protein, 5 aa, homo sapiens
MSARC

SEQ ID NO: 6140 - DNA, 18 bp, homo sapiens
atgagtgcgagatgttga

SEQ ID NO: 6141 - protein, 15 aa, homo sapiens
MEAEVDKLELMVSAK

SEQ ID NO: 6142 - DNA, 48 bp, homo sapiens; identical to SEQ ID NO: 5326

SEQ ID NO: 6143 - protein, 43 aa, homo sapiens; identical to SEQ ID NO: 5327

SEQ ID NO: 6144 - DNA, 132 bp, homo sapiens; identical to SEQ ID NO: 5328

SEQ ID NO: 6145 - protein, 40 aa, homo sapiens
MGNHCYPLDNNYCLVGNHCYLLENKYCLMGKHCYLLDNKY

SEQ ID NO: 6146 - DNA, 123 bp, homo sapiens
atgggtaaccactgttacccactggataataattattgccttgtgggtaaccactgttacctgctggaaaataaatattgcctcatgggtaaacactgttacctgctggataataagtattga

SEQ ID NO: 6147 - protein, 19 aa, homo sapiens
MGNTCYPVDNKYGLMGNHC

SEQ ID NO: 6148 - DNA, 60 bp, homo sapiens
atgggtaacacctgttaccctgtggataataagtatggcctcatgggtaaccactgttaa

SEQ ID NO: 6149 - protein, 101 aa, homo sapiens
MASWVTTVNRWIISTGSWVTTVTQWIISIPSWVTTVTWWIISTASSVTTVTRWIINIASWVATVTQWIISIASWVTTITWWIISVASWLTTVIQWIISVAS

SEQ ID NO: 6150 - DNA, 306 bp, homo sapiens
atggcctcatgggtaaccactgttaaccggtggataataagtactggctcatgggtaaccactgttacccagtggataataagtattccttcatgggtaaccactgttacctggtggataataagtactgcctcatcagtaaccactgttactcggtggataataaatattgcctcatgggtagccactgttacccagtggataataagtattgcctcgtgggtaaccactattacctggtggataataagtgttgcctcctggttaaccactgttatccagtggataataagtgttgcctcgtga

SEQ ID NO: 6151 - protein, 223 aa, homo sapiens [sequence omitted]

SEQ ID NO: 6152 - DNA, 672 bp, homo sapiens
atgggtaaccactgttacccagtggataataagtattccttcatgggtaaccactgttacctggtggataataagtactgcctcatcagtaaccactgttactcggtggataataaatattgcctcatgggtagccactgttacccagtggataataagtattgcctcgtgggtaaccactattacctggtggataataagtgttgcctcctggttaaccactgttatccagtggataataagtgttgcctcgtgagtaatcactgttacctgctggataataattgttgcctcatggggaaccactgttacccaatgcatcataagtgttgcctcgtgggtaaccactgttaccaagtggataataagtatttcttgtgggtaaccactgttacccggtgtataataagtgttgccttctgcgtaaccactgttacccagtggacaataagtattgcctcatggataaccactgttaccaagtggaaaataattattgcctcatgggtaaccactgttaccctgtggataataggtattgcctcgtgggtaaccactgctacccggtgggtaataagcattacctcgtgggtaaacactgttacccagtggataataagtgttgcctcgtgggtaaccagtgttacccggtggataataaatgttgcctag

SEQ ID NO: 6153 - protein, 15 aa, homo sapiens
MCDSCLAGPGLRGAG

SEQ ID NO: 6154 - DNA, 48 bp, homo sapiens
atgtgtgattcgtgccttgcgggccctggcctccggggtgctgggtaa

SEQ ID NO: 6155 - protein, 63 aa, homo sapiens
MLTRCQRDRERKTGVGGARMERGRVGRSHGRRHIRDISPTPPLALSATFPNRSPGRGGEGLLV

SEQ ID NO: 6156 - DNA, 192 bp, homo sapiens
atgttgacgcggtgccagcgagaccgcgagaggaagacgggggtgggcggggccaggatggagaggggccgagttggcaggagtcatggcagacgccacattcgcgacatctcccccacaccccctctggctctgtccgcaacatttccaaacaggagtcccgggagagggggagaggggctgctggtctga

SEQ ID NO: 6157 - protein, 155 aa, homo sapiens [sequence omitted]

SEQ ID NO: 6158 - DNA, 468 bp, homo sapiens
atggcagacgccacattcgcgacatctcccccacaccccctctggctctgtccgcaacatttccaaacaggagtcccgggagagggggagaggggctgctggtctgaggctaagaagggcagagccttcgacccggagagaggccgcggcccctgcccagtgggcagcgtggaagtttccatacaaggaggtgggaaggagacccccccccccttcactgccctgtgcagagatgagccgggggtgcaggatgggagcccatggcacttcgctacgggatggtccagggctcccggttgggggtgcaggagagaagagactggctgggaggagggagagggcgggagcaaaggcgcgggggagtggtcagcagggagaggggtggggggtagggtggagcccgggctgggaggagtcggctcacacataaaagctgaggcactgaccagcctgcaaactggacattag

SEQ ID NO: 6159 - protein, 65 aa, homo sapiens
MSRGCRMGAHGTSLRDGPGLPVGGAGEKRLAGRRERAGAKARGSGQQGEGWGVGWSPGWEESAHT

SEQ ID NO: 6160 - DNA, 198 bp, homo sapiens
atgagccgggggtgcaggatgggagcccatggcacttcgctacgggatggtccagggctcccggttgggggtgcaggagagaagagactggctgggaggagggagagggcgggagcaaaggcgcgggggagtggtcagcagggagaggggtggggggtagggtggagcccgggctgggaggagtcggctcacacataa

SEQ ID NO: 6161 - protein, 121 aa, homo sapiens [sequence omitted]

SEQ ID NO: 6162 - DNA, 366 bp, homo sapiens
atggcggagcgaggggggcgaggggggccaggggggcgcgagattccgccggcggccccttccccttggctaggcttaggcggcggggggctggcggggtgcgggattttgtgcgtggtttttgacttggtaaaaatcacagtgctttcttacatcgttcaaactctccaggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcaggtaggatttgagctgtgtttcccgccctga

SEQ ID NO: 6163 - protein, 111 aa, homo sapiens
MGPLNSLERAFSMALALCGSLPPTQPRPRAPPSPCDRRPPPGAPGPPARTPRPALGSGCGGGPGAGRGLRGRPLARARGQRGPRGPWAAGWRDYKSRAWAPAVRLLSGGAA

SEQ ID NO: 6164 - DNA, 336 bp, homo sapiens
atggggcccctgaattctctagaacgggcattcagcatggccttggcgctctgcggctccctgccccccacccagcctcgcccccgcgcaccccccagcccctgcgaccgccgccccccccccggggccccagggcccccagcccgcaccccccgccccgctcttggctcgggttgcgggggcgggccgggggcggggcgagggctccgcgggcgcccattggcgcgggcgcgaggccagcgaggcccgcgcgggccctgggccgcgggctggcgcgactataagagccgggcgtgggcgcccgcagttcgcctgctctccggcggagctgcgtga

SEQ ID NO: 6165 - protein, 15 aa, homo sapiens
MCDSCLAGPGLRGAG

SEQ ID NO: 6166 - DNA, 48 bp, homo sapiens; identical to SEQ ID NO: 6154

SEQ ID NO: 6167 - protein, 63 aa, homo sapiens; identical to SEQ ID NO: 6155

SEQ ID NO: 6168 - DNA, 192 bp, homo sapiens; identical to SEQ ID NO: 6156

SEQ ID NO: 6169 - protein, 79 aa, homo sapiens [sequence omitted]

SEQ ID NO: 6170 - DNA, 240 bp, homo sapiens
atgggacagggctcaggcttggggtgtatggggaggggggctttgcttttaaaagaggtcatctcagcaatatctttttgtttttccccaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtga

SEQ ID NO: 6171 - protein, 74 aa, homo sapiens [sequence omitted]

SEQ ID NO: 6172 - DNA, 225 bp, homo sapiens
atggggggcagaaagtgggtagagagggaaaaagggaaaatatcattggggaagaacctaaaaacccaaggaaagctgggctctgctgggggctgtgagacccccgggttctccccgccccaggctgctggccatggggtcttgcaccaatggcctgacctttctgtcggtctgtatttatcaaagtgggtgacagtctcaggcctcctggctgttcagaattga

SEQ ID NO: 6173 - protein, 19 aa, homo sapiens
MGSCTNGLTFLSVCIYQSG

SEQ ID NO: 6174 - DNA, 60 bp, homo sapiens
atggggtcttgcaccaatggcctgacctttctgtcggtctgtatttatcaaagtgggtga

SEQ ID NO: 6175 - protein, 24 aa, homo sapiens
MDWSPCTCPTTGPAGRDPAGDSSG

SEQ ID NO: 6176 - DNA, 75 bp, homo sapiens
atggattggagtccctgtacctgccccacgacagggcctgcagggagggatccagcaggtgactcttcaggctga

SEQ ID NO: 6177 - protein, 4 aa, homo sapiens
MRRA

SEQ ID NO: 6178 - DNA, 15 bp, homo sapiens
atgaggagagcatag

SEQ ID NO: 6179 - protein, 19 aa, homo sapiens
MGVIIIETTLQGRCLDYMR

SEQ ID NO: 6180 - DNA, 60 bp, homo sapiens
atgggtgtgataataatagaaaccaccttacaaggccgttgtttggattacatgaggtaa

SEQ ID NO: 6181 - protein, 4 aa, homo sapiens
MLFP

SEQ ID NO: 6182 - DNA, 15 bp, homo sapiens
atgttgtttccttag

SEQ ID NO: 6183 - protein, 26 aa, homo sapiens
MTAETMFSYPLFQLLSLVQCLAYFNK

SEQ ID NO: 6184 - DNA, 81 bp, homo sapiens
atgacagcagagactatgttttcttatccactattccaactcctgtccttagtacaatgcctggcatattttaataaataa

SEQ ID NO: 6185 - protein, 22 aa, homo sapiens
MDQGVEGGGCGPGVGRQSACSL

SEQ ID NO: 6186 - DNA, 69 bp, homo sapiens; identical to SEQ ID NO: 4146

SEQ ID NO: 6187 - protein, 28 aa, homo sapiens
MKDGKEGYRDRGRVGLRIARAAWHTVLG

SEQ ID NO: 6188 - DNA, 87 bp, homo sapiens; identical to SEQ ID NO: 4148

SEQ ID NO: 6189 - protein, 41 aa, homo sapiens; identical to SEQ ID NO: 4149

SEQ ID NO: 6190 - DNA, 126 bp, homo sapiens; identical to SEQ ID NO: 4150

SEQ ID NO: 6191 - protein, 16 aa, homo sapiens
MILFPLDPAPLVPFSL

SEQ ID NO: 6192 - DNA, 51 bp, homo sapiens; identical to SEQ ID NO: 4152

SEQ ID NO: 6193 - protein, 56 aa, homo sapiens
MPYSVGFREVSTGRLLGWTGRCQEGATQAAPVGSTRARAALHTPPASPPRGLPALA

SEQ ID NO: 6194 - DNA, 171 bp, homo sapiens
atgccctattctgtgggcttccgcgaagtgagtactgggcggctgctcgggtggacggggagatgtcaggagggggccacccaggccgcgccagtaggcagcacgcgagcaagagcagctttgcacaccccacccgcctcgcctccccgtgggctccctgccttagcatag

SEQ ID NO: 6195 - protein, 43 aa, homo sapiens
MSGGGHPGRASRQHASKSSFAHPTRLASPWAPCLSIAAHRPCS

SEQ ID NO: 6196 - DNA, 132 bp, homo sapiens
atgtcaggagggggccacccaggccgcgccagtaggcagcacgcgagcaagagcagctttgcacaccccacccgcctcgcctccccgtgggctccctgccttagcatagcggcacatcgaccttgtagctga

SEQ ID NO: 6197 - protein, 5 aa, homo sapiens
MSCQQ

SEQ ID NO: 6198 - DNA, 18 bp, homo sapiens
atgtcctgtcagcaatag

SEQ ID NO: 6199 - protein, 5 aa, homo sapiens
MVFGL

SEQ ID NO: 6200 - DNA, 18 bp, homo sapiens
atggtttttggattatag

SEQ ID NO: 6201 - protein, 22 aa, homo sapiens
MDQGVEGGGCGPGVGRQSACSL

SEQ ID NO: 6202 - DNA, 69 bp, homo sapiens; identical to SEQ ID NO: 4146

SEQ ID NO: 6203 - protein, 28 aa, homo sapiens
MKDGKEGYRDRGRVGLRIARAAWHTVLG

SEQ ID NO: 6204 - DNA, 87 bp, homo sapiens; identical to SEQ ID NO: 4148

SEQ ID NO: 6205 - protein, 41 aa, homo sapiens; identical to SEQ ID NO: 4149

SEQ ID NO: 6206 - DNA, 126 bp, homo sapiens; identical to SEQ ID NO: 4150

SEQ ID NO: 6207 - protein, 16 aa, homo sapiens
MILFPLDPAPLVPFSL

SEQ ID NO: 6208 - DNA, 51 bp, homo sapiens; identical to SEQ ID NO: 4152

SEQ ID NO: 6209 - protein, 22 aa, homo sapiens
MDQGVEGGGCGPGVGRQSACSL

SEQ ID NO: 6210 - DNA, 69 bp, homo sapiens; identical to SEQ ID NO: 4146

SEQ ID NO: 6211 - protein, 28 aa, homo sapiens
MKDGKEGYRDRGRVGLRIARAAWHTVLG

SEQ ID NO: 6212 - DNA, 87 bp, homo sapiens; identical to SEQ ID NO: 4148

SEQ ID NO: 6213 - protein, 41 aa, homo sapiens; identical to SEQ ID NO: 4149

SEQ ID NO: 6214 - DNA, 126 bp, homo sapiens; identical to SEQ ID NO: 4150

SEQ ID NO: 6215 - protein, 16 aa, homo sapiens
MILFPLDPAPLVPFSL

SEQ ID NO: 6216 - DNA, 51 bp, homo sapiens; identical to SEQ ID NO: 4152

SEQ ID NO: 6217 - protein, 5 aa, homo sapiens
MGAEA

SEQ ID NO: 6218 - DNA, 18 bp, homo sapiens
atgggcgctgaagcttga

SEQ ID NO: 6219 - protein, 4 aa, homo sapiens
MSGT

SEQ ID NO: 6220 - DNA, 15 bp, homo sapiens
atgagcgggacttaa

SEQ ID NO: 6221 - protein, 19 aa, homo sapiens
MFNSAGAIGTLLFDYRNVV

SEQ ID NO: 6222 - DNA, 60 bp, homo sapiens
atgtttaacagtgcaggtgctataggcaccttgctttttgattatagaaatgtggtttga

SEQ ID NO: 6223 - protein, 17 aa, homo sapiens
MWFDCGACGSHVGSARS

SEQ ID NO: 6224 - DNA, 54 bp, homo sapiens
atgtggtttgattgcggtgcttgtggttctcatgtagggtcagctaggtcttag

SEQ ID NO: 6225 - protein, 86 aa, homo sapiens
MFSPEIVRPLQLIEHTRTNTDTLSCCTKGARAQRPRERARAHTHTHTHTQTHTHSHTPGCGLARAWKSQISPGNRRGTRIGVASQN

SEQ ID NO: 6226 - DNA, 261 bp, homo sapiens
atgttctctccagaaattgtccgcccattgcagctaatcgaacacacacgcacgaatacagacacgctctcctgctgtactaaaggcgccagggcgcaaagacctagggagcgcgcgcgggcacacacacacacacacacacacacacagacacacacacactcacacactccaggctgcgggttggccagagcctggaaatcgcagatttcaccaggaaatcgccgaggtacccgaataggtgttgcctcccaaaactaa

SEQ ID NO: 6227 - protein, 26 aa, homo sapiens
MNPAQLAEASRSPFYFGLQALRESQV

SEQ ID NO: 6228 - DNA, 81 bp, homo sapiens
atgaatccagcccagctcgccgaggcatccaggtctccattctattttggtctccaggctcttcgtgaaagccaggtttga

SEQ ID NO: 6229 - protein, 135 aa, homo sapiens
MAGLKGRGKRGTARGEVPLRFRRSLSPAECGESSLGAALSRRRSLFQPPIPSTVADPPPATHSRCSHGQDKESFVPPAPRVPSCWGLTASSVRVGWRPGSLGLRAVPRLRFRSSPWALERFPIAVSRSWPRRRSN

SEQ ID NO: 6230 - DNA, 408 bp, homo sapiens
atggcgggtctgaaaggaaggggcaaacgaggcacagcgcgaggcgaggtacccctacgattccgacggtcactgagtccagccgaatgtggcgaaagcagcctgggagctgcgctgtcccggcgtcgctccctattccagccccccattccctctactgttgctgacccccctcccgccacccactccagatgcagccatggacaagacaaggagagcttcgtccctcccgcccctcgggttccttcctgctggggtctgaccgcgtcttctgtgcgtgtgggatggaggcccggctcgctcgggctccgagctgtcccccggctccgctttcggagcagcccttgggcgctggagaggtttcccattgcggtctccaggtcatggccaaggaggagaagcaattag

SEQ ID NO: 6231 - protein, 26 aa, homo sapiens
MWRKQPGSCAVPASLPIPAPHSLYCC

SEQ ID NO: 6232 - DNA, 81 bp, homo sapiens
atgtggcgaaagcagcctgggagctgcgctgtcccggcgtcgctccctattccagccccccattccctctactgttgctga

SEQ ID NO: 6233 - protein, 24 aa, homo sapiens
MAGAPPAASLPPCRLISDCCASNQ

SEQ ID NO: 6234 - DNA, 75 bp, homo sapiens
atggcgggcgcccctcccgcagcctcgctgccgccttgcaggttgatctcagactgctgtgctagcaatcagtga

SEQ ID NO: 6235 - protein, 64 aa, homo sapiens
MPRPASARARCMHPLTCAHCLALPSEMNSVSQMEMQKSPSSPSLTLGAVDRSCSYSAIFAPPCN

SEQ ID NO: 6236 - DNA, 195 bp, homo sapiens
atgcctcgccctgcttcggctcgcgcacggtgcatgcacccactgacctgcgcccactgtctggcactccctagtgagatgaactcggtatctcagatggaaatgcagaaatcaccgtcttctccatcgctcacgctgggagctgtagaccggagctgttcctattcggccatctttgctcctccctgcaactaa

SEQ ID NO: 6237 - protein, 25 aa, homo sapiens
MLKFQPLVPQNVTVFGNRAFKEVIK

SEQ ID NO: 6238 - DNA, 78 bp, homo sapiens
atgctgaagttccaacccctagtacctcagaatgtgactgtatttggaaatagggcctttaaagaggtgattaagtga

SEQ ID NO: 6239 - protein, 7 aa, homo sapiens
MAKPHFY

SEQ ID NO: 6240 - DNA, 24 bp, homo sapiens
atggcaaaaccccatttctactaa

SEQ ID NO: 6241 - protein, 64 aa, homo sapiens; identical to SEQ ID NO: 6235

SEQ ID NO: 6242 - DNA, 195 bp, homo sapiens; identical to SEQ ID NO: 6236

SEQ ID NO: 6243 - protein, 25 aa, homo sapiens
MLKFQPLVPQNVTVFGNRAFKEVIK

SEQ ID NO: 6244 - DNA, 78 bp, homo sapiens; identical to SEQ ID NO: 6238

SEQ ID NO: 6245 - protein, 7 aa, homo sapiens
MAKPHFY

SEQ ID NO: 6246 - DNA, 24 bp, homo sapiens
atggcaaaaccccatttctactaa

SEQ ID NO: 6247 - protein, 25 aa, homo sapiens
MAPLPSSLGNRVRLCSPPPAPHKKI

SEQ ID NO: 6248 - DNA, 78 bp, homo sapiens
atggcaccactgccctccagcctagggaacagagtgagactctgctcccctccccccgccccacacaaaaaaatttaa

SEQ ID NO: 6249 - protein, 29 aa, homo sapiens
MQPIGSLLQSPPPGVRGGGAGHVRQPALG

SEQ ID NO: 6250 - DNA, 90 bp, homo sapiens
atgcagcccattggctctctcctgcagtccccgcccccgggcgttcgaggcggcggggcgggccacgtcaggcagccggcgctgggctga

SEQ ID NO: 6251 - protein, 4 aa, homo sapiens
MEGG

SEQ ID NO: 6252 - DNA, 15 bp, homo sapiens
atggagggcggctga

SEQ ID NO: 6253 - protein, 49 aa, homo sapiens
MWRQGRVAARGSREGAFCPRPVLLGLSASGGLGLLRLRSSEIPGQGWLW

SEQ ID NO: 6254 - DNA, 150 bp, homo sapiens
atgtggcggcagggccgcgtcgcggcgaggggcagccgggagggggctttttgccctcgtccggtcctgctggggctctcagcttctggaggactaggccttctgaggttacggagctccgagatacctgggcagggctggctgtggtga

SEQ ID NO: 6255 - protein, 10 aa, homo sapiens
MSTYNAKAYG

SEQ ID NO: 6256 - DNA, 33 bp, homo sapiens
atgtccacttataatgcaaaggcttatgggtga

SEQ ID NO: 6257 - protein, 132 aa, homo sapiens [sequence omitted]

SEQ ID NO: 6258 - DNA, 399 bp, homo sapiens
atggaaaagtgggatattgtggaagaccaaggagatcatgtatttgaagtgcttcatgttgcctggtgtacagtaagcactcagtacacattaactattattgtgactgcattcttcctttcacctatgttctttttacctccttacagaggaataatccacaaatatactatggttcctttcaggcagcacccctcccaagtcgacggaagcagttggcctatgcacaaatcatatatcctgatgttctctttcgaaggaatgaaaagtcctcattctgattcacagtacagtgattcatggttctcttcctcttctcttgtcaccctcctcccctccactgaaaacatgaaaacacaattaagaaaccacagggctgaaagctgcagactcttctaa

SEQ ID NO: 6259 - protein, 12 aa, homo sapiens
MYLKCFMLPGVQ

SEQ ID NO: 6260 - DNA, 39 bp, homo sapiens
atgtatttgaagtgcttcatgttgcctggtgtacagtaa

SEQ ID NO: 6261 - protein, 14 aa, homo sapiens
MVLFLFSCHPPPLH

SEQ ID NO: 6262 - DNA, 45 bp, homo sapiens
atggttctcttcctcttctcttgtcaccctcctcccctccactga

SEQ ID NO: 6263 - protein, 11 aa, homo sapiens
MPAEGLKQNTP

SEQ ID NO: 6264 - DNA, 36 bp, homo sapiens
atgccggcagagggtctgaagcaaaatacaccctga

SEQ ID NO: 6265 - protein, 8 aa, homo sapiens
MVNPILCT

SEQ ID NO: 6266 - DNA, 27 bp, homo sapiens
atggttaatccaattctgtgcacctga

SEQ ID NO: 6267 - protein, 11 aa, homo sapiens
MTERMNGHMND

SEQ ID NO: 6268 - DNA, 36 bp, homo sapiens; identical to SEQ ID NO: 4068

SEQ ID NO: 6269 - protein, 48 aa, homo sapiens [sequence omitted]

SEQ ID NO: 6270 - DNA, 147 bp, homo sapiens; identical to SEQ ID NO: 4070

SEQ ID NO: 6271 - protein, 25 aa, homo sapiens
MKLNESERENKEKPIKKRTNTWVYL

SEQ ID NO: 6272 - DNA, 78 bp, homo sapiens; identical to SEQ ID NO: 4072

SEQ ID NO: 6273 - protein, 22 aa, homo sapiens
MDQGVEGGGCGPGVGRQSACSL

SEQ ID NO: 6274 - DNA, 69 bp, homo sapiens; identical to SEQ ID NO: 4146

SEQ ID NO: 6275 - protein, 28 aa, homo sapiens
MKDGKEGYRDRGRVGLRIARAAWHTVLG

SEQ ID NO: 6276 - DNA, 87 bp, homo sapiens; identical to SEQ ID NO: 4148

SEQ ID NO: 6277 - protein, 41 aa, homo sapiens; identical to SEQ ID NO: 4149

SEQ ID NO: 6278 - DNA, 126 bp, homo sapiens; identical to SEQ ID NO: 4150

SEQ ID NO: 6279 - protein, 16 aa, homo sapiens
MILFPLDPAPLVPFSL

SEQ ID NO: 6280 - DNA, 51 bp, homo sapiens; identical to SEQ ID NO: 4152

SEQ ID NO: 6281 - protein, 22 aa, homo sapiens
MDQGVEGGGCGPGVGRQSACSL

SEQ ID NO: 6282 - DNA, 69 bp, homo sapiens; identical to SEQ ID NO: 4146

SEQ ID NO: 6283 - protein, 28 aa, homo sapiens
MKDGKEGYRDRGRVGLRIARAAWHTVLG

SEQ ID NO: 6284 - DNA, 87 bp, homo sapiens; identical to SEQ ID NO: 4148

SEQ ID NO: 6285 - protein, 41 aa, homo sapiens; identical to SEQ ID NO: 4149

SEQ ID NO: 6286 - DNA, 126 bp, homo sapiens; identical to SEQ ID NO: 4150

SEQ ID NO: 6287 - protein, 16 aa, homo sapiens
MILFPLDPAPLVPFSL

SEQ ID NO: 6288 - DNA, 51 bp, homo sapiens; identical to SEQ ID NO: 4152

SEQ ID NO: 6289 - protein, 22 aa, homo sapiens
MDQGVEGGGCGPGVGRQSACSL

SEQ ID NO: 6290 - DNA, 69 bp, homo sapiens; identical to SEQ ID NO: 4146

SEQ ID NO: 6291 - protein, 28 aa, homo sapiens
MKDGKEGYRDRGRVGLRIARAAWHTVLG

SEQ ID NO: 6292 - DNA, 87 bp, homo sapiens; identical to SEQ ID NO: 4148

SEQ ID NO: 6293 - protein, 41 aa, homo sapiens; identical to SEQ ID NO: 4149

SEQ ID NO: 6294 - DNA, 126 bp, homo sapiens; identical to SEQ ID NO: 4150

SEQ ID NO: 6295 - protein, 16 aa, homo sapiens
MILFPLDPAPLVPFSL

SEQ ID NO: 6296 - DNA, 51 bp, homo sapiens; identical to SEQ ID NO: 4152

SEQ ID NO: 6297 - protein, 21 aa, homo sapiens
MGWDGFWGGVPNSDWEWRNPS

SEQ ID NO: 6298 - DNA, 66 bp, homo sapiens; identical to SEQ ID NO: 4722

SEQ ID NO: 6299 - protein, 13 aa, homo sapiens
MRLGRLLSPAPQM

SEQ ID NO: 6300 - DNA, 42 bp, homo sapiens; identical to SEQ ID NO: 4724

SEQ ID NO: 6301 - protein, 59 aa, homo sapiens [sequence omitted]

SEQ ID NO: 6302 - DNA, 180 bp, homo sapiens; identical to SEQ ID NO: 4726

SEQ ID NO: 6303 - protein, 32 aa, homo sapiens; identical to SEQ ID NO: 4727

SEQ ID NO: 6304 - DNA, 99 bp, homo sapiens; identical to SEQ ID NO: 4728

SEQ ID NO: 6305 - protein, 4 aa, homo sapiens
MSIR

SEQ ID NO: 6306 - DNA, 15 bp, homo sapiens
atgtcaatcagatga

SEQ ID NO: 6307 - protein, 361 aa, homo sapiens [sequence omitted]

SEQ ID NO: 6308 - DNA, 1086 bp, homo sapiens
atgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttga

SEQ ID NO: 6309 - protein, 292 aa, homo sapiens [sequence omitted]

SEQ ID NO: 6310 - DNA, 879 bp, homo sapiens
atgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtga

SEQ ID NO: 6311 - protein, 8 aa, homo sapiens
MGLKPRYS

SEQ ID NO: 6312 - DNA, 27 bp, homo sapiens
atggggctcaagcctcgttattcataa

SEQ ID NO: 6313 - protein, 15 aa, homo sapiens
MPPCLANFCLFVCLL

SEQ ID NO: 6314 - DNA, 48 bp, homo sapiens
atgccaccatgcctggctaatttttgtttgtttgtttgtttgttgtag

SEQ ID NO: 6315 - protein, 7 aa, homo sapiens
MCCPGWS

SEQ ID NO: 6316 - DNA, 24 bp, homo sapiens
atgtgttgcccaggctggtcttga

SEQ ID NO: 6317 - protein, 14 aa, homo sapiens
MCPPGPPKVLELQT

SEQ ID NO: 6318 - DNA, 45 bp, homo sapiens
atgtgtccgcctgggcctcccaaagtgctggaattacagacatga

SEQ ID NO: 6319 - protein, 5 aa, homo sapiens
MRYCA

SEQ ID NO: 6320 - DNA, 18 bp, homo sapiens
atgaggtactgtgcctga

SEQ ID NO: 6321 - protein, 16 aa, homo sapiens
MSRAPASLPLLPGWAV

SEQ ID NO: 6322 - DNA, 51 bp, homo sapiens; identical to SEQ ID NO: 4618

SEQ ID NO: 6323 - protein, 41 aa, homo sapiens; identical to SEQ ID NO: 4619

SEQ ID NO: 6324 - DNA, 126 bp, homo sapiens; identical to SEQ ID NO: 4620

SEQ ID NO: 6325 - protein, 13 aa, homo sapiens
MGLPRARRWQPGA

SEQ ID NO: 6326 - DNA, 42 bp, homo sapiens; identical to SEQ ID NO: 4622

SEQ ID NO: 6327 - protein, 36 aa, homo sapiens; identical to SEQ ID NO: 4623

SEQ ID NO: 6328 - DNA, 111 bp, homo sapiens; identical to SEQ ID NO: 4624

SEQ ID NO: 6329 - protein, 16 aa, homo sapiens
MSRAPASLPLLPGWAV

SEQ ID NO: 6330 - DNA, 51 bp, homo sapiens; identical to SEQ ID NO: 4618

SEQ ID NO: 6331 - protein, 41 aa, homo sapiens; identical to SEQ ID NO: 4619

SEQ ID NO: 6332 - DNA, 126 bp, homo sapiens; identical to SEQ ID NO: 4620

SEQ ID NO: 6333 - protein, 13 aa, homo sapiens
MGLPRARRWQPGA

SEQ ID NO: 6334 - DNA, 42 bp, homo sapiens; identical to SEQ ID NO: 4622

SEQ ID NO: 6335 - protein, 36 aa, homo sapiens; identical to SEQ ID NO: 4623

SEQ ID NO: 6336 - DNA, 111 bp, homo sapiens; identical to SEQ ID NO: 4624

SEQ ID NO: 6337 - protein, 16 aa, homo sapiens
MSRAPASLPLLPGWAV

SEQ ID NO: 6338 - DNA, 51 bp, homo sapiens; identical to SEQ ID NO: 4618

SEQ ID NO: 6339 - protein, 41 aa, homo sapiens; identical to SEQ ID NO: 4619

SEQ ID NO: 6340 - DNA, 126 bp, homo sapiens; identical to SEQ ID NO: 4620

SEQ ID NO: 6341 - protein, 13 aa, homo sapiens
MGLPRARRWQPGA

SEQ ID NO: 6342 - DNA, 42 bp, homo sapiens; identical to SEQ ID NO: 4622

SEQ ID NO: 6343 - protein, 36 aa, homo sapiens; identical to SEQ ID NO: 4623

SEQ ID NO: 6344 - DNA, 111 bp, homo sapiens; identical to SEQ ID NO: 4624

SEQ ID NO: 6345 - protein, 18 aa, homo sapiens
MIQMSNCLYLTLFVYLQK

SEQ ID NO: 6346 - DNA, 57 bp, homo sapiens; identical to SEQ ID NO: 5458

SEQ ID NO: 6347 - protein, 4 aa, homo sapiens
MVKL

SEQ ID NO: 6348 - DNA, 15 bp, homo sapiens
atggtgaagttataa

SEQ ID NO: 6349 - protein, 15 aa, homo sapiens
MVQNVRRCYTPSWGR

SEQ ID NO: 6350 - DNA, 48 bp, homo sapiens; identical to SEQ ID NO: 5462

SEQ ID NO: 6351 - protein, 15 aa, homo sapiens
MMLHFGTPFPCSGRM

SEQ ID NO: 6352 - DNA, 48 bp, homo sapiens; identical to SEQ ID NO: 5464

SEQ ID NO: 6353 - protein, 4 aa, homo sapiens
MVCH

SEQ ID NO: 6354 - DNA, 15 bp, homo sapiens
atggtctgtcactaa

SEQ ID NO: 6355 - protein, 13 aa, homo sapiens
MPINDLSILRVWA

SEQ ID NO: 6356 - DNA, 42 bp, homo sapiens
atgcccattaatgatctctctatactgagagtatgggcttga

SEQ ID NO: 6357 - protein, 5 aa, homo sapiens
MISLY

SEQ ID NO: 6358 - DNA, 18 bp, homo sapiens
atgatctctctatactga

SEQ ID NO: 6359 - protein, 17 aa, homo sapiens
MGLMFLAITLENTLDMP

SEQ ID NO: 6360 - DNA, 54 bp, homo sapiens
atgggcttgatgtttctggccattaccttggagaatactttagatatgccttaa

SEQ ID NO: 6361 - protein, 8 aa, homo sapiens
MGFSLIAE

SEQ ID NO: 6362 - DNA, 27 bp, homo sapiens
atgggcttctcgttgatcgcagaatga

SEQ ID NO: 6363 - protein, 15 aa, homo sapiens
MKFKLRNMFLKSFRF

SEQ ID NO: 6364 - DNA, 48 bp, homo sapiens; identical to SEQ ID NO: 3060

SEQ ID NO: 6365 - protein, 9 aa, homo sapiens
MQCRSPLFL

SEQ ID NO: 6366 - DNA, 30 bp, homo sapiens; identical to SEQ ID NO: 3062

SEQ ID NO: 6367 - protein, 10 aa, homo sapiens
MSLSPISLAL

SEQ ID NO: 6368 - DNA, 33 bp, homo sapiens; identical to SEQ ID NO: 3064

SEQ ID NO: 6369 - protein, 4 aa, homo sapiens
MSPQ

SEQ ID NO: 6370 - DNA, 15 bp, homo sapiens
atgtctcctcagtag

SEQ ID NO: 6371 - protein, 53 aa, homo sapiens
MRLPLLLVFASVIPGAVLLLGKSALRQGISDLGGRNHTFLFWVTVNGFLSTSL

SEQ ID NO: 6372 - DNA, 162 bp, homo sapiens
atgaggctacccctgctcctggtttttgcctctgtcattccgggtgctgttctcctactgggtaagtctgctctgaggcaggggatctctgacctggggggccggaaccacaccttcctcttctgggttactgtgaatgggttcctttcaacatctttgtga

SEQ ID NO: 6373 - protein, 104 aa, homo sapiens
MGSFQHLCEEETGFPCTTQSTAKPAAFTWRPGMGGLELEEGGGCVSGLGCCPAGNPTDLQCPPDFSHRSLFLPCFLRAEISCSVVYSFWFSIHTISVSPPTNTF

SEQ ID NO: 6374 - DNA, 315 bp, homo sapiens
atgggttcctttcaacatctttgtgaggaggaaacggggttcccctgcaccacgcagtccacggctaagcctgctgccttcacctggcggccaggcatgggaggcctggagttggaggagggaggaggatgcgtctcaggtctcggttgctgccctgccgggaaccctacagaccttcagtgtcctcctgacttctctcatcgctcgttgttccttccctgttttcttcgtgcagaaatttcctgctctgtggtttactctttctggttttcaattcacactatttctgtctcaccgccaacaaacaccttctga

SEQ ID NO: 6375 - protein, 20 aa, homo sapiens
MRLRSRLLPCREPYRPSVSS

SEQ ID NO: 6376 - DNA, 63 bp, homo sapiens
atgcgtctcaggtctcggttgctgccctgccgggaaccctacagaccttcagtgtcctcctga

SEQ ID NO: 6377 - protein, 4 aa, homo sapiens
MSPQ

SEQ ID NO: 6378 - DNA, 15 bp, homo sapiens
atgtctcctcagtag

SEQ ID NO: 6379 - protein, 53 aa, homo sapiens; identical to SEQ ID NO: 6371

SEQ ID NO: 6380 - DNA, 162 bp, homo sapiens; identical to SEQ ID NO: 6372

SEQ ID NO: 6381 - protein, 104 aa, homo sapiens; identical to SEQ ID NO: 6373

SEQ ID NO: 6382 - DNA, 315 bp, homo sapiens; identical to SEQ ID NO: 6374

SEQ ID NO: 6383 - protein, 20 aa, homo sapiens
MRLRSRLLPCREPYRPSVSS

SEQ ID NO: 6384 - DNA, 63 bp, homo sapiens; identical to SEQ ID NO: 6376

SEQ ID NO: 6385 - protein, 4 aa, homo sapiens
MSIR

SEQ ID NO: 6386 - DNA, 15 bp, homo sapiens
atgtcaatcagatga

SEQ ID NO: 6387 - protein, 361 aa, homo sapiens [sequence omitted]

SEQ ID NO: 6388 - DNA, 1086 bp, homo sapiens; identical to SEQ ID NO: 6308

SEQ ID NO: 6389 - protein, 292 aa, homo sapiens [sequence omitted]

SEQ ID NO: 6390 - DNA, 879 bp, homo sapiens; identical to SEQ ID NO: 6310

SEQ ID NO: 6391 - protein, 8 aa, homo sapiens
MGLKPRYS

SEQ ID NO: 6392 - DNA, 27 bp, homo sapiens
atggggctcaagcctcgttattcataa

SEQ ID NO: 6393 - protein, 4 aa, homo sapiens
MSIR

SEQ ID NO: 6394 - DNA, 15 bp, homo sapiens
atgtcaatcagatga

SEQ ID NO: 6395 - protein, 361 aa, homo sapiens [sequence omitted]

SEQ ID NO: 6396 - DNA, 1086 bp, homo sapiens; identical to SEQ ID NO: 6308

SEQ ID NO: 6397 - protein, 292 aa, homo sapiens [sequence omitted]

SEQ ID NO: 6398 - DNA, 879 bp, homo sapiens; identical to SEQ ID NO: 6310

SEQ ID NO: 6399 - protein, 8 aa, homo sapiens
MGLKPRYS

SEQ ID NO: 6400 - DNA, 27 bp, homo sapiens
atggggctcaagcctcgttattcataa

SEQ ID NO: 6401 - protein, 4 aa, homo sapiens
MSIR

SEQ ID NO: 6402 - DNA, 15 bp, homo sapiens
atgtcaatcagatga

SEQ ID NO: 6403 - protein, 361 aa, homo sapiens [sequence omitted]

SEQ ID NO: 6404 - DNA, 1086 bp, homo sapiens; identical to SEQ ID NO: 6308

SEQ ID NO: 6405 - protein, 292 aa, homo sapiens [sequence omitted]

SEQ ID NO: 6406 - DNA, 879 bp, homo sapiens; identical to SEQ ID NO: 6310

SEQ ID NO: 6407 - protein, 8 aa, homo sapiens
MGLKPRYS

SEQ ID NO: 6408 - DNA, 27 bp, homo sapiens
atggggctcaagcctcgttattcataa

SEQ ID NO: 6409 - protein, 4 aa, homo sapiens
MSIR

SEQ ID NO: 6410 - DNA, 15 bp, homo sapiens
atgtcaatcagatga

SEQ ID NO: 6411 - protein, 361 aa, homo sapiens [sequence omitted]

SEQ ID NO: 6412 - DNA, 1086 bp, homo sapiens; identical to SEQ ID NO: 6308

SEQ ID NO: 6413 - protein, 292 aa, homo sapiens [sequence omitted]

SEQ ID NO: 6414 - DNA, 879 bp, homo sapiens; identical to SEQ ID NO: 6310

SEQ ID NO: 6415 - protein, 8 aa, homo sapiens
MGLKPRYS

SEQ ID NO: 6416 - DNA, 27 bp, homo sapiens
atggggctcaagcctcgttattcataa

SEQ ID NO: 6417 - protein, 4 aa, homo sapiens
MSIR

SEQ ID NO: 6418 - DNA, 15 bp, homo sapiens
atgtcaatcagatga

SEQ ID NO: 6419 - protein, 361 aa, homo sapiens [sequence omitted]

SEQ ID NO: 6420 - DNA, 1086 bp, homo sapiens; identical to SEQ ID NO: 6308

SEQ ID NO: 6421 - protein, 292 aa, homo sapiens [sequence omitted]

SEQ ID NO: 6422 - DNA, 879 bp, homo sapiens; identical to SEQ ID NO: 6310

SEQ ID NO: 6423 - protein, 8 aa, homo sapiens
MGLKPRYS

SEQ ID NO: 6424 - DNA, 27 bp, homo sapiens
atggggctcaagcctcgttattcataa

SEQ ID NO: 6425 - protein, 4 aa, homo sapiens
MSIR

SEQ ID NO: 6426 - DNA, 15 bp, homo sapiens
atgtcaatcagatga

SEQ ID NO: 6427 - protein, 361 aa, homo sapiens [sequence omitted]

SEQ ID NO: 6428 - DNA, 1086 bp, homo sapiens; identical to SEQ ID NO: 6308

SEQ ID NO: 6429 - protein, 292 aa, homo sapiens [sequence omitted]

SEQ ID NO: 6430 - DNA, 879 bp, homo sapiens; identical to SEQ ID NO: 6310

SEQ ID NO: 6431 - protein, 8 aa, homo sapiens
MGLKPRYS

SEQ ID NO: 6432 - DNA, 27 bp, homo sapiens
atggggctcaagcctcgttattcataa

SEQ ID NO: 6433 - protein, 4 aa, homo sapiens
MSIR

SEQ ID NO: 6434 - DNA, 15 bp, homo sapiens
atgtcaatcagatga

SEQ ID NO: 6435 - protein, 361 aa, homo sapiens [sequence omitted]

SEQ ID NO: 6436 - DNA, 1086 bp, homo sapiens; identical to SEQ ID NO: 6308

SEQ ID NO: 6437 - protein, 292 aa, homo sapiens [sequence omitted]

SEQ ID NO: 6438 - DNA, 879 bp, homo sapiens; identical to SEQ ID NO: 6310

SEQ ID NO: 6439 - protein, 8 aa, homo sapiens
MGLKPRYS

SEQ ID NO: 6440 - DNA, 27 bp, homo sapiens
atggggctcaagcctcgttattcataa

SEQ ID NO: 6441 - protein, 4 aa, homo sapiens
MSIR

SEQ ID NO: 6442 - DNA, 15 bp, homo sapiens
atgtcaatcagatga

SEQ ID NO: 6443 - protein, 361 aa, homo sapiens [sequence omitted]

SEQ ID NO: 6444 - DNA, 1086 bp, homo sapiens; identical to SEQ ID NO: 6308

SEQ ID NO: 6445 - protein, 292 aa, homo sapiens [sequence omitted]

SEQ ID NO: 6446 - DNA, 879 bp, homo sapiens; identical to SEQ ID NO: 6310

SEQ ID NO: 6447 - protein, 8 aa, homo sapiens
MGLKPRYS

SEQ ID NO: 6448 - DNA, 27 bp, homo sapiens
atggggctcaagcctcgttattcataa

SEQ ID NO: 6449 - protein, 4 aa, homo sapiens
MSIR

SEQ ID NO: 6450 - DNA, 15 bp, homo sapiens
atgtcaatcagatga

SEQ ID NO: 6451 - protein, 361 aa, homo sapiens [sequence omitted]

SEQ ID NO: 6452 - DNA, 1086 bp, homo sapiens; identical to SEQ ID NO: 6308

SEQ ID NO: 6453 - protein, 292 aa, homo sapiens [sequence omitted]

SEQ ID NO: 6454 - DNA, 879 bp, homo sapiens; identical to SEQ ID NO: 6310

SEQ ID NO: 6455 - protein, 8 aa, homo sapiens
MGLKPRYS

SEQ ID NO: 6456 - DNA, 27 bp, homo sapiens
atggggctcaagcctcgttattcataa

SEQ ID NO: 6457 - protein, 4 aa, homo sapiens
MSIR

SEQ ID NO: 6458 - DNA, 15 bp, homo sapiens
atgtcaatcagatga

SEQ ID NO: 6459 - protein, 361 aa, homo sapiens [sequence omitted]

SEQ ID NO: 6460 - DNA, 1086 bp, homo sapiens; identical to SEQ ID NO: 6308

SEQ ID NO: 6461 - protein, 292 aa, homo sapiens [sequence omitted]

SEQ ID NO: 6462 - DNA, 879 bp, homo sapiens; identical to SEQ ID NO: 6310

SEQ ID NO: 6463 - protein, 8 aa, homo sapiens
MGLKPRYS

SEQ ID NO: 6464 - DNA, 27 bp, homo sapiens
atggggctcaagcctcgttattcataa

SEQ ID NO: 6465 - protein, 4 aa, homo sapiens
MSIR

SEQ ID NO: 6466 - DNA, 15 bp, homo sapiens
atgtcaatcagatga

SEQ ID NO: 6467 - protein, 361 aa, homo sapiens [sequence omitted]

SEQ ID NO: 6468 - DNA, 1086 bp, homo sapiens; identical to SEQ ID NO: 6308

SEQ ID NO: 6469 - protein, 292 aa, homo sapiens [sequence omitted]

SEQ ID NO: 6470 - DNA, 879 bp, homo sapiens; identical to SEQ ID NO: 6310

SEQ ID NO: 6471 - protein, 8 aa, homo sapiens
MGLKPRYS

SEQ ID NO: 6472 - DNA, 27 bp, homo sapiens
atggggctcaagcctcgttattcataa

SEQ ID NO: 6473 - protein, 4 aa, homo sapiens
MSIR

SEQ ID NO: 6474 - DNA, 15 bp, homo sapiens
atgtcaatcagatga

SEQ ID NO: 6475 - protein, 361 aa, homo sapiens [sequence omitted]

SEQ ID NO: 6476 - DNA, 1086 bp, homo sapiens; identical to SEQ ID NO: 6308

SEQ ID NO: 6477 - protein, 292 aa, homo sapiens [sequence omitted]

SEQ ID NO: 6478 - DNA, 879 bp, homo sapiens; identical to SEQ ID NO: 6310

SEQ ID NO: 6479 - protein, 8 aa, homo sapiens
MGLKPRYS

SEQ ID NO: 6480 - DNA, 27 bp, homo sapiens
atggggctcaagcctcgttattcataa

SEQ ID NO: 6481 - protein, 4 aa, homo sapiens
MSIR

SEQ ID NO: 6482 - DNA, 15 bp, homo sapiens
atgtcaatcagatga

SEQ ID NO: 6483 - protein, 361 aa, homo sapiens [sequence omitted]

SEQ ID NO: 6484 - DNA, 1086 bp, homo sapiens; identical to SEQ ID NO: 6308

SEQ ID NO: 6485 - protein, 292 aa, homo sapiens [sequence omitted]

SEQ ID NO: 6486 - DNA, 879 bp, homo sapiens; identical to SEQ ID NO: 6310

SEQ ID NO: 6487 - protein, 8 aa, homo sapiens
MGLKPRYS

SEQ ID NO: 6488 - DNA, 27 bp, homo sapiens
atggggctcaagcctcgttattcataa

SEQ ID NO: 6489 - protein, 4 aa, homo sapiens
MSIR

SEQ ID NO: 6490 - DNA, 15 bp, homo sapiens
atgtcaatcagatga

SEQ ID NO: 6491 - protein, 361 aa, homo sapiens [sequence omitted]

SEQ ID NO: 6492 - DNA, 1086 bp, homo sapiens; identical to SEQ ID NO: 6308

SEQ ID NO: 6493 - protein, 292 aa, homo sapiens [sequence omitted]

SEQ ID NO: 6494 - DNA, 879 bp, homo sapiens; identical to SEQ ID NO: 6310

SEQ ID NO: 6495 - protein, 8 aa, homo sapiens
MGLKPRYS

SEQ ID NO: 6496 - DNA, 27 bp, homo sapiens
atggggctcaagcctcgttattcataa

SEQ ID NO: 6497 - protein, 4 aa, homo sapiens
MSIR

SEQ ID NO: 6498 - DNA, 15 bp, homo sapiens
atgtcaatcagatga

SEQ ID NO: 6499 - protein, 361 aa, homo sapiens [sequence omitted]

SEQ ID NO: 6500 - DNA, 1086 bp, homo sapiens; identical to SEQ ID NO: 6308

SEQ ID NO: 6501 - protein, 292 aa, homo sapiens [sequence omitted]

SEQ ID NO: 6502 - DNA, 879 bp, homo sapiens; identical to SEQ ID NO: 6310

SEQ ID NO: 6503 - protein, 8 aa, homo sapiens
MGLKPRYS

SEQ ID NO: 6504 - DNA, 27 bp, homo sapiens
atggggctcaagcctcgttattcataa

SEQ ID NO: 6505 - protein, 4 aa, homo sapiens
MSIR

SEQ ID NO: 6506 - DNA, 15 bp, homo sapiens
atgtcaatcagatga

SEQ ID NO: 6507 - protein, 361 aa, homo sapiens [sequence omitted]

SEQ ID NO: 6508 - DNA, 1086 bp, homo sapiens; identical to SEQ ID NO: 6308

SEQ ID NO: 6509 - protein, 292 aa, homo sapiens [sequence omitted]

SEQ ID NO: 6510 - DNA, 879 bp, homo sapiens; identical to SEQ ID NO: 6310

SEQ ID NO: 6511 - protein, 8 aa, homo sapiens
MGLKPRYS

SEQ ID NO: 6512 - DNA, 27 bp, homo sapiens
atggggctcaagcctcgttattcataa

SEQ ID NO: 6513 - protein, 4 aa, homo sapiens
MSIR

SEQ ID NO: 6514 - DNA, 15 bp, homo sapiens
atgtcaatcagatga

SEQ ID NO: 6515 - protein, 361 aa, homo sapiens [sequence omitted]

SEQ ID NO: 6516 - DNA, 1086 bp, homo sapiens; identical to SEQ ID NO: 6308

SEQ ID NO: 6517 - protein, 292 aa, homo sapiens [sequence omitted]

SEQ ID NO: 6518 - DNA, 879 bp, homo sapiens; identical to SEQ ID NO: 6310

SEQ ID NO: 6519 - protein, 8 aa, homo sapiens
MGLKPRYS

SEQ ID NO: 6520 - DNA, 27 bp, homo sapiens
atggggctcaagcctcgttattcataa

SEQ ID NO: 6521 - protein, 4 aa, homo sapiens
MSIR

SEQ ID NO: 6522 - DNA, 15 bp, homo sapiens
atgtcaatcagatga

SEQ ID NO: 6523 - protein, 361 aa, homo sapiens [sequence omitted]

SEQ ID NO: 6524 - DNA, 1086 bp, homo sapiens; identical to SEQ ID NO: 6308

SEQ ID NO: 6525 - protein, 292 aa, homo sapiens [sequence omitted]

SEQ ID NO: 6526 - DNA, 879 bp, homo sapiens; identical to SEQ ID NO: 6310

SEQ ID NO: 6527 - protein, 8 aa, homo sapiens
MGLKPRYS

SEQ ID NO: 6528 - DNA, 27 bp, homo sapiens
atggggctcaagcctcgttattcataa

SEQ ID NO: 6529 - protein, 4 aa, homo sapiens
MSIR

SEQ ID NO: 6530 - DNA, 15 bp, homo sapiens
atgtcaatcagatga

SEQ ID NO: 6531 - protein, 361 aa, homo sapiens [sequence omitted]

SEQ ID NO: 6532 - DNA, 1086 bp, homo sapiens; identical to SEQ ID NO: 6308

SEQ ID NO: 6533 - protein, 292 aa, homo sapiens [sequence omitted]

SEQ ID NO: 6534 - DNA, 879 bp, homo sapiens; identical to SEQ ID NO: 6310

SEQ ID NO: 6535 - protein, 8 aa, homo sapiens
MGLKPRYS

SEQ ID NO: 6536 - DNA, 27 bp, homo sapiens
atggggctcaagcctcgttattcataa

SEQ ID NO: 6537 - protein, 4 aa, homo sapiens
MSIR

SEQ ID NO: 6538 - DNA, 15 bp, homo sapiens
atgtcaatcagatga

SEQ ID NO: 6539 - protein, 361 aa, homo sapiens [sequence omitted]

SEQ ID NO: 6540 - DNA, 1086 bp, homo sapiens; identical to SEQ ID NO: 6308

SEQ ID NO: 6541 - protein, 292 aa, homo sapiens [sequence omitted]

SEQ ID NO: 6542 - DNA, 879 bp, homo sapiens; identical to SEQ ID NO: 6310

SEQ ID NO: 6543 - protein, 8 aa, homo sapiens
MGLKPRYS

SEQ ID NO: 6544 - DNA, 27 bp, homo sapiens
atggggctcaagcctcgttattcataa

SEQ ID NO: 6545 - protein, 4 aa, homo sapiens
MSIR

SEQ ID NO: 6546 - DNA, 15 bp, homo sapiens
atgtcaatcagatga

SEQ ID NO: 6547 - protein, 361 aa, homo sapiens [sequence omitted]

SEQ ID NO: 6548 - DNA, 1086 bp, homo sapiens; identical to SEQ ID NO: 6308

SEQ ID NO: 6549 - protein, 292 aa, homo sapiens [sequence omitted]

SEQ ID NO: 6550 - DNA, 879 bp, homo sapiens; identical to SEQ ID NO: 6310

SEQ ID NO: 6551 - protein, 8 aa, homo sapiens
MGLKPRYS

SEQ ID NO: 6552 - DNA, 27 bp, homo sapiens
atggggctcaagcctcgttattcataa

SEQ ID NO: 6553 - protein, 4 aa, homo sapiens
MSIR

SEQ ID NO: 6554 - DNA, 15 bp, homo sapiens
atgtcaatcagatga

SEQ ID NO: 6555 - protein, 361 aa, homo sapiens [sequence omitted]

SEQ ID NO: 6556 - DNA, 1086 bp, homo sapiens; identical to SEQ ID NO: 6308

SEQ ID NO: 6557 - protein, 292 aa, homo sapiens [sequence omitted]

SEQ ID NO: 6558 - DNA, 879 bp, homo sapiens; identical to SEQ ID NO: 6310

SEQ ID NO: 6559 - protein, 8 aa, homo sapiens
MGLKPRYS

SEQ ID NO: 6560 - DNA, 27 bp, homo sapiens
atggggctcaagcctcgttattcataa

SEQ ID NO: 6561 - protein, 4 aa, homo sapiens
MSIR

SEQ ID NO: 6562 - DNA, 15 bp, homo sapiens
atgtcaatcagatga

SEQ ID NO: 6563 - protein, 361 aa, homo sapiens [sequence omitted]

SEQ ID NO: 6564 - DNA, 1086 bp, homo sapiens; identical to SEQ ID NO: 6308

SEQ ID NO: 6565 - protein, 292 aa, homo sapiens [sequence omitted]

SEQ ID NO: 6566 - DNA, 879 bp, homo sapiens; identical to SEQ ID NO: 6310

SEQ ID NO: 6567 - protein, 8 aa, homo sapiens
MGLKPRYS

SEQ ID NO: 6568 - DNA, 27 bp, homo sapiens
atggggctcaagcctcgttattcataa

SEQ ID NO: 6569 - protein, 4 aa, homo sapiens
MSIR

SEQ ID NO: 6570 - DNA, 15 bp, homo sapiens
atgtcaatcagatga

SEQ ID NO: 6571 - protein, 361 aa, homo sapiens [sequence omitted]

SEQ ID NO: 6572 - DNA, 1086 bp, homo sapiens; identical to SEQ ID NO: 6308

SEQ ID NO: 6573 - protein, 292 aa, homo sapiens [sequence omitted]

SEQ ID NO: 6574 - DNA, 879 bp, homo sapiens; identical to SEQ ID NO: 6310

SEQ ID NO: 6575 - protein, 8 aa, homo sapiens
MGLKPRYS

SEQ ID NO: 6576 - DNA, 27 bp, homo sapiens
atggggctcaagcctcgttattcataa

SEQ ID NO: 6577 - protein, 4 aa, homo sapiens
MSIR

SEQ ID NO: 6578 - DNA, 15 bp, homo sapiens
atgtcaatcagatga

SEQ ID NO: 6579 - protein, 361 aa, homo sapiens [sequence omitted]

SEQ ID NO: 6580 - DNA, 1086 bp, homo sapiens; identical to SEQ ID NO: 6308

SEQ ID NO: 6581 - protein, 292 aa, homo sapiens [sequence omitted]

SEQ ID NO: 6582 - DNA, 879 bp, homo sapiens; identical to SEQ ID NO: 6310

SEQ ID NO: 6583 - protein, 8 aa, homo sapiens
MGLKPRYS

SEQ ID NO: 6584 - DNA, 27 bp, homo sapiens
atggggctcaagcctcgttattcataa

SEQ ID NO: 6585 - protein, 4 aa, homo sapiens
MSIR

SEQ ID NO: 6586 - DNA, 15 bp, homo sapiens
atgtcaatcagatga

SEQ ID NO: 6587 - protein, 361 aa, homo sapiens [sequence omitted]

SEQ ID NO: 6588 - DNA, 1086 bp, homo sapiens; identical to SEQ ID NO: 6308

SEQ ID NO: 6589 - protein, 292 aa, homo sapiens [sequence omitted]

SEQ ID NO: 6590 - DNA, 879 bp, homo sapiens; identical to SEQ ID NO: 6310

SEQ ID NO: 6591 - protein, 8 aa, homo sapiens
MGLKPRYS

SEQ ID NO: 6592 - DNA, 27 bp, homo sapiens
atggggctcaagcctcgttattcataa

SEQ ID NO: 6593 - protein, 4 aa, homo sapiens
MSIR

SEQ ID NO: 6594 - DNA, 15 bp, homo sapiens
atgtcaatcagatga

SEQ ID NO: 6595 - protein, 361 aa, homo sapiens [sequence omitted]

SEQ ID NO: 6596 - DNA, 1086 bp, homo sapiens; identical to SEQ ID NO: 6308

SEQ ID NO: 6597 - protein, 292 aa, homo sapiens [sequence omitted]

SEQ ID NO: 6598 - DNA, 879 bp, homo sapiens; identical to SEQ ID NO: 6310

SEQ ID NO: 6599 - protein, 8 aa, homo sapiens
MGLKPRYS

SEQ ID NO: 6600 - DNA, 27 bp, homo sapiens
atggggctcaagcctcgttattcataa

SEQ ID NO: 6601 - protein, 4 aa, homo sapiens
MSIR

SEQ ID NO: 6602 - DNA, 15 bp, homo sapiens
atgtcaatcagatga

SEQ ID NO: 6603 - protein, 361 aa, homo sapiens [sequence omitted]

SEQ ID NO: 6604 - DNA, 1086 bp, homo sapiens; identical to SEQ ID NO: 6308

SEQ ID NO: 6605 - protein, 292 aa, homo sapiens [sequence omitted]

SEQ ID NO: 6606 - DNA, 879 bp, homo sapiens; identical to SEQ ID NO: 6310

SEQ ID NO: 6607 - protein, 8 aa, homo sapiens
MGLKPRYS

SEQ ID NO: 6608 - DNA, 27 bp, homo sapiens
atggggctcaagcctcgttattcataa

SEQ ID NO: 6609 - protein, 4 aa, homo sapiens
MSIR

SEQ ID NO: 6610 - DNA, 15 bp, homo sapiens
atgtcaatcagatga

SEQ ID NO: 6611 - protein, 361 aa, homo sapiens [sequence omitted]

SEQ ID NO: 6612 - DNA, 1086 bp, homo sapiens; identical to SEQ ID NO: 6308

SEQ ID NO: 6613 - protein, 292 aa, homo sapiens [sequence omitted]

SEQ ID NO: 6614 - DNA, 879 bp, homo sapiens; identical to SEQ ID NO: 6310

SEQ ID NO: 6615 - protein, 8 aa, homo sapiens
MGLKPRYS

SEQ ID NO: 6616 - DNA, 27 bp, homo sapiens
atggggctcaagcctcgttattcataa

SEQ ID NO: 6617 - protein, 4 aa, homo sapiens
MSIR

SEQ ID NO: 6618 - DNA, 15 bp, homo sapiens
atgtcaatcagatga

SEQ ID NO: 6619 - protein, 361 aa, homo sapiens [sequence omitted]

SEQ ID NO: 6620 - DNA, 1086 bp, homo sapiens; identical to SEQ ID NO: 6308

SEQ ID NO: 6621 - protein, 292 aa, homo sapiens [sequence omitted]

SEQ ID NO: 6622 - DNA, 879 bp, homo sapiens; identical to SEQ ID NO: 6310

SEQ ID NO: 6623 - protein, 8 aa, homo sapiens
MGLKPRYS

SEQ ID NO: 6624 - DNA, 27 bp, homo sapiens
atggggctcaagcctcgttattcataa

SEQ ID NO: 6625 - protein, 4 aa, homo sapiens
MSIR

SEQ ID NO: 6626 - DNA, 15 bp, homo sapiens
atgtcaatcagatga

SEQ ID NO: 6627 - protein, 361 aa, homo sapiens [sequence omitted]

SEQ ID NO: 6628 - DNA, 1086 bp, homo sapiens; identical to SEQ ID NO: 6308

SEQ ID NO: 6629 - protein, 292 aa, homo sapiens [sequence omitted]

SEQ ID NO: 6630 - DNA, 879 bp, homo sapiens; identical to SEQ ID NO: 6310

SEQ ID NO: 6631 - protein, 8 aa, homo sapiens
MGLKPRYS

SEQ ID NO: 6632 - DNA, 27 bp, homo sapiens
atggggctcaagcctcgttattcataa

SEQ ID NO: 6633 - protein, 4 aa, homo sapiens
MSIR

SEQ ID NO: 6634 - DNA, 15 bp, homo sapiens
atgtcaatcagatga

SEQ ID NO: 6635 - protein, 361 aa, homo sapiens [sequence omitted]

SEQ ID NO: 6636 - DNA, 1086 bp, homo sapiens; identical to SEQ ID NO: 6308

SEQ ID NO: 6637 - protein, 292 aa, homo sapiens [sequence omitted]

SEQ ID NO: 6638 - DNA, 879 bp, homo sapiens; identical to SEQ ID NO: 6310

SEQ ID NO: 6639 - protein, 8 aa, homo sapiens
MGLKPRYS

SEQ ID NO: 6640 - DNA, 27 bp, homo sapiens
atggggctcaagcctcgttattcataa

SEQ ID NO: 6641 - protein, 4 aa, homo sapiens
MSIR

SEQ ID NO: 6642 - DNA, 15 bp, homo sapiens
atgtcaatcagatga

SEQ ID NO: 6643 - protein, 361 aa, homo sapiens [sequence omitted]

SEQ ID NO: 6644 - DNA, 1086 bp, homo sapiens; identical to SEQ ID NO: 6308

SEQ ID NO: 6645 - protein, 292 aa, homo sapiens [sequence omitted]

SEQ ID NO: 6646 - DNA, 879 bp, homo sapiens; identical to SEQ ID NO: 6310

SEQ ID NO: 6647 - protein, 8 aa, homo sapiens
MGLKPRYS

SEQ ID NO: 6648 - DNA, 27 bp, homo sapiens
atggggctcaagcctcgttattcataa

SEQ ID NO: 6649 - protein, 4 aa, homo sapiens
MSIR

SEQ ID NO: 6650 - DNA, 15 bp, homo sapiens
atgtcaatcagatga

SEQ ID NO: 6651 - protein, 361 aa, homo sapiens [sequence omitted]

SEQ ID NO: 6652 - DNA, 1086 bp, homo sapiens; identical to SEQ ID NO: 6308

SEQ ID NO: 6653 - protein, 292 aa, homo sapiens [sequence omitted]

SEQ ID NO: 6654 - DNA, 879 bp, homo sapiens; identical to SEQ ID NO: 6310

SEQ ID NO: 6655 - protein, 8 aa, homo sapiens
MGLKPRYS

SEQ ID NO: 6656 - DNA, 27 bp, homo sapiens
atggggctcaagcctcgttattcataa

SEQ ID NO: 6657 - protein, 4 aa, homo sapiens
MSIR

SEQ ID NO: 6658 - DNA, 15 bp, homo sapiens
atgtcaatcagatga

SEQ ID NO: 6659 - protein, 361 aa, homo sapiens [sequence omitted]

SEQ ID NO: 6660 - DNA, 1086 bp, homo sapiens; identical to SEQ ID NO: 6308

SEQ ID NO: 6661 - protein, 292 aa, homo sapiens [sequence omitted]

SEQ ID NO: 6662 - DNA, 879 bp, homo sapiens; identical to SEQ ID NO: 6310

SEQ ID NO: 6663 - protein, 8 aa, homo sapiens
MGLKPRYS

SEQ ID NO: 6664 - DNA, 27 bp, homo sapiens
atggggctcaagcctcgttattcataa

SEQ ID NO: 6665 - protein, 4 aa, homo sapiens
MSIR

SEQ ID NO: 6666 - DNA, 15 bp, homo sapiens
atgtcaatcagatga

SEQ ID NO: 6667 - protein, 361 aa, homo sapiens [sequence omitted]

SEQ ID NO: 6668 - DNA, 1086 bp, homo sapiens; identical to SEQ ID NO: 6308

SEQ ID NO: 6669 - protein, 292 aa, homo sapiens [sequence omitted]

SEQ ID NO: 6670 - DNA, 879 bp, homo sapiens; identical to SEQ ID NO: 6310

SEQ ID NO: 6671 - protein, 8 aa, homo sapiens
MGLKPRYS

SEQ ID NO: 6672 - DNA, 27 bp, homo sapiens
atggggctcaagcctcgttattcataa

SEQ ID NO: 6673 - protein, 4 aa, homo sapiens
MSIR

SEQ ID NO: 6674 - DNA, 15 bp, homo sapiens
atgtcaatcagatga

SEQ ID NO: 6675 - protein, 361 aa, homo sapiens [sequence omitted]

SEQ ID NO: 6676 - DNA, 1086 bp, homo sapiens; identical to SEQ ID NO: 6308

SEQ ID NO: 6677 - protein, 292 aa, homo sapiens [sequence omitted]

SEQ ID NO: 6678 - DNA, 879 bp, homo sapiens; identical to SEQ ID NO: 6310

SEQ ID NO: 6679 - protein, 8 aa, homo sapiens
MGLKPRYS

SEQ ID NO: 6680 - DNA, 27 bp, homo sapiens
atggggctcaagcctcgttattcataa

SEQ ID NO: 6681 - protein, 4 aa, homo sapiens
MSIR

SEQ ID NO: 6682 - DNA, 15 bp, homo sapiens
atgtcaatcagatga

SEQ ID NO: 6683 - protein, 361 aa, homo sapiens [sequence omitted]

SEQ ID NO: 6684 - DNA, 1086 bp, homo sapiens; identical to SEQ ID NO: 6308

SEQ ID NO: 6685 - protein, 292 aa, homo sapiens [sequence omitted]

SEQ ID NO: 6686 - DNA, 879 bp, homo sapiens; identical to SEQ ID NO: 6310

SEQ ID NO: 6687 - protein, 8 aa, homo sapiens
MGLKPRYS

SEQ ID NO: 6688 - DNA, 27 bp, homo sapiens
atggggctcaagcctcgttattcataa

SEQ ID NO: 6689 - protein, 4 aa, homo sapiens
MSIR

SEQ ID NO: 6690 - DNA, 15 bp, homo sapiens
atgtcaatcagatga

SEQ ID NO: 6691 - protein, 361 aa, homo sapiens [sequence omitted]

SEQ ID NO: 6692 - DNA, 1086 bp, homo sapiens; identical to SEQ ID NO: 6308

SEQ ID NO: 6693 - protein, 292 aa, homo sapiens [sequence omitted]

SEQ ID NO: 6694 - DNA, 879 bp, homo sapiens; identical to SEQ ID NO: 6310

SEQ ID NO: 6695 - protein, 8 aa, homo sapiens
MGLKPRYS

SEQ ID NO: 6696 - DNA, 27 bp, homo sapiens
atggggctcaagcctcgttattcataa

SEQ ID NO: 6697 - protein, 4 aa, homo sapiens
MSIR

SEQ ID NO: 6698 - DNA, 15 bp, homo sapiens
atgtcaatcagatga

SEQ ID NO: 6699 - protein, 361 aa, homo sapiens [sequence omitted]

SEQ ID NO: 6700 - DNA, 1086 bp, homo sapiens; identical to SEQ ID NO: 6308

SEQ ID NO: 6701 - protein, 292 aa, homo sapiens [sequence omitted]

SEQ ID NO: 6702 - DNA, 879 bp, homo sapiens; identical to SEQ ID NO: 6310

SEQ ID NO: 6703 - protein, 8 aa, homo sapiens
MGLKPRYS

SEQ ID NO: 6704 - DNA, 27 bp, homo sapiens
atggggctcaagcctcgttattcataa

SEQ ID NO: 6705 - protein, 4 aa, homo sapiens
MSIR

SEQ ID NO: 6706 - DNA, 15 bp, homo sapiens
atgtcaatcagatga

SEQ ID NO: 6707 - protein, 361 aa, homo sapiens [sequence omitted]

SEQ ID NO: 6708 - DNA, 1086 bp, homo sapiens; identical to SEQ ID NO: 6308

SEQ ID NO: 6709 - protein, 292 aa, homo sapiens [sequence omitted]

SEQ ID NO: 6710 - DNA, 879 bp, homo sapiens; identical to SEQ ID NO: 6310

SEQ ID NO: 6711 - protein, 8 aa, homo sapiens
MGLKPRYS

SEQ ID NO: 6712 - DNA, 27 bp, homo sapiens
atggggctcaagcctcgttattcataa

SEQ ID NO: 6713 - protein, 4 aa, homo sapiens
MSIR

SEQ ID NO: 6714 - DNA, 15 bp, homo sapiens
atgtcaatcagatga

SEQ ID NO: 6715 - protein, 361 aa, homo sapiens [sequence omitted]

SEQ ID NO: 6716 - DNA, 1086 bp, homo sapiens; identical to SEQ ID NO: 6308

SEQ ID NO: 6717 - protein, 292 aa, homo sapiens [sequence omitted]

SEQ ID NO: 6718 - DNA, 879 bp, homo sapiens; identical to SEQ ID NO: 6310

SEQ ID NO: 6719 - protein, 8 aa, homo sapiens
MGLKPRYS

SEQ ID NO: 6720 - DNA, 27 bp, homo sapiens
atggggctcaagcctcgttattcataa

SEQ ID NO: 6721 - protein, 16 aa, homo sapiens
MSRAPASLPLLPGWAV

SEQ ID NO: 6722 - DNA, 51 bp, homo sapiens; identical to SEQ ID NO: 4618

SEQ ID NO: 6723 - protein, 41 aa, homo sapiens; identical to SEQ ID NO: 4619

SEQ ID NO: 6724 - DNA, 126 bp, homo sapiens; identical to SEQ ID NO: 4620

SEQ ID NO: 6725 - protein, 13 aa, homo sapiens
MGLPRARRWQPGA

SEQ ID NO: 6726 - DNA, 42 bp, homo sapiens; identical to SEQ ID NO: 4622

SEQ ID NO: 6727 - protein, 36 aa, homo sapiens; identical to SEQ ID NO: 4623

SEQ ID NO: 6728 - DNA, 111 bp, homo sapiens; identical to SEQ ID NO: 4624

SEQ ID NO: 6729 - protein, 22 aa, homo sapiens
MDQGVEGGGCGPGVGRQSACSL

SEQ ID NO: 6730 - DNA, 69 bp, homo sapiens; identical to SEQ ID NO: 4146

SEQ ID NO: 6731 - protein, 28 aa, homo sapiens
MKDGKEGYRDRGRVGLRIARAAWHTVLG

SEQ ID NO: 6732 - DNA, 87 bp, homo sapiens; identical to SEQ ID NO: 4148

SEQ ID NO: 6733 - protein, 41 aa, homo sapiens; identical to SEQ ID NO: 4149

SEQ ID NO: 6734 - DNA, 126 bp, homo sapiens; identical to SEQ ID NO: 4150

SEQ ID NO: 6735 - protein, 16 aa, homo sapiens
MILFPLDPAPLVPFSL

SEQ ID NO: 6736 - DNA, 51 bp, homo sapiens; identical to SEQ ID NO: 4152

SEQ ID NO: 6737 - protein, 22 aa, homo sapiens
MDQGVEGGGCGPGVGRQSACSL

SEQ ID NO: 6738 - DNA, 69 bp, homo sapiens; identical to SEQ ID NO: 4146

SEQ ID NO: 6739 - protein, 28 aa, homo sapiens
MKDGKEGYRDRGRVGLRIARAAWHTVLG

SEQ ID NO: 6740 - DNA, 87 bp, homo sapiens; identical to SEQ ID NO: 4148

SEQ ID NO: 6741 - protein, 41 aa, homo sapiens; identical to SEQ ID NO: 4149

SEQ ID NO: 6742 - DNA, 126 bp, homo sapiens; identical to SEQ ID NO: 4150

SEQ ID NO: 6743 - protein, 16 aa, homo sapiens
MILFPLDPAPLVPFSL

SEQ ID NO: 6744 - DNA, 51 bp, homo sapiens; identical to SEQ ID NO: 4152

SEQ ID NO: 6745 - protein, 18 aa, homo sapiens
MIQMSNCLYLTLFVYLQK

SEQ ID NO: 6746 - DNA, 57 bp, homo sapiens; identical to SEQ ID NO: 5458

SEQ ID NO: 6747 - protein, 4 aa, homo sapiens
MVKL

SEQ ID NO: 6748 - DNA, 15 bp, homo sapiens
atggtgaagttataa

SEQ ID NO: 6749 - protein, 15 aa, homo sapiens
MVQNVRRCYTPSWGR

SEQ ID NO: 6750 - DNA, 48 bp, homo sapiens; identical to SEQ ID NO: 5462

SEQ ID NO: 6751 - protein, 15 aa, homo sapiens
MMLHFGTPFPCSGRM

SEQ ID NO: 6752 - DNA, 48 bp, homo sapiens; identical to SEQ ID NO: 5464

SEQ ID NO: 6753 - protein, 22 aa, homo sapiens
MDQGVEGGGCGPGVGRQSACSL

SEQ ID NO: 6754 - DNA, 69 bp, homo sapiens; identical to SEQ ID NO: 4146

SEQ ID NO: 6755 - protein, 28 aa, homo sapiens
MKDGKEGYRDRGRVGLRIARAAWHTVLG

SEQ ID NO: 6756 - DNA, 87 bp, homo sapiens; identical to SEQ ID NO: 4148

SEQ ID NO: 6757 - protein, 41 aa, homo sapiens; identical to SEQ ID NO: 4149

SEQ ID NO: 6758 - DNA, 126 bp, homo sapiens; identical to SEQ ID NO: 4150

SEQ ID NO: 6759 - protein, 16 aa, homo sapiens
MILFPLDPAPLVPFSL

SEQ ID NO: 6760 - DNA, 51 bp, homo sapiens; identical to SEQ ID NO: 4152

SEQ ID NO: 6761 - protein, 22 aa, homo sapiens
MDQGVEGGGCGPGVGRQSACSL

SEQ ID NO: 6762 - DNA, 69 bp, homo sapiens; identical to SEQ ID NO: 4146

SEQ ID NO: 6763 - protein, 28 aa, homo sapiens
MKDGKEGYRDRGRVGLRIARAAWHTVLG

SEQ ID NO: 6764 - DNA, 87 bp, homo sapiens; identical to SEQ ID NO: 4148

SEQ ID NO: 6765 - protein, 41 aa, homo sapiens; identical to SEQ ID NO: 4149

SEQ ID NO: 6766 - DNA, 126 bp, homo sapiens; identical to SEQ ID NO: 4150

SEQ ID NO: 6767 - protein, 16 aa, homo sapiens
MILFPLDPAPLVPFSL

SEQ ID NO: 6768 - DNA, 51 bp, homo sapiens; identical to SEQ ID NO: 4152

SEQ ID NO: 6769 - protein, 23 aa, homo sapiens
MCGNIFFLFLRWGLTLLPRLATS

SEQ ID NO: 6770 - DNA, 72 bp, homo sapiens; identical to SEQ ID NO: 5850

SEQ ID NO: 6771 - protein, 36 aa, homo sapiens; identical to SEQ ID NO: 5851

SEQ ID NO: 6772 - DNA, 111 bp, homo sapiens; identical to SEQ ID NO: 5852

SEQ ID NO: 6773 - protein, 9 aa, homo sapiens
MSPELVSNS

SEQ ID NO: 6774 - DNA, 30 bp, homo sapiens; identical to SEQ ID NO: 5854

SEQ ID NO: 6775 - protein, 40 aa, homo sapiens [sequence omitted]

SEQ ID NO: 6776 - DNA, 123 bp, homo sapiens; identical to SEQ ID NO: 5856

SEQ ID NO: 6777 - protein, 77 aa, homo sapiens [sequence omitted]

SEQ ID NO: 6778 - DNA, 234 bp, homo sapiens
atgttaaccagagagctgggagggcaaatccctggtatccagaagctgaatagcacttctgttccctcactgtatgctattgagtgtgttggcccagcatggtggaaacaccgcattcccaggctgagcacctcatgcttctgcagagaaaatgcttttccgcctcagcttgtgtcacgccagatgcactctgatctcagagggaaatgtgtgctactggtaattaataaataa

SEQ ID NO: 6779 - protein, 17 aa, homo sapiens
MLLSVLAQHGGNTAFPG

SEQ ID NO: 6780 - DNA, 54 bp, homo sapiens
atgctattgagtgtgttggcccagcatggtggaaacaccgcattcccaggctga

SEQ ID NO: 6781 - protein, 31 aa, homo sapiens
MVETPHSQAEHLMLLQRKCFSASACVTPDAL

SEQ ID NO: 6782 - DNA, 96 bp, homo sapiens
atggtggaaacaccgcattcccaggctgagcacctcatgcttctgcagagaaaatgcttttccgcctcagcttgtgtcacgccagatgcactctga

SEQ ID NO: 6783 - protein, 23 aa, homo sapiens
MLFRLSLCHARCTLISEGNVCYW

SEQ ID NO: 6784 - DNA, 72 bp, homo sapiens
atgcttttccgcctcagcttgtgtcacgccagatgcactctgatctcagagggaaatgtgtgctactggtaa

SEQ ID NO: 6785 - protein, 12 aa, homo sapiens
MYLKCVCFFYYL

SEQ ID NO: 6786 - DNA, 39 bp, homo sapiens
atgtatcttaaatgtgtctgctttttctattacctgtaa

SEQ ID NO: 6787 - protein, 19 aa, homo sapiens
MCLLFLLPVIILLVMTQYL

SEQ ID NO: 6788 - DNA, 60 bp, homo sapiens
atgtgtctgctttttctattacctgtaataatcttgttagtaatgacacaatatttatga

SEQ ID NO: 6789 - protein, 25 aa, homo sapiens
MKCSQYAREEERGREKRRRKVMSER

SEQ ID NO: 6790 - DNA, 78 bp, homo sapiens
atgaagtgctctcaatatgctagggaagaagaaagagggagagagaaaagaagaagaaaggtgatgtctgagaggtga

SEQ ID NO: 6791 - protein, 15 aa, homo sapiens
MLGKKKEGERKEEER

SEQ ID NO: 6792 - DNA, 48 bp, homo sapiens
atgctagggaagaagaaagagggagagagaaaagaagaagaaaggtga

SEQ ID NO: 6793 - protein, 14 aa, homo sapiens
MENIFGVLVAFFTR

SEQ ID NO: 6794 - DNA, 45 bp, homo sapiens
atggaaaacatttttggagtgctggttgctttttttaccagatga

SEQ ID NO: 6795 - protein, 8 aa, homo sapiens
MYSPESMF

SEQ ID NO: 6796 - DNA, 27 bp, homo sapiens
atgtattccccagaaagtatgttttaa

SEQ ID NO: 6797 - protein, 25 aa, homo sapiens
MHQSALCKMHQSALCKTHQSAGFQK

SEQ ID NO: 6798 - DNA, 78 bp, homo sapiens
atgcaccaatcagcgctctgtaaaatgcaccaatcagcactctgtaaaacgcaccaatcagcaggattccaaaagtag

SEQ ID NO: 6799 - protein, 63 aa, homo sapiens
MEHGRGPQGNKSWPPPASTWGSLPCCGSCPFALRNKPCYRSLFESVPSLRAVNSHREGLQLHS

SEQ ID NO: 6800 - DNA, 192 bp, homo sapiens
atggaacatgggaggggaccacaagggaataaaagctggccaccaccagccagcacctggggttctcttccatgctgtggaagctgtccttttgctcttcgcaataaaccttgctaccgctcactctttgagtccgtgccatctttaagagctgttaacagtcaccgggaaggtctgcagcttcattcttga

SEQ ID NO: 6801 - protein, 112 aa, homo sapiens [sequence omitted]

SEQ ID NO: 6802 - DNA, 339 bp, homo sapiens
atggcgaccccgggcatgagctggcagcagcactattacggcggctcggcggccaaattcgcgccctcgccggccaccgcacagctggctgggcacagcatggactacagccaggagatgcacctgaaaatgagcaagaaaatcgcccagctcaccaaggtaaggggggcagcgacggggcaggtggcgaccccgtgcgggccgcgccggactcacctgtctccccgggaggcagtgcgccctgcgcccgcagcgaggggaactctactcctccgccgaagcaacagccggagacacctccaaaaccctgcaaactttggtggaacgctggcaacatga

SEQ ID NO: 6803 - protein, 4 aa, homo sapiens
MNLS

SEQ ID NO: 6804 - DNA, 15 bp, homo sapiens
atgaatttaagctag

SEQ ID NO: 6805 - protein, 15 aa, homo sapiens
MHLPGLHEASHYSTI

SEQ ID NO: 6806 - DNA, 48 bp, homo sapiens
atgcatctgccagggctccacgaggcatcacactacagtaccatttga

SEQ ID NO: 6807 - protein, 4 aa, homo sapiens
MTRN

SEQ ID NO: 6808 - DNA, 15 bp, homo sapiens
atgactcggaattaa

SEQ ID NO: 6809 - protein, 36 aa, homo sapiens
MITWATFSVLCKCVMTNQPGRPRDLFLEIGNFHLCL

SEQ ID NO: 6810 - DNA, 111 bp, homo sapiens
atgattacctgggcaaccttttctgtgctatgtaaatgtgtaatgactaatcaaccaggacggccaagggatttgtttctagagataggcaattttcatttgtgcctgtga

SEQ ID NO: 6811 - protein, 4 aa, homo sapiens
MCND

SEQ ID NO: 6812 - DNA, 15 bp, homo sapiens
atgtgtaatgactaa

SEQ ID NO: 6813 - protein, 14 aa, homo sapiens
MMDQNKRRNHFTHA

SEQ ID NO: 6814 - DNA, 45 bp, homo sapiens
atgatggaccaaaacaaaagaagaaatcatttcactcatgcttag

SEQ ID NO: 6815 - protein, 4 aa, homo sapiens
MCMR

SEQ ID NO: 6816 - DNA, 15 bp, homo sapiens
atgtgcatgcgttga

SEQ ID NO: 6817 - protein, 110 aa, homo sapiens [sequence omitted]

SEQ ID NO: 6818 - DNA, 333 bp, homo sapiens
atgagcagcggctacagcagcctggaggaggacgccgaggacttcttcttcaccgccaggacctccttcttcaggagagcgccccagggcaagccccgctccggccaacaagtgagtggcgcgcggcgggcgctgcagcccgcgccccagagttccggggaacccgccagcccgcgccccctgcctccacgtgtctctgcggggcgctcgggggatgctcgccgggaaggaggagcgggccgagaagtggcttctgccttttcgggtcccgggaacgtgcctggagcttgtgcgtgtaggcgagggaaggcggaggaagggcggggaggctga

SEQ ID NO: 6819 - protein, 114 aa, homo sapiens [sequence omitted]

SEQ ID NO: 6820 - DNA, 345 bp, homo sapiens
atgctcgccgggaaggaggagcgggccgagaagtggcttctgccttttcgggtcccgggaacgtgcctggagcttgtgcgtgtaggcgagggaaggcggaggaagggcggggaggctgagggccggcttctgccttccgcgccagatggcctctgcagctccgcctcgggctgccgcctgcggggagcagccccggagccagcaggcgtccccgggccactcccccaggtttccccttcgcgtccccgctgggtcgacggtcgggttcgcgcgcctgtccttcctgttagtcagcttactcatctgtggcccccagagtggcttgggtcaacgtgtaatagctag

SEQ ID NO: 6821 - protein, 72 aa, homo sapiens
MASAAPPRAAACGEQPRSQQASPGHSPRFPLRVPAGSTVGFARLSFLLVSLLICGPQSGLGQRVIARGGRVT

SEQ ID NO: 6822 - DNA, 219 bp, homo sapiens
atggcctctgcagctccgcctcgggctgccgcctgcggggagcagccccggagccagcaggcgtccccgggccactcccccaggtttccccttcgcgtccccgctgggtcgacggtcgggttcgcgcgcctgtccttcctgttagtcagcttactcatctgtggcccccagagtggcttgggtcaacgtgtaatagctaggggtggccgggtgacctga

SEQ ID NO: 6823 - protein, 49 aa, homo sapiens
MFCKQAPMLNTSQRQLTFSPVSSFFGGSMPWEARVGKRWEGNLCQFRQL

SEQ ID NO: 6824 - DNA, 150 bp, homo sapiens
atgttttgcaaacaagctcctatgctaaatactagccagcgacagctaaccttttcgccggtttcttccttttttggaggcagcatgccgtgggaagcacgagttgggaaaagatgggaagggaacttgtgccagtttcgccagctgtag

SEQ ID NO: 6825 - protein, 30 aa, homo sapiens
MALCCESPRGGSSNQGLSFCAVEKPGETLK

SEQ ID NO: 6826 - DNA, 93 bp, homo sapiens
atggcgctttgctgtgaatctccgcggggaggctcttccaaccaggggctgagcttctgcgctgtggagaagccaggtgagacactgaaataa

SEQ ID NO: 6827 - protein, 19 aa, homo sapiens
MTASRTLSERDSTPNLTLL

SEQ ID NO: 6828 - DNA, 60 bp, homo sapiens
atgaccgcatcgaggacgctttccgaaagggatagcaccccaaatctcactctattgtaa

SEQ ID NO: 6829 - protein, 6 aa, homo sapiens
MVSFLC

SEQ ID NO: 6830 - DNA, 21 bp, homo sapiens
atggtatcctttttgtgttaa

SEQ ID NO: 6831 - protein, 7 aa, homo sapiens
MVKLRLY

SEQ ID NO: 6832 - DNA, 24 bp, homo sapiens
atggtgaaactccgtctctactaa

SEQ ID NO: 6833 - protein, 87 aa, homo sapiens
MGFQKLTYEKSCCVPNCDNNQVASHGPHRNRAESKTPSTARKARTTATLFRTKDPLRTRTSFPLHSSVLCAERTIRYSQESRALPHP

SEQ ID NO: 6834 - DNA, 264 bp, homo sapiens
atgggctttcagaaattaacctatgagaagagctgctgtgtccccaactgtgataacaatcaagttgcttcccacggcccacacagaaaccgcgcagaaagcaaaacaccctccaccgcgaggaaggctagaaccacggcaacgcttttcagaaccaaagaccctctgcgaaccagaacttcatttcctcttcattcatctgtgctgtgtgctgaaaggaccatccgctattcccaagaaagcagggccctccctcatccatag

SEQ ID NO: 6835 - protein, 88 aa, homo sapiens
MRRAAVSPTVITIKLLPTAHTETAQKAKHPPPRGRLEPRQRFSEPKTLCEPELHFLFIHLCCVLKGPSAIPKKAGPSLIHSVNVECSH

SEQ ID NO: 6836 - DNA, 267 bp, homo sapiens
atgagaagagctgctgtgtccccaactgtgataacaatcaagttgcttcccacggcccacacagaaaccgcgcagaaagcaaaacaccctccaccgcgaggaaggctagaaccacggcaacgcttttcagaaccaaagaccctctgcgaaccagaacttcatttcctcttcattcatctgtgctgtgtgctgaaaggaccatccgctattcccaagaaagcagggccctccctcatccatagcgtcaacgttgagtgttcacactag

SEQ ID NO: 6837 - protein, 4 aa, homo sapiens
MPSS

SEQ ID NO: 6838 - DNA, 15 bp, homo sapiens
atgccatcatcttag

SEQ ID NO: 6839 - protein, 36 aa, homo sapiens
MVKNPVGWMQWLMPIIPTLWEAEVGGLLEPKSLRPA

SEQ ID NO: 6840 - DNA, 111 bp, homo sapiens
atggtcaagaatcccgtgggctggatgcagtggctcatgcctataatcccaacactttgggaggctgaggtaggaggactgcttgagcccaagagtttgagaccagcctga

SEQ ID NO: 6841 - protein, 123 aa, homo sapiens
MKLPSTRPRLAQVGRGPCARAGPGRALAAALGDADLSPRSPGAQSPARSSQVRALEARTRWSGRGGPRRASPRASKEPGSPVPRSRPGAPSEAKRQWRTGEKVCACHRIAASRGPRLSLRISF

SEQ ID NO: 6842 - DNA, 372 bp, homo sapiens
atgaaacttccctccacgcgcccccgccttgcccaagtggggcgggggccctgtgcccgggccggaccggggcgggctctggcggcggctctgggagacgcagacctgagcccgcggagcccgggtgcgcagagtcccgcccgcagcagccaggtgagggcgctggaggccaggactcggtggagcggccgcggcggaccgcggagagcaagtccccgggcctccaaggagccagggtcgcccgtgccccgctcgcgccccggggcgccctccgaggcaaagaggcagtggaggacaggagaaaaggtctgcgcctgccacagaatcgccgcgagtcggggtcccaggctaagtctcaggatctctttttaa

SEQ ID NO: 6843 - protein, 11 aa, homo sapiens
MLGCSLKGTLV

SEQ ID NO: 6844 - DNA, 36 bp, homo sapiens
atgcttgggtgttcactgaaaggcaccttggtttga

SEQ ID NO: 6845 - protein, 29 aa, homo sapiens
MPVTTVYRILTPPSLSFLIRKMGSVMLPH

SEQ ID NO: 6846 - DNA, 90 bp, homo sapiens
atgccagttacaactgtgtacaggatcttaacccctcccagtctcagtttcctcatcaggaaaatgggttctgtgatgcttcctcactag

SEQ ID NO: 6847 - protein, 5 aa, homo sapiens
MVRLK

SEQ ID NO: 6848 - DNA, 18 bp, homo sapiens
atggtgaggcttaaatga

SEQ ID NO: 6849 - protein, 44 aa, homo sapiens
MAAVAAAAREEAVPRSGAPSAAAESGSGPSWRTRTETSGSRTAT

SEQ ID NO: 6850 - DNA, 135 bp, homo sapiens
atggcggcggtagcagcggccgcccgagaggaggcggtgccgagatcgggggcgccgagcgcggcagcagagagcggtagcggcccgtcgtggcgcaccagaaccgaaaccagcggcagccgcacggccacttga

SEQ ID NO: 6851 - protein, 220 aa, homo sapiens
MGAKQSGPAAANGRTRAYSGSDLPSSSSGGANGTAGGGGGARAAAAGRFPAQVPSAHQPSASGGAAAAAAAPAAPAAPRSRSLGGAVGSVASGARAAQSPFSIPNSSSGPYGSQDSVHSSPEDGGGGRDRPVGGSPGGPRLVIGSLPAHLSPHMFGGTDPSPRTRARSSRGCTWAVAAGYFYPSPFLLLPGRRGLPPGPARVGLHPGRNPALNTGGAATA

SEQ ID NO: 6852 - DNA, 663 bp, homo sapiens
atgggcgccaaacagagcggcccggccgccgctaacggccgcacgcgcgcgtactcgggctcggatctaccttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggtacggacccctctccgcgcacccgcgctcggtcctcccgcggctgcacgtgggccgtggccgccggctatttttacccttctccttttctccttctgccggggcgccgggggctgcctcccggaccagcccgcgtcggtctccatcctggaagaaacccggcgcttaacaccggcggtgccgctaccgcatag

SEQ ID NO: 6853 - protein, 110 aa, homo sapiens
MGPRAAAGALGPPPRGGSRLRCPARTSPAPPAAPRRPRRPRQPRRPRAAAPSAGPWGAWRRGPARRSPPSASRTAAAARTARRTRCTAALRTAAAAGTGRWAGAPAGRAW

SEQ ID NO: 6854 - DNA, 333 bp, homo sapiens
atgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtga

SEQ ID NO: 6855 - protein, 57 aa, homo sapiens [sequence omitted]

SEQ ID NO: 6856 - DNA, 174 bp, homo sapiens
atgactggagcaaatgttgttttacaacaaaccgacgaaacagcccttgtggttgtggtttttagtaccaggaagtcaggaggagaccagttgctaaatgtagttctatctggggactcgagtggggaacagtttttaaaggccaaaagtcaaagcgtctcaaatgaacactga

SEQ ID NO: 6857 - protein, 30 aa, homo sapiens
MREGRPWPWGRRELLCLHRSPCAALMCCAR

SEQ ID NO: 6858 - DNA, 93 bp, homo sapiens
atgagggaagggcggccgtggccctgggggcggcgggagctgctttgcctccaccgatctccctgtgcggccctcatgtgctgtgctcgctga

SEQ ID NO: 6859 - protein, 88 aa, homo sapiens
MEKARRGGDGVPRGPVLHIVVVGFHHKKGCQVRKGPAPAPSRSGVRPFRGPPALLLCAQLASCSPPHSACDPSPLNLTPFAAPPTRPT

SEQ ID NO: 6860 - DNA, 267 bp, homo sapiens
atggagaaggccaggagaggcggggatggcgtcccccgggggcccgtactgcacatcgtggtggtcggatttcaccacaagaagggctgccaggtgaggaaagggcccgcccccgcccccagccgttcgggcgttcgccccttccggggcccccctgccctgcttctgtgtgctcagctcgcgtcgtgcagtcctccccacagcgcctgcgacccttcgcctctcaacctgactccttttgcagctcctcccacccgccccacatga

SEQ ID NO: 6861 - protein, 23 aa, homo sapiens
MASPGGPYCTSWWSDFTTRRAAR

SEQ ID NO: 6862 - DNA, 72 bp, homo sapiens
atggcgtcccccgggggcccgtactgcacatcgtggtggtcggatttcaccacaagaagggctgccaggtga

SEQ ID NO: 6863 - protein, 16 aa, homo sapiens
MKPSPHNLFLLPLKNG

SEQ ID NO: 6864 - DNA, 51 bp, homo sapiens
atgaagcccagcccccacaacctcttccttctgcccctgaaaaatggttga

SEQ ID NO: 6865 - protein, 20 aa, homo sapiens
MAAAAASTGRWAGAPAGRAW

SEQ ID NO: 6866 - DNA, 63 bp, homo sapiens
atggcggcggcggcggccagcaccggccggtgggcgggagccccggcgggccgcgcctggtga

SEQ ID NO: 6867 - protein, 68 aa, homo sapiens
MFGGTDPSPRARARFSRGCTWAVAAGYFYRSPFLLPPGRRGLLPGPARQGLLPGPARAGLHPGKKPGT

SEQ ID NO: 6868 - DNA, 207 bp, homo sapiens
atgtttggaggtacggacccctctccacgcgcccgcgctcggttctcccgcggctgcacgtgggccgtggccgccggctatttttaccgttctccttttctccttccgccggggcgccgggggctgcttcccggcccagcccgccaggggctgcttcccggcccagcccgcgccggtctccatcctgggaagaaacccggcacgtaa

SEQ ID NO: 6869 - protein, 9 aa, homo sapiens
MLFYSKPTK

SEQ ID NO: 6870 - DNA, 30 bp, homo sapiens
atgttgttttacagcaaacccacgaaatag

SEQ ID NO: 6871 - protein, 13 aa, homo sapiens
MNSELPSLDRLLI

SEQ ID NO: 6872 - DNA, 42 bp, homo sapiens
atgaactctgagttaccatctttggaccgacttttaatataa

SEQ ID NO: 6873 - protein, 15 aa, homo sapiens
MCQPQVTAMTRVRQA

SEQ ID NO: 6874 - DNA, 48 bp, homo sapiens
atgtgccagccccaggtaacagccatgacccgggtaagacaagcttaa

SEQ ID NO: 6875 - protein, 97 aa, homo sapiens
MGEFASVKAAAATSFFQTRRDGWSCWSCSSRLATRHPRSISLGSAEAPSPQQQPTMGLPVGGVKPSVFNSGIMGSCLADVEHVVPKSPRCTATRAGP

SEQ ID NO: 6876 - DNA, 294 bp, homo sapiens
atgggagagtttgcttctgtgaaagcagcagcagccacctccttcttccagactcgacgtgatggctggagctgctggagctgcagcagccgccttgcaacccgacatccacgcagcattagtctcgggagtgctgaggctccaagtccacagcagcagcccaccatgggcctcccggtgggaggggtcaagcccagtgtgttcaactctgggatcatgggttcctgtcttgctgacgtagaacacgttgttcccaagtcaccccggtgcacagccaccagagccggcccttga

SEQ ID NO: 6877 - protein, 59 aa, homo sapiens
MAGAAGAAAAALQPDIHAALVSGVLRLQVHSSSPPWASRWEGSSPVCSTLGSWVPVLLT

SEQ ID NO: 6878 - DNA, 180 bp, homo sapiens
atggctggagctgctggagctgcagcagccgccttgcaacccgacatccacgcagcattagtctcgggagtgctgaggctccaagtccacagcagcagcccaccatgggcctcccggtgggaggggtcaagcccagtgtgttcaactctgggatcatgggttcctgtcttgctgacgtag

SEQ ID NO: 6879 - protein, 378 aa, homo sapiens [sequence omitted]

SEQ ID NO: 6880 - DNA, 1137 bp, homo sapiens
atggtcacaggtgtggcggcaggaacccatcagggactcccctccaggccctgggaggctcccggatcctggcacctcctgggggcttgtgagtgcaggaaggccctaggtacacaggcgcccctccatagacctcttcaccccacagcgcctcagggccccacacttacccggagaaccttgcctgagggctggggcctctgggccaggttgcggtcagggcctggccagcggcccgcacctcccagcggggcaggtcgtgggctgaggtgcggcagacgcctcgagcctaaaaaaataaaggtgaccggagaagccgatcttgctaagggccgggaagggaaagtggctggtgtcgggggtccccagcagccacaaggagccgggcaaggagccgggcgggcagttccggccctggccccgcaccgcgggttaggccggtgggggtcagtccagggcacgcccccacccccgccagttctcagccagcgaggccgcgcacagtcgcacctgcccactgcggccgcaccgggaagccgcagcccggaccccgcgcgcctcacctgtgtccccgcgtctctgggctccgcaggggccgggcctgggcagggggcgagggcgggggcggggccacgcggggaagggctggagccagcagcggggaggtgtctggtccggaaggtggcggggctagagtggtgggcggggccatgcggggaaggtctggggccagtagcggggaggcgcctggtccagaaggggccgggggcggggcgagagggggcggggcgagaggggggcggggccatgcggggaagggctagggccgcagcggggaggcgcctggtccagaaggggctgggggcggggcgagtggggccgggagacgcctcgtccggaaggggccggggctctaggccgcccagccccggggccaggaggtgcaggggggccgggcagggtctgcagagggctgcactttctgcccccagacggctcgcccttggggcctccagggtccccgacctccttcacccctgctggagcccctccgacgccacgagcctcccagccccgcggggacccggctgcagcgccgacgagactgcgggaggctctgggcgcgtctgggcctga

SEQ ID NO: 6881 - protein, 16 aa, homo sapiens
MCLLLAGSTFVCLPLR

SEQ ID NO: 6882 - DNA, 51 bp, homo sapiens
atgtgccttcttctggctggaagcacgtttgtttgcttaccgctcaggtga

SEQ ID NO: 6883 - protein, 9 aa, homo sapiens
MRKASLITS

SEQ ID NO: 6884 - DNA, 30 bp, homo sapiens
atgagaaaagcaagtctcatcacatcttga

SEQ ID NO: 6885 - protein, 35 aa, homo sapiens
MGANYMFPHTQSLCLWLNLERTTPVVVWKLPSISS

SEQ ID NO: 6886 - DNA, 108 bp, homo sapiens
atgggggcgaattacatgtttccacacacacagtctctttgtctctggctaaatctagaaagaacaactccagttgtggtttggaaattacctagcatcagcagctaa

SEQ ID NO: 6887 - protein, 18 aa, homo sapiens
MIQYIPPLTPTSTSVHCV

SEQ ID NO: 6888 - DNA, 57 bp, homo sapiens
atgattcagtacatcccaccactaactcccacatcgacctcagttcactgtgtttga

SEQ ID NO: 6889 - protein, 18 aa, homo sapiens
MGSKGSLGQVIGDHPLPE

SEQ ID NO: 6890 - DNA, 57 bp, homo sapiens
atgggcagcaagggcagccttggacaggtgataggtgaccatccccttccagagtga

SEQ ID NO: 6891 - protein, 27 aa, homo sapiens
MRARGLVCAPSLRSLGRELPPSGRDPE

SEQ ID NO: 6892 - DNA, 84 bp, homo sapiens
atgagggccagaggcctggtatgtgcaccctcattgcggagcctgggtcgggaactccctccttcgggtcgggacccggagtga

SEQ ID NO: 6893 - protein, 50 aa, homo sapiens
MCTLIAEPGSGTPSFGSGPGVKNRLCCELLRTAPPGGARTRRALVENVGI

SEQ ID NO: 6894 - DNA, 153 bp, homo sapiens
atgtgcaccctcattgcggagcctgggtcgggaactccctccttcgggtcgggacccggagtgaaaaaccggctctgctgcgagctgttgagaacggcgccaccagggggcgctcgaacgcgccgcgctttggtggaaaatgtggggatttga

SEQ ID NO: 6895 - protein, 23 aa, homo sapiens
MWGFDLVGTGAPGASGHGIRGGF

SEQ ID NO: 6896 - DNA, 72 bp, homo sapiens
atgtggggatttgaccttgtcggaacaggagcacctggggcttcaggtcacgggatccgtggcggattctga

SEQ ID NO: 6897 - protein, 42 aa, homo sapiens
MRTDCGTGRTRGFVSADSSVPRGAASSAFSSGSCAPGMNQGF

SEQ ID NO: 6898 - DNA, 129 bp, homo sapiens
atgcgcactgactgcggaactgggcgaacccgggggttcgtttctgctgactccagtgtcccgagaggcgccgcttcttccgctttctcgtcaggctcctgcgccccaggcatgaaccaaggtttctga

SEQ ID NO: 6899 - protein, 93 aa, homo sapiens [sequence omitted]

SEQ ID NO: 6900 - DNA, 282 bp, homo sapiens
atggcggggccgcgggtggaggtcgatggcagcatcatggaaggggtgagtacagagcgaagcggccggggctgcagcctaactaaggaggggagctctcaccaccggtgtgcttacttctcttctccctgtaccccaacctttgcagggcggccagatcctgagagtctctacggccttgagctgtctcctaggcctccccttgcgggtgcagaagatccgagccggccggagcacgccaggcctgaggtaaatctggctggagggggagttgggccgtga

SEQ ID NO: 6901 - protein, 7 aa, homo sapiens
MAASWKG

SEQ ID NO: 6902 - DNA, 24 bp, homo sapiens
atggcagcatcatggaaggggtga

SEQ ID NO: 6903 - protein, 16 aa, homo sapiens
MGDPGRGTLPGRWPGL

SEQ ID NO: 6904 - DNA, 51 bp, homo sapiens
atgggcgatccagggcggggcactctgcctgggcggtggcctgggttgtaa

SEQ ID NO: 6905 - protein, 33 aa, homo sapiens
MGLYKGAVPRAPAQLEPDSGVDKWRVCCDPEGR

SEQ ID NO: 6906 - DNA, 102 bp, homo sapiens
atgggcctatacaagggggcggttccgcgcgcgcccgcccagttggagccagacagcggggtggacaagtggcgtgtgtgctgcgaccccgagggaagatga

SEQ ID NO: 6907 - protein, 80 aa, homo sapiens
MNGTRNWCTLVDVHPEDQAAVRKSALAVFSVLYSRFLSPPLPCPAPCWLTSPGARLARSALRGASLFLFFCLRRAVGVAG

SEQ ID NO: 6908 - DNA, 243 bp, homo sapiens
atgaacgggacgcggaactggtgtaccctggtggacgtgcacccagaggaccaggcggcggtaagaaaaagcgctctcgctgtcttctccgttttgtattcccggtttctaagtccgccccttccgtgccccgcgccgtgttggctgacatcacctggtgcccggctcgcgcggtcagccctgcgcggcgcttctctctttttattcttttgcctgcgacgggcagtgggagtcgcggggtga

SEQ ID NO: 6909 - protein, 20 aa, homo sapiens
MSSSDWVPERLWTLCPAEEA

SEQ ID NO: 6910 - DNA, 63 bp, homo sapiens
atgagctcaagcgactgggtccctgagcgcctttggacgttgtgtcctgccgaggaggcttag

SEQ ID NO: 6911 - protein, 29 aa, homo sapiens
MVLWMISNKKNGRVNYRAWTGGRGASRGR

SEQ ID NO: 6912 - DNA, 90 bp, homo sapiens
atggtgctttggatgatcagtaacaagaaaaatggtagagtaaattacagggcttggactggagggcggggggcaagtaggggacggtag

SEQ ID NO: 6913 - protein, 36 aa, homo sapiens
MGEGRAGRGILSLPGSPSRRGEGVSLTGRLPEGAGK

SEQ ID NO: 6914 - DNA, 111 bp, homo sapiens
atgggggaggggagagcagggagggggatcctgagcctaccgggaagtccctccaggcggggtgaaggggtgtccctgacaggcagactcccggagggggctgggaagtaa

SEQ ID NO: 6915 - protein, 13 aa, homo sapiens
MIGASPIVQFVCV

SEQ ID NO: 6916 - DNA, 42 bp, homo sapiens
atgatcggagcctcccccatagtccagtttgtgtgtgtttaa

SEQ ID NO: 6917 - protein, 18 aa, homo sapiens
MWERQDDLSVVSLINVTG

SEQ ID NO: 6918 - DNA, 57 bp, homo sapiens
atgtgggaacgacaggatgatctcagtgttgtaagtttaataaatgtcactggttag

SEQ ID NO: 6919 - protein, 5 aa, homo sapiens
MISVL

SEQ ID NO: 6920 - DNA, 18 bp, homo sapiens
atgatctcagtgttgtaa

SEQ ID NO: 6921 - protein, 53 aa, homo sapiens [sequence omitted]

SEQ ID NO: 6922 - DNA, 162 bp, homo sapiens
atgcctagcaaaaccaagtacaaccttgtggacgatgggcacgacctgcggatccccttgcacaacgaggacgccttccagcacggcatctgctttgaggccaaggtgagggggctccggggagggtgctacctgtggtggcggttgggggggcatgtttga

SEQ ID NO: 6923 - protein, 24 aa, homo sapiens
MGTTCGSPCTTRTPSSTASALRPR

SEQ ID NO: 6924 - DNA, 75 bp, homo sapiens
atgggcacgacctgcggatccccttgcacaacgaggacgccttccagcacggcatctgctttgaggccaaggtga

SEQ ID NO: 6925 - protein, 17 aa, homo sapiens
MFERMGCTAVLDPELAG

SEQ ID NO: 6926 - DNA, 54 bp, homo sapiens
atgtttgagcggatgggatgcacagccgtcctggacccagagctggcgggctag

SEQ ID NO: 6927 - protein, 27 aa, homo sapiens
MHSRPGPRAGGLGRFGGLSLREGNSPF

SEQ ID NO: 6928 - DNA, 84 bp, homo sapiens
atgcacagccgtcctggacccagagctggcgggctaggccgatttgggggcctttctcttagggagggtaactctcccttctga

SEQ ID NO: 6929 - protein, 16 aa, homo sapiens
MLIFPYDSSPFPFSVL

SEQ ID NO: 6930 - DNA, 51 bp, homo sapiens
atgcttatattcccttatgactcttccccttttcctttttctgtcctatag

SEQ ID NO: 6931 - protein, 65 aa, homo sapiens
MTLPLFLFLSYRISLFSSLLIVSFAVQKRFSLTRYHLSIFFCSCNCPWGLSQKFFAKADVEKSTS

SEQ ID NO: 6932 - DNA, 198 bp, homo sapiens
atgactcttccccttttcctttttctgtcctataggattagcttattttctagtctgttgatagtttctttcgctgtgcagaagcgctttagtttaactaggtaccatttgtcaattttcttttgttcttgcaattgcccttggggacttagccaaaaattctttgccaaggctgatgttgagaagagcacttcctag

SEQ ID NO: 6933 - protein, 16 aa, homo sapiens
MLRRALPRFSSRIFIV

SEQ ID NO: 6934 - DNA, 51 bp, homo sapiens
atgttgagaagagcacttcctaggttttcttctagaatttttatagtttga

SEQ ID NO: 6935 - protein, 4 aa, homo sapiens
MSYI

SEQ ID NO: 6936 - DNA, 15 bp, homo sapiens
atgtcttacatttaa

SEQ ID NO: 6937 - protein, 185 aa, homo sapiens
MGRAGVVKGTGLGRSLGSFQSKREASDCLFSHQSRDRDPEVRFRPRPNSCTVRTGNGQGAAGTAAKGLRAYRTGRKGGGPHLAEMHGGQPLPLPPRGAGRTRQPPLPRLTGRNWDAADAELARPAARGTREPSRACSTRRPPARAPGPASLPASPPLPSASLRVWPLRPGDRRSACVRAPDFTSG

SEQ ID NO: 6938 - DNA, 558 bp, homo sapiens
atggggagggcaggcgtggtaaaaggtacaggtttgggaaggtcgctcggttccttccaatccaaacgagaggcttctgattgtttattctcacaccagagccgtgaccgagacccagaggtccgcttccggccacggccgaacagctgcaccgtgcgtaccgggaacggtcaaggcgcagctggaaccgctgcaaaaggcctccgggcgtaccggacaggtcgcaagggcgggggtccccacctagcggaaatgcacggaggccaacccctccccctgcccccgcgaggagcggggcggactcggcagccgccactccccaggctcacaggaagaaactgggacgctgcggacgcggaactggccagacccgcggcgcgtggcacgcgcgagccctcccgcgcatgctccacccgccggcctccagcccgcgccccgggccccgcctccctccctgcttctccccctctcccgtcagcctccctccgagtttggcccctccggccgggcgatcgacgttccgcgtgcgtgcgggcgcctgacttcacttccggctaa

SEQ ID NO: 6939 - protein, 45 aa, homo sapiens
MLHPPASSPRPGPRLPPCFSPSPVSLPPSLAPPAGRSTFRVRAGA

SEQ ID NO: 6940 - DNA, 138 bp, homo sapiens
atgctccacccgccggcctccagcccgcgccccgggccccgcctccctccctgcttctccccctctcccgtcagcctccctccgagtttggcccctccggccgggcgatcgacgttccgcgtgcgtgcgggcgcctga

SEQ ID NO: 6941 - protein, 162 aa, homo sapiens [sequence omitted]

SEQ ID NO: 6942 - DNA, 489 bp, homo sapiens
atggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtggtgagtcttccgcacgccgggcgggcgcgaagccggggaaagaagccgtccagccccggggctcggcctcgcgactcggggaagcgagatggcgagagggcagggctgggggttcgggcccagccgtgaagggaggcccggaagctgatggagggggaccttag

SEQ ID NO: 6943 - protein, 19 aa, homo sapiens
MARGQGWGFGPSREGRPGS

SEQ ID NO: 6944 - DNA, 60 bp, homo sapiens
atggcgagagggcagggctgggggttcgggcccagccgtgaagggaggcccggaagctga

SEQ ID NO: 6945 - protein, 77 aa, homo sapiens
MSHRPGVGGVSRLPSPSPGAAVGARPSPQVWARAPRSAPPQVLRLHGGVRDLWWPPRRFEDSVLRLPFNRRSAALKP

SEQ ID NO: 6946 - DNA, 234 bp, homo sapiens
atgagtcaccgcccgggagttgggggagtgagtaggctcccctcccccagccccggcgctgcagttggggcgcggccctctccacaggtgtgggcccgcgcgccccgctccgccccgccccaggtgcttcgtctccatggcggcgttagggatctttggtggcctccgaggaggtttgaagattctgtgctgagacttccttttaaccggaggagcgctgctctgaagccttga

SEQ ID NO: 6947 - protein, 18 aa, homo sapiens
MAALGIFGGLRGGLKILC

SEQ ID NO: 6948 - DNA, 57 bp, homo sapiens
atggcggcgttagggatctttggtggcctccgaggaggtttgaagattctgtgctga

SEQ ID NO: 6949 - protein, 11 aa, homo sapiens
MGPGGKGAGTG

SEQ ID NO: 6950 - DNA, 36 bp, homo sapiens
atggggcctggggggaagggtgcgggaactggatag

SEQ ID NO: 6951 - protein, 5 aa, homo sapiens
MSVSL

SEQ ID NO: 6952 - DNA, 18 bp, homo sapiens
atgagtgtttctttataa

SEQ ID NO: 6953 - protein, 32 aa, homo sapiens
MGFSLIPPSTHLRFRVHARDSPVGPQITTIRD

SEQ ID NO: 6954 - DNA, 99 bp, homo sapiens
atgggtttctctctcattccaccctccacccacctccggttccgcgtgcacgcgcgagatagtccagtgggcccacagataacgaccatcagagattaa

SEQ ID NO: 6955 - protein, 14 aa, homo sapiens
MSKETARSAQAGVG

SEQ ID NO: 6956 - DNA, 45 bp, homo sapiens
atgtccaaggagaccgccagaagtgcgcaagccggagtcggctag

SEQ ID NO: 6957 - protein, 11 aa, homo sapiens
MLRESSSTKGG

SEQ ID NO: 6958 - DNA, 36 bp, homo sapiens
atgctcagggagtcgtccagcactaaaggaggctaa

SEQ ID NO: 6959 - protein, 6 aa, homo sapiens
MAALEK

SEQ ID NO: 6960 - DNA, 21 bp, homo sapiens
atggcagcgcttgagaaatga

SEQ ID NO: 6961 - protein, 25 aa, homo sapiens
MSPAPHSPLLTDPASQAALIAPGPL

SEQ ID NO: 6962 - DNA, 78 bp, homo sapiens
atgtccccagctccccactctccgctcctgaccgacccggcctcccaggccgcgcttatagcgccggggcccttgtag

SEQ ID NO: 6963 - protein, 13 aa, homo sapiens
MFRTGRDGEPRES

SEQ ID NO: 6964 - DNA, 42 bp, homo sapiens
atgttcaggactggcagggatggggagcctcgggaatcttga

SEQ ID NO: 6965 - protein, 43 aa, homo sapiens [sequence omitted]

SEQ ID NO: 6966 - DNA, 132 bp, homo sapiens
atggggagcctcgggaatcttgaagggcagccgcttaattataacatgtccttgacgtttgcgctttccacagtgatacactttatctcctttattgatcatagagagtttttttttttaataaacttttag

SEQ ID NO: 6967 - protein, 7 aa, homo sapiens
MGDTHAG

SEQ ID NO: 6968 - DNA, 24 bp, homo sapiens
atgggggatacgcatgcaggttag

SEQ ID NO: 6969 - protein, 11 aa, homo sapiens
MGEPDLHVEKA

SEQ ID NO: 6970 - DNA, 36 bp, homo sapiens; identical to SEQ ID NO: 1562

SEQ ID NO: 6971 - protein, 36 aa, homo sapiens; identical to SEQ ID NO: 1563

SEQ ID NO: 6972 - DNA, 111 bp, homo sapiens; identical to SEQ ID NO: 1564

SEQ ID NO: 6973 - protein, 26 aa, homo sapiens
MRGGHGMGGAAVLPGGCRPRPGEGRG

SEQ ID NO: 6974 - DNA, 81 bp, homo sapiens; identical to SEQ ID NO: 1566

SEQ ID NO: 6975 - protein, 31 aa, homo sapiens; identical to SEQ ID NO: 1567

SEQ ID NO: 6976 - DNA, 96 bp, homo sapiens; identical to SEQ ID NO: 1568

SEQ ID NO: 6977 - protein, 160 aa, homo sapiens [sequence omitted]

SEQ ID NO: 6978 - DNA, 483 bp, homo sapiens
atggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcctccgccaagctggccttcggcagcgaggtcgagcccggggcgctgttggtgctgctgctgcgggcgggcgggcggggcgccgctgggcggaggaggggcgctgcggggcccgcggggctcttggggtggggcgggggtgggcgcagggcgccgccgcaccctcgccggtctgtcccgccggggccccgggccgcgggcggcgctgcggtcagctggggtggcagagagtgtttcgcctctaatcacgccaaaccctcgtccagtgtaggtggtaagagacgtcggggactgaggcctcttcccttaccagggacctaa

SEQ ID NO: 6979 - protein, 16 aa, homo sapiens
MTSLPHYQENWEFGIL

SEQ ID NO: 6980 - DNA, 51 bp, homo sapiens
atgaccagtctgccccactaccaggaaaattgggagtttgggatactgtag

SEQ ID NO: 6981 - protein, 18 aa, homo sapiens
MLQVSIPLGVVHGVSGRK

SEQ ID NO: 6982 - DNA, 57 bp, homo sapiens
atgcttcaggttagtatcccattgggtgtagttcatggggtaagtggtcgaaagtaa

SEQ ID NO: 6983 - protein, 14 aa, homo sapiens
MNNFVWAVKFVVRN

SEQ ID NO: 6984 - DNA, 45 bp, homo sapiens
atgaataactttgtatgggccgtgaagtttgttgtcaggaactag

SEQ ID NO: 6985 - protein, 11 aa, homo sapiens
MARAGARALGC

SEQ ID NO: 6986 - DNA, 36 bp, homo sapiens
atggcccgggctggggcccgggccctcggctgctga

SEQ ID NO: 6987 - protein, 6 aa, homo sapiens
MAPGGR

SEQ ID NO: 6988 - DNA, 21 bp, homo sapiens
atggccccggggggccgctag

SEQ ID NO: 6989 - protein, 101 aa, homo sapiens
MDVWMMWPAGSPMCKATFSCKVLGGCSHTPPPSRFWSGSSDPPSASALSPINARGSALPRRCACPTSVSLLEDWPARREAVYWQSPRGGSPTSAEWEDLQS

SEQ ID NO: 6990 - DNA, 306 bp, homo sapiens
atggatgtgtggatgatgtggcctgcggggtcacccatgtgcaaagcaactttttcctgcaaggttctgggtgggtgctctcatacacccccaccttcacgcttctggagcgggagttccgatcccccttctgcctcagctctctctcccattaacgcccgaggcagcgctcttccccgtagatgcgcttgccctacctcagtgtctctacttgaggactggccagcccgaagggaagcggtatactggcagtccccacgtggggggtctcccacatcagcagagtgggaggacctccagtcctga

SEQ ID NO: 6991 - protein, 10 aa, homo sapiens
MRLPYLSVST

SEQ ID NO: 6992 - DNA, 33 bp, homo sapiens
atgcgcttgccctacctcagtgtctctacttga

SEQ ID NO: 6993 - protein, 54 aa, homo sapiens [sequence omitted]

SEQ ID NO: 6994 - DNA, 165 bp, homo sapiens
atggacctggcccaaccctcacagccagtagacgagctggagctctcggtgctcgagcggcagccagaagagaacacgcctctcaatggtgccgacaaggtcttcccttctttggacgaggaggtccccccggccgaggtaaggtccccttggcgctggccctaa

SEQ ID NO: 6995 - protein, 18 aa, homo sapiens
MVPTRSSLLWTRRSPRPR

SEQ ID NO: 6996 - DNA, 57 bp, homo sapiens
atggtgccgacaaggtcttcccttctttggacgaggaggtccccccggccgaggtaa

SEQ ID NO: 6997 - protein, 54 aa, homo sapiens
MEPSHRDTFRPEQSPPQPLGSSNPSDPRGALGILVVRCGRCCLQRGIPEMEVVF

SEQ ID NO: 6998 - DNA, 165 bp, homo sapiens
atggagccgagtcaccgcgacacctttcggcccgagcagtcccctccccagcccctggggtcctccaacccctctgacccccgaggcgctttaggaatcctagtggtgaggtgtggccgctgctgtcttcagagaggtattccggagatggaagtagttttttaa

SEQ ID NO: 6999 - protein, 5 aa, homo sapiens
MRMTN

SEQ ID NO: 7000 - DNA, 18 bp, homo sapiens
atgagaatgacaaattga

SEQ ID NO: 7001 - protein, 18 aa, homo sapiens
MLQKALPSLYVCNMCKRV

SEQ ID NO: 7002 - DNA, 57 bp, homo sapiens
atgttgcagaaagcattgccatcactgtatgtgtgcaatatgtgcaaaagagtgtga

SEQ ID NO: 7003 - protein, 37 aa, homo sapiens
MCAICAKECEIYTSNAADLVNFHAFNMLNTYHIINMF

SEQ ID NO: 7004 - DNA, 114 bp, homo sapiens
atgtgtgcaatatgtgcaaaagagtgtgaaatatatacatcaaatgccgccgatctggttaatttccatgcatttaacatgcttaatacctaccatatcatcaatatgttttaa

SEQ ID NO: 7005 - protein, 35 aa, homo sapiens
MPPIWLISMHLTCLIPTISSICFNAYFFPHTIWSS

SEQ ID NO: 7006 - DNA, 108 bp, homo sapiens
atgccgccgatctggttaatttccatgcatttaacatgcttaatacctaccatatcatcaatatgttttaatgcatatttctttccacatacaatatggtctagttag

SEQ ID NO: 7007 - protein, 40 aa, homo sapiens
MHISFHIQYGLVRKEPTSSTALLTAMFQPKTSCWGQHNES

SEQ ID NO: 7008 - DNA, 123 bp, homo sapiens
atgcatatttctttccacatacaatatggtctagttaggaaagagccaacatcctccacagccttactcactgctatgtttcagcctaaaacttcttgctggggccagcacaatgagagttaa

SEQ ID NO: 7009 - protein, 88 aa, homo sapiens [sequence omitted]

SEQ ID NO: 7010 - DNA, 267 bp, homo sapiens
atgtgtctcattataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatga

SEQ ID NO: 7011 - protein, 24 aa, homo sapiens
MQPPSTHKQRSMSHLNTPTQPQRP

SEQ ID NO: 7012 - DNA, 75 bp, homo sapiens
atgcagccgccatccacgcacaagcaaagaagcatgtcccatttaaatacacccacgcagccccagcgcccttag

SEQ ID NO: 7013 - protein, 6 aa, homo sapiens
MRTRVK

SEQ ID NO: 7014 - DNA, 21 bp, homo sapiens
atgaggacgcgagtgaaatag

SEQ ID NO: 7015 - protein, 70 aa, homo sapiens
MASDSPARSLDEIDLSALRVSRTFSGFFPVVWVRVNGLGAWTGGWGWGRGTAAGECVGEGTWIPVLIRGC

SEQ ID NO: 7016 - DNA, 213 bp, homo sapiens
atggcgagcgactccccggctcgaagcctggatgaaatagatctctcggctctgagggtgagcaggacgttttctggtttctttccagtggtttgggttagggtgaatgggctcggtgcgtggactgggggctggggctggggcagggggacagcagcgggagaatgcgtcggggagggaacctggattcccgttttgattcggggttgctga

SEQ ID NO: 7017 - protein, 27 aa, homo sapiens
MTQWSTGHLTGPPAVRPVHPLSIPLCC

SEQ ID NO: 7018 - DNA, 84 bp, homo sapiens
atgacacagtggagcactggccatctcacaggtcctcctgctgtcaggcccgtgcatcccctctccattcccctctgctgctag

SEQ ID NO: 7019 - protein, 24 aa, homo sapiens
MNDSALVSCLGFTSPFLIRSWHSL

SEQ ID NO: 7020 - DNA, 75 bp, homo sapiens
atgaatgactctgctttagtcagctgcctgggctttaccagccccttcctcatcagatcctggcattctctgtag

SEQ ID NO: 7021 - protein, 4 aa, homo sapiens
MTLL

SEQ ID NO: 7022 - DNA, 15 bp, homo sapiens
atgactctgctttag

SEQ ID NO: 7023 - protein, 26 aa, homo sapiens
MSWFTKLSVIWPLATCSTSPLQGPGP

SEQ ID NO: 7024 - DNA, 81 bp, homo sapiens
atgtcatggtttacaaagctgtcagtgatctggcctttggccacctgttctacttctcctctgcagggtcccggaccctag

SEQ ID NO: 7025 - protein, 50 aa, homo sapiens
MWRGSLRLATTRPRVRGFISLRSQLWEALVIRPQLSLRRSVTCGYWMIGS

SEQ ID NO: 7026 - DNA, 153 bp, homo sapiens
atgtggcgcgggtctttgcgtctggctactaccagaccgcgggttaggggcttcatctctctgcgttctcagttgtgggaggccttggtgattcggccacagctcagcctccgtcgctctgtgacctgcgggtattggatgattggtagctaa

SEQ ID NO: 7027 - protein, 11 aa, homo sapiens
MVSVRGRASQG

SEQ ID NO: 7028 - DNA, 36 bp, homo sapiens
atggtgagtgtgcggggcagggcgtcccaaggctga

SEQ ID NO: 7029 - protein, 61 aa, homo sapiens
MAAGPSLRTESPLPPLSPGASVPSGEGPGLLSVPAQRLWPSLQPSLCSSAPAAPHLPQAVG

SEQ ID NO: 7030 - DNA, 186 bp, homo sapiens
atggcggcgggaccgagtctgcgaacggagtccccgctgccgccgctcagccctggggcctcagtaccctccggtgagggacctgggctcctgtcggtccccgcacagcggctctggcccagcctgcagccctccttgtgcagctctgcgcccgcagccccgcaccttccccaggctgtggggtga

SEQ ID NO: 7031 - protein, 24 aa, homo sapiens
MPAWEELWEKLWSGDPVPALPCSE

SEQ ID NO: 7032 - DNA, 75 bp, homo sapiens
atgccggcgtgggaggagctgtgggagaagctgtggtctggggatcccgtccctgctttaccctgttcggaatga

SEQ ID NO: 7033 - protein, 10 aa, homo sapiens
MAWEREEIAL

SEQ ID NO: 7034 - DNA, 33 bp, homo sapiens
atggcctgggaaagggaggaaatagccctttaa

SEQ ID NO: 7035 - protein, 33 aa, homo sapiens
MQSLNDIQLEDVINTSYGRETRLGKFPACRENH

SEQ ID NO: 7036 - DNA, 102 bp, homo sapiens
atgcaatctttgaatgacatacaattggaagatgtcataaataccagttacggcagagagaccaggctgggtaaattcccagcatgcagagaaaatcactga

SEQ ID NO: 7037 - protein, 8 aa, homo sapiens
MTYNWKMS

SEQ ID NO: 7038 - DNA, 27 bp, homo sapiens
atgacatacaattggaagatgtcataa

SEQ ID NO: 7039 - protein, 18 aa, homo sapiens
MQRKSLSSLLLLSPFGTH

SEQ ID NO: 7040 - DNA, 57 bp, homo sapiens
atgcagagaaaatcactgagcagcttactcctactcagcccctttggaactcactaa

SEQ ID NO: 7041 - protein, 11 aa, homo sapiens
MVSVLGKKRAK

SEQ ID NO: 7042 - DNA, 36 bp, homo sapiens
atggtgtccgtgctgggcaagaaaagggcaaaatag

SEQ ID NO: 7043 - protein, 15 aa, homo sapiens
MTSLNIFSLQFPHCN

SEQ ID NO: 7044 - DNA, 48 bp, homo sapiens
atgacaagccttaacattttctcacttcagtttcctcactgcaattga

SEQ ID NO: 7045 - protein, 5 aa, homo sapiens
MNRIS

SEQ ID NO: 7046 - DNA, 18 bp, homo sapiens
atgaataggatttcctaa

SEQ ID NO: 7047 - protein, 77 aa, homo sapiens [sequence omitted]

SEQ ID NO: 7048 - DNA, 234 bp, homo sapiens
atggaaagtgaaggccttcaggttcttcctaacagccgctccgaggaggggaaagctacaggaagagggaggagacccaagaaaggtcggaccaatgaggcagcgggcgggacaggagttcccgcctttgggcgtcgtgcgcgcgcacctcgctcacacgcacactcgcacgcacgcacgctgcggaagcgcgcgcgcgcgcaggcccagccctcgtcgccgccgccattttag

SEQ ID NO: 7049 - protein, 142 aa, homo sapiens
MHTPTRPHSGSAPSACVNLRGACLDLPKYPVLAPSKSGKVPPMARGQVRGGLQGPPARARREQVPVRQRPRPRVRLPSALAQGAQALTSPLPSPYSSPNSRPTPCLLFQSSQHSKQAPPPLAAPGMGPTPYRRSPGPLHPVG

SEQ ID NO: 7050 - DNA, 429 bp, homo sapiens
atgcacacacccacacgcccacactcagggtctgccccctcggcctgcgtgaacctccgcggagcctgcctggatctcccaaagtatccagtcctggcaccaagcaagtctggaaaagtgcccccaatggctcggggccaagtcagaggtgggctgcagggtcccccagcccgggcacgaagggagcaggtccctgtaagacagaggcctcgtcccagggtgcgcctgccctcggccttggcacagggagctcaggccttgacctccccgctcccctcgccttactcctcccccaacagccgacccacgccctgcctgctcttccagtccagccaacactctaagcaggcaccgcctccactcgcagcccccgggatgggtcccactccctaccgcagatccccaggccccctccacccagtcggctag

SEQ ID NO: 7051 - protein, 43 aa, homo sapiens
MGCESITYALLIPSFPILNILKDTGRWLLKSVCSELPVTSANL

SEQ ID NO: 7052 - DNA, 132 bp, homo sapiens
atgggctgtgagagcattacctatgccctactgatcccatcatttcccatcctaaacatcttgaaggacacaggcaggtggcttcttaaatcagtgtgctctgaactccctgtgacctcagccaacctgtga

SEQ ID NO: 7053 - protein, 16 aa, homo sapiens
MRQALSSEPLFALSAA

SEQ ID NO: 7054 - DNA, 51 bp, homo sapiens
atgagacaggctctatcctcagagcctctttttgccctctctgcagcctag

SEQ ID NO: 7055 - protein, 6 aa, homo sapiens
MDLRHK

SEQ ID NO: 7056 - DNA, 21 bp, homo sapiens
atggatttgaggcacaagtga

SEQ ID NO: 7057 - protein, 16 aa, homo sapiens
MGDTPATDAGRQDLHP

SEQ ID NO: 7058 - DNA, 51 bp, homo sapiens
atgggggatacgccagcaacagacgccggccgccaagatctgcatccctag

SEQ ID NO: 7059 - protein, 236 aa, homo sapiens [sequence omitted]

SEQ ID NO: 7060 - DNA, 711 bp, homo sapiens
atgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctggggtaagtcccgccggcgccccctgcgccccggcctccgtggccaggccgcgctggggcgcgcgaggtcgccgctcgcccctcggctgcgggcggtgcgcagcgacccccggtctcccctcgcctcccgctgcgcgccgcggcccccttggcatccagttttccgtcccttgggacgggcaggtgtttctgtcccagtatttcaacttccgccccccccccgcccccaccccgccgcggtctgcctgaggaagcgcatttgccggcttcccgatggagagccgggggggacccggagtcctgcggtgccaccgctgtgcgcagaggcgcgcgaagggagaggctcggcacaggctgaatcggctcccagcgagggaggacgggcgggcgattgtgtcacctctgcggtccctggggctctcctatcccccccatcacctccgcgggtcacggaccttggggacagagatgaggacaagtaa

SEQ ID NO: 7061 - protein, 119 aa, homo sapiens
MESRGGPGVLRCHRCAQRRAKGEARHRLNRLPAREDGRAIVSPLRSLGLSYPPHHLRGSRTLGTEMRTSKGVGPGRRDPAQDRVLVYAHQMEDTGSPLASPRPLSLPPPQSSMPICSSR

SEQ ID NO: 7062 - DNA, 360 bp, homo sapiens
atggagagccgggggggacccggagtcctgcggtgccaccgctgtgcgcagaggcgcgcgaagggagaggctcggcacaggctgaatcggctcccagcgagggaggacgggcgggcgattgtgtcacctctgcggtccctggggctctcctatcccccccatcacctccgcgggtcacggaccttggggacagagatgaggacaagtaagggagttggaccggggaggagagacccggcacaggatagagtcttggtttacgcgcaccagatggaagataccggttcccctcttgcctctccaaggcccctgtccctgccccctccgcaatcttctatgcccatttgcagttctcggtga

SEQ ID NO: 7063 - protein, 5 aa, homo sapiens
MARAV

SEQ ID NO: 7064 - DNA, 18 bp, homo sapiens
atggcgagagcggtctga

SEQ ID NO: 7065 - protein, 101 aa, homo sapiens
MSAPAGSSHPAASARIPPKFGGAAVSGAAAPAGPGAGPAPHQQNGEAGGPGGARGLAPAGRPARPHRGGAGRAGKGVRGQARPEGRERARCGGRGVRVGCG

SEQ ID NO: 7066 - DNA, 306 bp, homo sapiens
atgtcggcccccgccgggtcctctcacccggccgccagcgcccggatcccgcccaagttcggcggagcggccgtctcaggagccgcagcgcccgcgggcccgggtgcgggcccggcgccgcaccagcagaacggtgaggcgggcggcccgggcggagcgcggggcctagcaccggctgggcggcctgcacggccacatcggggcggggcgggccgggccgggaagggcgttcggggccaggcccggcccgagggacgggagcgggcgcggtgcggaggccgcggggtccgggttgggtgcgggtag

SEQ ID NO: 7067 - protein, 102 aa, homo sapiens
MRPQARNGLGRVGATEKLGAHVVKPSYLAWTRASCPERPLGCESWPEAEAAECVVRRRLVQPPSRVDCALPVSGKLLRFPRPSEHAALRKLKFALKFVDKRV

SEQ ID NO: 7068 - DNA, 309 bp, homo sapiens
atgcgaccccaggcccgaaacggcctcgggcgagtaggggcgactgaaaagctgggagcccacgtagtaaaacccagttacctagcctggacgcgggcgagttgccccgagcgaccccttggctgcgagagctggccagaagccgaggccgctgagtgcgtggtccggagaaggctggtgcagccacccagcagggtggattgtgcccttcctgtctcaggaaaattgcttcggttcccgaggcccagcgaacacgctgccttgaggaaacttaagtttgcactcaagtttgtagacaaaagggtgtaa

SEQ ID NO: 7069 - protein, 34 aa, homo sapiens
MLYKCNCNPDPVRPQELSLPLRLLLKLLEFACSV

SEQ ID NO: 7070 - DNA, 105 bp, homo sapiens
atgctatataagtgtaactgtaaccctgacccagttcggcctcaagaactgtcattgccgctgcggctgctgctcaagcttttggagtttgcttgtagtgtttga

SEQ ID NO: 7071 - protein, 35 aa, homo sapiens
MKKRARVGPALRQGLHTGSSQMQHESRFHIKVVGF

SEQ ID NO: 7072 - DNA, 108 bp, homo sapiens
atgaaaaaacgtgccagagttggccctgctttgaggcagggccttcatacaggcagcagccaaatgcagcacgaaagccgctttcatattaaggtcgtgggcttttag

SEQ ID NO: 7073 - protein, 15 aa, homo sapiens
MPQPGELEALAVRGE

SEQ ID NO: 7074 - DNA, 48 bp, homo sapiens
atgccccagcccggggagctggaggcgctcgcagtcagaggcgagtga

SEQ ID NO: 7075 - protein, 11 aa, homo sapiens
MAAVQGRGGGN

SEQ ID NO: 7076 - DNA, 36 bp, homo sapiens
atggctgctgtccaggggcgggggggtgggaattag

SEQ ID NO: 7077 - protein, 205 aa, homo sapiens [sequence omitted]

SEQ ID NO: 7078 - DNA, 618 bp, homo sapiens
atggcatccgttcgagggttctctcgcgtttgtgcgctcaaggcagagggagggtataacggggaggcgattcggccgaggaccttgtacttgacccctgaagggatgggcaccgcggagcccagaggccagagccagctgccagggcagggatggaggtgggggaccaggaggagcttcgggacctcttcaactcccctttactccgtcttccccctaaggaggaacaagagcgggatgtgttgggggtggggaatgtcttggggctgtacaagctcgctgagacttttcggggcccgccgtttccgcgtgcccgcgcgactctcgacaatggacagtgtacagtggtggcagggtttcacgggtccccgcgccgatttgggaatggtacggggtgcccttgcattagagaagcctgtgcgggcccccgggattagagaagaggtgagcgcctgcgggcggggagagaaggacgcgctgctggcaaaaagaagggcgccttccatggactggaggagcggcgagggagcctggtatgtgtgttttggatttgaaggaggcaaaccgcatcggagagtgcaagtagatgcagtgcgtcggggcaaaaggacaatctga

SEQ ID NO: 7079 - protein, 94 aa, homo sapiens [sequence omitted]

SEQ ID NO: 7080 - DNA, 285 bp, homo sapiens
atggaggtgggggaccaggaggagcttcgggacctcttcaactcccctttactccgtcttccccctaaggaggaacaagagcgggatgtgttgggggtggggaatgtcttggggctgtacaagctcgctgagacttttcggggcccgccgtttccgcgtgcccgcgcgactctcgacaatggacagtgtacagtggtggcagggtttcacgggtccccgcgccgatttgggaatggtacggggtgcccttgcattagagaagcctgtgcgggcccccgggattag

SEQ ID NO: 7081 - protein, 108 aa, homo sapiens [sequence omitted]

SEQ ID NO: 7082 - DNA, 327 bp, homo sapiens
atggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtaagggcgctgccccctga

SEQ ID NO: 7083 - protein, 86 aa, homo sapiens
MSLVRALPPDSPGGIPEGGGRGWDWWRWGKEGGMGPGVPLGKRYLRWKVGSGGRDGNGEEPDLERQWPNFCFPVPSPQHQSHLPRP

SEQ ID NO: 7084 - DNA, 261 bp, homo sapiens
atgagcctggtaagggcgctgccccctgacagccctgggggcatcccggaggggggcggcagagggtgggactggtggcggtgggggaaggagggagggatgggcccaggggtgcctcttggtaaaaggtatctaaggtggaaggtgggaagtggagggagggatggaaatggggaagaacccgacttagagcgccagtggcccaatttctgctttcccgtcccatccccccagcaccaatcccatctccccagaccttag

SEQ ID NO: 7085 - protein, 8 aa, homo sapiens
MEMGKNPT

SEQ ID NO: 7086 - DNA, 27 bp, homo sapiens
atggaaatggggaagaacccgacttag

SEQ ID NO: 7087 - protein, 55 aa, homo sapiens
MGGIAIQKKQILTHATPAVALTLLCEKPKGMIASPPQGGLVFLADKSRKIRCRRQ

SEQ ID NO: 7088 - DNA, 168 bp, homo sapiens
atgggggggatagcaatacagaaaaaacaaatcctgacgcacgcaaccccagcggtcgctctcactttgctgtgtgaaaaacccaaaggaatgattgcgagtcccccgcaaggggggttggtcttccttgctgacaagagtagaaagataaggtgcagaaggcagtga

SEQ ID NO: 7089 - protein, 19 aa, homo sapiens
MPSTGAPAQCGRRRRSVLR

SEQ ID NO: 7090 - DNA, 60 bp, homo sapiens
atgccgagcacaggcgcgcctgcgcagtgcggtcggaggcggcggtctgttctccgctga

SEQ ID NO: 7091 - protein, 218 aa, homo sapiens [sequence omitted]

SEQ ID NO: 7092 - DNA, 657 bp, homo sapiens
atgattcccatatgccctgtagtttctttcacctatggtgagtctaatgtggcccgcgaggcctctgcccggccccctccctggccccgggcagcggggagccgcgggggttggggcaggctccggggaggaggcggcggccgccacccgggcgtgcgagtgagtgagggagtgcgaggcgggagggggaggcggcgcggccgcggcctgggccccgccagggctgctctcacggcgcctctctctttctctccctgccctccctcggcgtctcggctcctctgtgtctcttgtcccgccatgggacccgactcttcgtgcccgccgcagtgcccagccggctgggggaagatgccaaaatggcgaccggcaactactttggattcacccacagcggggcggcggcggcggcggctgcggcccaatataggtaacggcatcctgccttctctctgttcgccccttgctctcccctcggtccggatcctgtcgatgcgacgcccccgcgcccgtccccagccatcccagagccccggcccgctgcaggcctggcccggcccagcccggcggcctctcccgccccgccccgccccgccccgccttgcccggcccggcccggcccgcggcggggagcggcccccagtaggggggaggtag

SEQ ID NO: 7093 - protein, 9 aa, homo sapiens
MPCSFFHLW

SEQ ID NO: 7094 - DNA, 30 bp, homo sapiens
atgccctgtagtttctttcacctatggtga

SEQ ID NO: 7095 - protein, 42 aa, homo sapiens
MVSLMWPARPLPGPLPGPGQRGAAGVGAGSGEEAAAATRACE

SEQ ID NO: 7096 - DNA, 129 bp, homo sapiens
atggtgagtctaatgtggcccgcgaggcctctgcccggccccctccctggccccgggcagcggggagccgcgggggttggggcaggctccggggaggaggcggcggccgccacccgggcgtgcgagtga

SEQ ID NO: 7097 - protein, 6 aa, homo sapiens
MSAAGL

SEQ ID NO: 7098 - DNA, 21 bp, homo sapiens
atgtcagccgctggactgtag

SEQ ID NO: 7099 - protein, 5 aa, homo sapiens
MPLQP

SEQ ID NO: 7100 - DNA, 18 bp, homo sapiens
atgcccttgcagccttga

SEQ ID NO: 7101 - protein, 41 aa, homo sapiens
MGINERTVFCNELYPCTQGASSKAIWLLAVAQLATCVCVAA

SEQ ID NO: 7102 - DNA, 126 bp, homo sapiens
atgggaataaatgaaaggactgtattttgcaacgagctttacccgtgcacgcagggggcctccagcaaagccatttggttgcttgctgtcgctcagctggctacgtgtgtttgcgtcgccgcctaa

SEQ ID NO: 7103 - protein, 48 aa, homo sapiens
MKGLYFATSFTRARRGPPAKPFGCLLSLSWLRVFASPPKSELLSAYLC

SEQ ID NO: 7104 - DNA, 147 bp, homo sapiens
atgaaaggactgtattttgcaacgagctttacccgtgcacgcagggggcctccagcaaagccatttggttgcttgctgtcgctcagctggctacgtgtgtttgcgtcgccgcctaaaagcgagctgctttcagcctatctctgctga

SEQ ID NO: 7105 - protein, 19 aa, homo sapiens
MSTLLSFCPPAWPIAAPLV

SEQ ID NO: 7106 - DNA, 60 bp, homo sapiens
atgagcacgcttctttccttctgcccgcccgcctggccaatcgccgcgccccttgtgtaa

SEQ ID NO: 7107 - protein, 49 aa, homo sapiens
MSDLRITEAFLYMDYLVGAGQGWHVASRISACPMAPCLEEQPFCFLSLG

SEQ ID NO: 7108 - DNA, 150 bp, homo sapiens
atgtctgatctccgaataactgaggcgtttctgtacatggattatctggtaggtgcagggcaggggtggcatgtcgcctctcggatctcggcgtgcccgatggccccctgccttgaggagcagcctttttgctttctttctttgggatag

SEQ ID NO: 7109 - protein, 57 aa, homo sapiens
MSPLGSRRARWPPALRSSLFAFFLWDRMPLGFFLPQPAGKPFPGLGGAASRAGGWWS

SEQ ID NO: 7110 - DNA, 174 bp, homo sapiens
atgtcgcctctcggatctcggcgtgcccgatggccccctgccttgaggagcagcctttttgctttctttctttgggataggatgcctctggggttctttctcccgcagccggctggtaagcctttccctggactcggaggggcagcctccagggcgggtgggtggtggagctga

SEQ ID NO: 7111 - protein, 48 aa, homo sapiens
MGRPRRRVPCPRSASWLPSALSAEDFLSGGAGVFLSPWSRTPGAIKEP

SEQ ID NO: 7112 - DNA, 147 bp, homo sapiens
atggggcggccgcggcggcgcgtcccctgcccgcgatcggcttcctggcttccctctgcgctctccgcagaggactttctttccgggggagcaggagttttcctctctccctggagcagaactccaggtgctattaaagagccataa

SEQ ID NO: 7113 - protein, 88 aa, homo sapiens
MAQQTSPDTLTVPEVDNPHCPNPWLNEDLVKSLRENLLQHEKSKTARKSVSPKLSPVISPRNSPRLLRRMLLSSNIPKQRRFTVAHTW

SEQ ID NO: 7114 - DNA, 267 bp, homo sapiens
atggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatggtaa

SEQ ID NO: 7115 - protein, 17 aa, homo sapiens
MRSPRQRGNRFLPSSLQ

SEQ ID NO: 7116 - DNA, 54 bp, homo sapiens
atgagaagtccaagacagcgaggaaatcggtttctcccaagctctctccagtga

SEQ ID NO: 7117 - protein, 47 aa, homo sapiens
MVRFAQTSQKWWPFPFRESCSRAFNFGGREGGPSSFLTGDLWPSDLP

SEQ ID NO: 7118 - DNA, 144 bp, homo sapiens
atggtaaggtttgcgcagacctcgcagaaatggtggccgtttcccttcagggagtcctgctctcgcgcctttaattttgggggtagggagggaggaccatcatcattcctcaccggggatttatggccaagtgatctcccttaa

SEQ ID NO: 7119 - protein, 14 aa, homo sapiens
MVAVSLQGVLLSRL

SEQ ID NO: 7120 - DNA, 45 bp, homo sapiens
atggtggccgtttcccttcagggagtcctgctctcgcgcctttaa

SEQ ID NO: 7121 - protein, 4 aa, homo sapiens
MFLS

SEQ ID NO: 7122 - DNA, 15 bp, homo sapiens
atgtttctgtcctaa

SEQ ID NO: 7123 - protein, 12 aa, homo sapiens
MPWEGVIVSRKY

SEQ ID NO: 7124 - DNA, 39 bp, homo sapiens
atgccctgggagggagtgattgtaagtagaaaatactga

SEQ ID NO: 7125 - protein, 4 aa, homo sapiens
MIRF

SEQ ID NO: 7126 - DNA, 15 bp, homo sapiens
atgattcgtttttaa

SEQ ID NO: 7127 - protein, 24 aa, homo sapiens
MCIKFKTMNLKASKNWQGYSSFVP

SEQ ID NO: 7128 - DNA, 75 bp, homo sapiens
atgtgtatcaagttcaagacgatgaatcttaaagcttctaagaactggcagggttattccagctttgtgccatga

SEQ ID NO: 7129 - protein, 10 aa, homo sapiens
MSDVTSGRLG

SEQ ID NO: 7130 - DNA, 33 bp, homo sapiens
atgtctgacgtcacgtctggtcgtcttggctag

SEQ ID NO: 7131 - protein, 5 aa, homo sapiens
MAVTK

SEQ ID NO: 7132 - DNA, 18 bp, homo sapiens
atggccgtgaccaaataa

SEQ ID NO: 7133 - protein, 34 aa, homo sapiens [sequence omitted]

SEQ ID NO: 7134 - DNA, 105 bp, homo sapiens
atgcctttcgtatggtgggcatggtataatagagaattgagcttcgaggtctttcctacgccatgccctgttgtgattctctgggatcacaactggtggggatga

SEQ ID NO: 7135 - protein, 5 aa, homo sapiens
MVGMV

SEQ ID NO: 7136 - DNA, 18 bp, homo sapiens
atggtgggcatggtataa

SEQ ID NO: 7137 - protein, 16 aa, homo sapiens
MVHTWVAASASPGSGV

SEQ ID NO: 7138 - DNA, 51 bp, homo sapiens
atggtacacacatgggtggctgcttctgcatccccagggagcggagtctga

SEQ ID NO: 7139 - protein, 87 aa, homo sapiens [sequence omitted]

SEQ ID NO: 7140 - DNA, 264 bp, homo sapiens
atgggtggctgcttctgcatccccagggagcggagtctgacccggggcccaggtgagtttcccagggggcccttggcctgtggcttggccaaagtggatggtccagtagaggctcagggacctgctgggttggagaaacttttctcccaaagatggggagatgattgtgctttctggctgcctctccttcctccctgggtaagtgtttgtcatgctggctctgtaaaaagggagcaaagcctggaagcatctattttttcctga

SEQ ID NO: 7141 - protein, 13 aa, homo sapiens
MIVLSGCLSFLPG

SEQ ID NO: 7142 - DNA, 42 bp, homo sapiens
atgattgtgctttctggctgcctctccttcctccctgggtaa

SEQ ID NO: 7143 - protein, 4 aa, homo sapiens
MLAL

SEQ ID NO: 7144 - DNA, 15 bp, homo sapiens
atgctggctctgtaa

SEQ ID NO: 7145 - protein, 32 aa, homo sapiens; identical to SEQ ID NO: 5025

SEQ ID NO: 7146 - DNA, 99 bp, homo sapiens; identical to SEQ ID NO: 5026

SEQ ID NO: 7147 - protein, 66 aa, homo sapiens [sequence omitted]

SEQ ID NO: 7148 - DNA, 201 bp, homo sapiens; identical to SEQ ID NO: 5028

SEQ ID NO: 7149 - protein, 113 aa, homo sapiens [sequence omitted]

SEQ ID NO: 7150 - DNA, 342 bp, homo sapiens; identical to SEQ ID NO: 5030

SEQ ID NO: 7151 - protein, 18 aa, homo sapiens
MGKEQCLSRGEGSRRRAR

SEQ ID NO: 7152 - DNA, 57 bp, homo sapiens; identical to SEQ ID NO: 5032

SEQ ID NO: 7153 - protein, 7 aa, homo sapiens
MARREKS

SEQ ID NO: 7154 - DNA, 24 bp, homo sapiens
atggcacggcgagagaagagttag

SEQ ID NO: 7155 - protein, 4 aa, homo sapiens
MAIL

SEQ ID NO: 7156 - DNA, 15 bp, homo sapiens
atggcgatcttatag

SEQ ID NO: 7157 - protein, 8 aa, homo sapiens
MRKYTLNA

SEQ ID NO: 7158 - DNA, 27 bp, homo sapiens
atgagaaaatacacgttaaacgcttag

SEQ ID NO: 7159 - protein, 29 aa, homo sapiens
MTVTLFSQRIRTLGLTRESEVMKTVICNI

SEQ ID NO: 7160 - DNA, 90 bp, homo sapiens
atgactgtgaccttattttctcagagaatcaggacacttggtctcacacgtgagagtgaagttatgaagacagtgatatgtaatatttga

SEQ ID NO: 7161 - protein, 8 aa, homo sapiens
MMRNTCGA

SEQ ID NO: 7162 - DNA, 27 bp, homo sapiens
atgatgagaaacacttgtggggcctga

SEQ ID NO: 7163 - protein, 26 aa, homo sapiens
MRKRGRWASPWMRRGHHDARLTSAIE

SEQ ID NO: 7164 - DNA, 81 bp, homo sapiens
atgaggaagagaggaaggtgggcgagcccctggatgagaaggggccaccacgatgccaggctcacctctgccattgaatag

SEQ ID NO: 7165 - protein, 40 aa, homo sapiens
MPGSPLPLNSCSVTPHSLQSNLLIIYSSPSQTTNLGRKQG

SEQ ID NO: 7166 - DNA, 123 bp, homo sapiens
atgccaggctcacctctgccattgaatagctgctcggtgactcctcacagtctgcaaagcaacctccttataatctatagctcaccaagtcagactaccaatttaggacgtaaacaaggctga

SEQ ID NO: 7167 - protein, 32 aa, homo sapiens
MTATLKDSSGQLEDHSLWLLPQLYLPLGIVTI

SEQ ID NO: 7168 - DNA, 99 bp, homo sapiens
atgacagccacacttaaggacagcagcgggcagctggaggatcattccctctggctgctgccccagctgtatttacctctgggcatagtgactatctaa

SEQ ID NO: 7169 - protein, 12 aa, homo sapiens
MKRPKIRSNEIT

SEQ ID NO: 7170 - DNA, 39 bp, homo sapiens
atgaaaagacctaagataagatcaaatgaaattacgtag

SEQ ID NO: 7171 - protein, 14 aa, homo sapiens
MKLRRSVKFLTVSI

SEQ ID NO: 7172 - DNA, 45 bp, homo sapiens
atgaaattacgtagaagtgtaaaattcttaactgttagtatctga

SEQ ID NO: 7173 - protein, 32 aa, homo sapiens
MHSLLGRHGISAVGILIKHHKLLFVGIRDSIE

SEQ ID NO: 7174 - DNA, 99 bp, homo sapiens
atgcattccttgctaggaaggcatggcattagtgctgtcggaatcctgataaaacatcacaaacttctgttcgttggtattagggacagtatagagtga

SEQ ID NO: 7175 - protein, 8 aa, homo sapiens
MALVLSES

SEQ ID NO: 7176 - DNA, 27 bp, homo sapiens
atggcattagtgctgtcggaatcctga

SEQ ID NO: 7177 - protein, 4 aa, homo sapiens
MAAA

SEQ ID NO: 7178 - DNA, 15 bp, homo sapiens
atggcggccgcctag

SEQ ID NO: 7179 - protein, 96 aa, homo sapiens
MASSGEVLSATVSALLLPRRPRSPWVLPSRPGFPCILSIPTPTPPRPSHPDPGLAPAPVLPASCPQDSYPVSEGTSCLPLRSCIPDRQSCPRLSVP

SEQ ID NO: 7180 - DNA, 291 bp, homo sapiens
atggccagctccggagaggtactgtccgcgactgtctccgctctgcttctgcctcggcggcctcggtctccctgggttcttccatcccgacccgggttcccttgcatcctttctatcccgacccctaccccgccccgtccttcccatcctgaccctggccttgcccctgctcccgtccttcccgcatcctgtccccaagactcctaccctgtctcggaaggcacaagctgtctcccccttcgctcgtgcattcctgatcgccagagttgtccccgtctctccgtcccctga

SEQ ID NO: 7181 - protein, 22 aa, homo sapiens
MLSFSPSPLLPGACLLNDVGGG

SEQ ID NO: 7182 - DNA, 69 bp, homo sapiens
atgctcagtttcagccccagcccacttctccctggagcctgcttgctgaatgacgtggggggtgggtga

SEQ ID NO: 7183 - protein, 41 aa, homo sapiens
MTWGVGDGGKAISPEGLTTYPGILSQHSPNLGPMEKPAASL

SEQ ID NO: 7184 - DNA, 126 bp, homo sapiens
atgacgtggggggtgggtgatggaggaaaagccatttcacctgagggacttacgacgtaccctggaattctttcccaacactccccaaatctgggtccgatggagaagcccgccgcgtccctgtaa

SEQ ID NO: 7185 - protein, 20 aa, homo sapiens
MADFDTYDDRAYSSFGGGRG

SEQ ID NO: 7186 - DNA, 63 bp, homo sapiens
atggcggacttcgacacctacgacgatcgggcctacagcagcttcggcggcggcagagggtga

SEQ ID NO: 7187 - protein, 64 aa, homo sapiens
MARSETGRRRLGSRGLACGADPFHCLPPTTTCWFLPCLGRGGADARRRAPASSPIPPTVGPVRG

SEQ ID NO: 7188 - DNA, 195 bp, homo sapiens
atggcgcgctcggagacggggcggcggcggctgggctcccggggtcttgcttgcggggcggatcccttccactgcctcccgccaacgacaacgtgttggtttttgccctgccttggccgcggcggcgccgatgcccggagacgagcgcccgcttccagccccatcccccctacggtaggaccagtgcggggctga

SEQ ID NO: 7189 - protein, 15 aa, homo sapiens
MPGDERPLPAPSPLR

SEQ ID NO: 7190 - DNA, 48 bp, homo sapiens
atgcccggagacgagcgcccgcttccagccccatcccccctacggtag

SEQ ID NO: 7191 - protein, 13 aa, homo sapiens
MVRLLAGGGRPRR

SEQ ID NO: 7192 - DNA, 42 bp, homo sapiens
atggtacgactccttgcgggcggggggagaccaaggagataa

SEQ ID NO: 7193 - protein, 157 aa, homo sapiens
MGGQHPHDPRRREGVGRQARNARCLAVSPPPPPPPPGLEVSRPGPKRQPASQWVPQSPATGANHGGRQGNRGPEAGGSAPAGSAWGCERLGRSRVWVGATGGAKWGAGQPFHLAAAGGRGPLLPGSTGGRCRDRGPTSQRKLCGPDTPTWPGREVGA

SEQ ID NO: 7194 - DNA, 474 bp, homo sapiens
atgggcgggcagcatccacatgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtaaccgcgggcccgaggccggggggagcgcgcctgccggatcagcctgggggtgcgagaggctcgggcgctcacgtgtctgggttggtgccacaggcggagcaaaatggggtgccgggcagccgttccaccttgcggctgctggagggagggggccactcctcccgggcagcacaggcggtcggtgcagagaccgaggcccgacctcgcagcggaaactttgtgggccggacactcccacttggccggggagggaagttggtgcctga

SEQ ID NO: 7195 - protein, 31 aa, homo sapiens
MTRAGGRAWGGRPGTHAAWPYRRPHRRRRRD

SEQ ID NO: 7196 - DNA, 96 bp, homo sapiens
atgacccgcgccggcgggagggcgtggggaggcaggccaggaacgcacgctgcctggccgtatcgccgcccccaccgccgccgccgccgggactag

SEQ ID NO: 7197 - protein, 176 aa, homo sapiens [sequence omitted]

SEQ ID NO: 7198 - DNA, 531 bp, homo sapiens
atggcggccgccaaggtaaccgcgggcccgaggccggggggagcgcgcctgccggatcagcctgggggtgcgagaggctcgggcgctcacgtgtctgggttggtgccacaggcggagcaaaatggggtgccgggcagccgttccaccttgcggctgctggagggagggggccactcctcccgggcagcacaggcggtcggtgcagagaccgaggcccgacctcgcagcggaaactttgtgggccggacactcccacttggccggggagggaagttggtgcctgacggggctgagccagggccgacgaggaggagcgggcgcgactggggcctggtgcaccctgggccggcaagcgctgggggtcctctctaccttcccagcgcgctcctgctcctgaccccgctggttgttgactccggcttcttccaggggccagagcccgggctgaagcctgatcctattacgtttcaagggctccgccctcccgcgggtggggaagttactttgacttccgttttggaaactgcctag

SEQ ID NO: 7199 - protein, 91 aa, homo sapiens
MGCRAAVPPCGCWREGATPPGQHRRSVQRPRPDLAAETLWAGHSHLAGEGSWCLTGLSQGRRGGAGATGAWCTLGRQALGVLSTFPARSCS

SEQ ID NO: 7200 - DNA, 276 bp, homo sapiens
atggggtgccgggcagccgttccaccttgcggctgctggagggagggggccactcctcccgggcagcacaggcggtcggtgcagagaccgaggcccgacctcgcagcggaaactttgtgggccggacactcccacttggccggggagggaagttggtgcctgacggggctgagccagggccgacgaggaggagcgggcgcgactggggcctggtgcaccctgggccggcaagcgctgggggtcctctctaccttcccagcgcgctcctgctcctga

SEQ ID NO: 7201 - protein, 10 aa, homo sapiens
MPTEPFPHGP

SEQ ID NO: 7202 - DNA, 33 bp, homo sapiens
atgcccacagagccttttccccatgggccctga

SEQ ID NO: 7203 - protein, 22 aa, homo sapiens
MGPDGSLQKVQPQVVPFLLWQE

SEQ ID NO: 7204 - DNA, 69 bp, homo sapiens
atgggccctgatggtagcctccagaaggtgcagcctcaggtggtgccctttcttctgtggcaagaataa

SEQ ID NO: 7205 - protein, 115 aa, homo sapiens
MVASRRCSLRWCPFFCGKNKLWVLDCNTTCGENGMRGKAISLLPLFLPLDRQVLLDPHNDAKNSQPGVCPFHTGGWGHYFGGSLPCPRKGRERGALWGAEEGKGDSQTGGHALCN

SEQ ID NO: 7206 - DNA, 348 bp, homo sapiens
atggtagcctccagaaggtgcagcctcaggtggtgccctttcttctgtggcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattga

SEQ ID NO: 7207 - protein, 184 aa, homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKVGKGIVFLTIVKEQ

SEQ ID NO: 7208 - DNA, 555 bp, homo sapiens
atggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaaggtaggtaaaggcattgtctttctgaccattgtgaaagaacaatga

SEQ ID NO: 7209 - protein, 7 aa, homo sapiens
MEVKGLN

SEQ ID NO: 7210 - DNA, 24 bp, homo sapiens
atggaggtgaaagggttaaactga

SEQ ID NO: 7211 - protein, 7 aa, homo sapiens
MKLALKC

SEQ ID NO: 7212 - DNA, 24 bp, homo sapiens
atgaaactggcattgaaatgttaa

SEQ ID NO: 7213 - protein, 37 aa, homo sapiens [sequence omitted]

SEQ ID NO: 7214 - DNA, 114 bp, homo sapiens
atgttaacagtgtctgctaaaaaagggctttcctctgaggaagtggctgttgagatttcctggactgttgcatctgatgcacctttcacagaatggcatgactatggcgagtaa

SEQ ID NO: 7215 - protein, 20 aa, homo sapiens
MHLSQNGMTMASKCPRRSTI

SEQ ID NO: 7216 - DNA, 63 bp, homo sapiens
atgcacctttcacagaatggcatgactatggcgagtaagtgtcccaggagatccaccatttaa

SEQ ID NO: 7217 - protein, 61 aa, homo sapiens [sequence omitted]

SEQ ID NO: 7218 - DNA, 186 bp, homo sapiens; identical to SEQ ID NO: 4418

SEQ ID NO: 7219 - protein, 8 aa, homo sapiens
MQGRRLNK

SEQ ID NO: 7220 - DNA, 27 bp, homo sapiens
atgcagggaaggcgcctcaataaatga

SEQ ID NO: 7221 - protein, 20 aa, homo sapiens
MSGGVGGGAPLRGSGGGTPQ

SEQ ID NO: 7222 - DNA, 63 bp, homo sapiens; identical to SEQ ID NO: 4422

SEQ ID NO: 7223 - protein, 25 aa, homo sapiens
MNERGAWGEGRLNECGAWGKGRLNE

SEQ ID NO: 7224 - DNA, 78 bp, homo sapiens; identical to SEQ ID NO: 4424

SEQ ID NO: 7225 - protein, 38 aa, homo sapiens
MHRPAAHALAAEPRAACAACIGPTGRRPRGKPSVTIRA

SEQ ID NO: 7226 - DNA, 117 bp, homo sapiens
atgcaccgtcctgccgcccacgcactcgcggcagagcccagggcggcctgcgcagcttgcatagggcccacgggacgccgcccacggggaaagccgtctgtaaccatccgagcctag

SEQ ID NO: 7227 - protein, 39 aa, homo sapiens; identical to SEQ ID NO: 1609

SEQ ID NO: 7228 - DNA, 120 bp, homo sapiens; identical to SEQ ID NO: 1610

SEQ ID NO: 7229 - protein, 67 aa, homo sapiens [sequence omitted]

SEQ ID NO: 7230 - DNA, 204 bp, homo sapiens; identical to SEQ ID NO: 1612

SEQ ID NO: 7231 - protein, 18 aa, homo sapiens
MDWVWFAKRGARSVSGTL

SEQ ID NO: 7232 - DNA, 57 bp, homo sapiens; identical to SEQ ID NO: 1614

SEQ ID NO: 7233 - protein, 19 aa, homo sapiens
MLIGPTVGSEGGRWGPLPQ

SEQ ID NO: 7234 - DNA, 60 bp, homo sapiens
atgctgattggtccgacagtcggaagtgagggcgggcggtgggggccgttgccgcagtga

SEQ ID NO: 7235 - protein, 243 aa, homo sapiens
MAASRRSQHHHHHHQQQLQPAPGASAPPPPPPPPLSPGLAPGTTPASPTASGLAPFASPRHGLALPEGDGSRDPPDRPRSPDPVDGTSCCSTTSTICTVAAAPVVPAVSTSSAAGVAPNPAGSGSNNSPSSSSSPTSSSSSSPSSPGSSLAESPEAAGVSSTAPLGPGAAGPGTGVPAVSGALRELLEACRNGDVSRVKRLVDAANVNAKDMAGRKSSPLHFAAGQRLLNCLLRVMGLGAGSG

SEQ ID NO: 7236 - DNA, 732 bp, homo sapiens
atggcggcgtcgcgtcgctctcagcatcatcaccaccatcatcaacaacagctccagcccgccccaggggcttcagcgccgccgccgccacctcctcccccactcagccctggcctggccccggggaccaccccagcctctcccacggccagcggcctggcccccttcgcctccccgcggcacggcctagcgctgccggagggggatggcagtcgggatccgcccgacaggccccgatccccggacccggttgacggtaccagctgttgcagtaccaccagcacaatctgtaccgtcgccgccgctcccgtggtcccagcggtttctacttcatctgccgctggggtcgctcccaacccagccggcagtggcagtaacaattcaccgtcgtcctcttcttccccgacttcttcctcatcttcctctccatcctcccctggatcgagcttggcggagagccccgaggcggccggagttagcagcacagcaccactggggcctggggcagcaggacctgggacaggggtcccagcagtgagcggggccctacgggaactgctggaggcctgtcgcaatggggacgtgtcccgggtaaagaggctggtggacgcggcaaacgtaaatgcaaaggacatggccggccggaagtcttctcccctgcacttcgctgcaggtcagagacttttgaattgtttattaagggttatgggtttgggtgcagggtccggttag

SEQ ID NO: 7237 - protein, 110 aa, homo sapiens
MAVGIRPTGPDPRTRLTVPAVAVPPAQSVPSPPLPWSQRFLLHLPLGSLPTQPAVAVTIHRRPLLPRLLPHLPLHPPLDRAWRRAPRRPELAAQHHWGLGQQDLGQGSQQ

SEQ ID NO: 7238 - DNA, 333 bp, homo sapiens
atggcagtcgggatccgcccgacaggccccgatccccggacccggttgacggtaccagctgttgcagtaccaccagcacaatctgtaccgtcgccgccgctcccgtggtcccagcggtttctacttcatctgccgctggggtcgctcccaacccagccggcagtggcagtaacaattcaccgtcgtcctcttcttccccgacttcttcctcatcttcctctccatcctcccctggatcgagcttggcggagagccccgaggcggccggagttagcagcacagcaccactggggcctggggcagcaggacctgggacaggggtcccagcagtga

SEQ ID NO: 7239 - protein, 6 aa, homo sapiens
MGTCPG

SEQ ID NO: 7240 - DNA, 21 bp, homo sapiens
atggggacgtgtcccgggtaa

SEQ ID NO: 7241 - protein, 255 aa, homo sapiens
MAAKSDGGGVGVGFAQLHNLDEAVGSGGEEDGEPGGGGCGGGGDGSEPGESSSMHICHCCNTSSCYWGCRSACLRSLLGRKPRRSAAADGGDQPLQPPAAPGAGRQPPTPSAARPEPPPPQVERPWLDCLWIVLALLVFFGDVGTDLWLALDYYRKGDYVYFGLTLFFVLVPSLLVQSLSFRWFVQDYTGGGLGAVEGLTSRGPPMMGAGYVHGAARGGPGVRVSPTPGAQRLCRLSVWIWQSVIHLLQMGQVWR

SEQ ID NO: 7242 - DNA, 768 bp, homo sapiens
atggcggcgaaatccgatggcggtggcgtgggggtgggcttcgctcagctgcacaacctggacgaggcggtgggcagcggcggcgaggaggacggggagcccgggggaggcggctgcggcggcggcggcgacggcagcgagcccggcgagagcagctcgatgcacatctgccactgctgcaacacctcctcgtgctactggggctgccgctccgcctgcctgcgctccctcctgggcaggaagccgcgccgcagcgccgccgccgacgggggggaccagccgctgcagcctcccgcggcccccggcgccggccgccaacccccgacgccctcggccgcgcggccggagccgccgccgccgcaggtggagcggccgtggctcgactgcctgtggatcgtgctggcgctgctggtgttcttcggggacgtgggcaccgacctgtggctggccctcgactactaccgcaagggggactacgtctacttcgggctgaccctcttcttcgtgctggtgccgtcgctgctggtgcagagcctgagcttccgctggttcgtgcaggactacacgggcggcgggctgggcgccgtggaggggctcaccagccggggcccccccatgatgggggccggctacgtccacggcgcggcccgcggtggcccaggcgtgagggtctcccccacgccgggggcgcagcgcctgtgtcgcctctccgtgtggatctggcagtcggtcatccacctgctgcagatggggcaggtgtggaggtaa

SEQ ID NO: 7243 - protein, 158 aa, homo sapiens
MAVAWGWASLSCTTWTRRWAAAARRTGSPGEAAAAAAATAASPARAARCTSATAATPPRATGAAAPPACAPSWAGSRAAAPPPTGGTSRCSLPRPPAPAANPRRPRPRGRSRRRRRWSGRGSTACGSCWRCWCSSGTWAPTCGWPSTTTARGTTSTSG

SEQ ID NO: 7244 - DNA, 477 bp, homo sapiens
atggcggtggcgtgggggtgggcttcgctcagctgcacaacctggacgaggcggtgggcagcggcggcgaggaggacggggagcccgggggaggcggctgcggcggcggcggcgacggcagcgagcccggcgagagcagctcgatgcacatctgccactgctgcaacacctcctcgtgctactggggctgccgctccgcctgcctgcgctccctcctgggcaggaagccgcgccgcagcgccgccgccgacgggggggaccagccgctgcagcctcccgcggcccccggcgccggccgccaacccccgacgccctcggccgcgcggccggagccgccgccgccgcaggtggagcggccgtggctcgactgcctgtggatcgtgctggcgctgctggtgttcttcggggacgtgggcaccgacctgtggctggccctcgactactaccgcaagggggactacgtctacttcgggctga

SEQ ID NO: 7245 - protein, 27 aa, homo sapiens
MTPNHCFPRRKKDFFFFWFAGLDVSFS

SEQ ID NO: 7246 - DNA, 84 bp, homo sapiens
atgactccaaaccactgctttcccagaaggaaaaaagactttttttttttttggtttgctggattagacgtgtccttttcttag

SEQ ID NO: 7247 - protein, 7 aa, homo sapiens
MGASVWC

SEQ ID NO: 7248 - DNA, 24 bp, homo sapiens
atgggcgcgagcgtttggtgttaa

SEQ ID NO: 7249 - protein, 6 aa, homo sapiens
MSESAA

SEQ ID NO: 7250 - DNA, 21 bp, homo sapiens
atgtcagaatctgcagcttag

SEQ ID NO: 7251 - protein, 35 aa, homo sapiens
MESTGRGRKRCRGFEQNESPPLCREKGFSGSPPPC

SEQ ID NO: 7252 - DNA, 108 bp, homo sapiens
atggagagtacagggaggggaagaaagaggtgcagaggatttgaacagaatgagagtcctcctctgtgcagggagaaaggcttcagtgggtctccccctccctgctag

SEQ ID NO: 7253 - protein, 92 aa, homo sapiens [sequence omitted]

SEQ ID NO: 7254 - DNA, 279 bp, homo sapiens
atgagagtcctcctctgtgcagggagaaaggcttcagtgggtctccccctccctgctagggatcctccttgccagccctgggctgggcgctggcaggcccgttcccaggtctcccgccgagggcaggagaggagccaggcctcaggagagaagtgcttactgagtaatttaccaagagcgataggcttcccactgagccagacgggatccccaggaggggagtcagaggcgggcctggcatgcatgcacagagagagtgtgcccacttggggagtgtga

SEQ ID NO: 7255 - protein, 48 aa, homo sapiens
MHAQRECAHLGSVKGLAVGPERMSRVKWQVGHTVCSHFLKGPGWCVLQ

SEQ ID NO: 7256 - DNA, 147 bp, homo sapiens
atgcatgcacagagagagtgtgcccacttggggagtgtgaagggccttgctgtgggacccgagaggatgagcagagtcaagtggcaggtgggacacacagtctgcagtcacttcttaaaaggccctgggtggtgtgtccttcaatga

SEQ ID NO: 7257 - protein, 10 aa, homo sapiens
MAFAGLERVH

SEQ ID NO: 7258 - DNA, 33 bp, homo sapiens
atggcgttcgccgggctggagcgagtacattaa

SEQ ID NO: 7259 - protein, 150 aa, homo sapiens [sequence omitted]

SEQ ID NO: 7260 - DNA, 453 bp, homo sapiens
atgaggaggcctggggaccatgggctccaggatcaagtgagtgcggccgggccgggcggagccgggccgggcgcggggcggcgaggccgggccagggctgcaggccgcgggccgcgcgggggacttgttgccgagaccagaggggcgccccgcgtgacgccggcacgcggggagggggacggttgctatggcgatccagggaggcgcgggggcggggtgcgcgcggggtggcagggcgccgggggtcaggtgtcccctcctcacctgggggtcggaacagctgagattacagggcggccccctccccgggtttacggagagcccctgaaaatggtccttcaactgtggggaaggggagtgggaaagccccggaagcacctccccatgtttgggcatgtttggggcgcccctgaaagttggcaggtccggagaggttgcagcctggccgcttga

SEQ ID NO: 7261 - protein, 6 aa, homo sapiens
MGSRIK

SEQ ID NO: 7262 - DNA, 21 bp, homo sapiens
atgggctccaggatcaagtga

SEQ ID NO: 7263 - protein, 46 aa, homo sapiens
MAIQGGAGAGCARGGRAPGVRCPLLTWGSEQLRLQGGPLPGFTESP

SEQ ID NO: 7264 - DNA, 141 bp, homo sapiens
atggcgatccagggaggcgcgggggcggggtgcgcgcggggtggcagggcgccgggggtcaggtgtcccctcctcacctgggggtcggaacagctgagattacagggcggccccctccccgggtttacggagagcccctga

SEQ ID NO: 7265 - protein, 153 aa, homo sapiens [sequence omitted]

SEQ ID NO: 7266 - DNA, 462 bp, homo sapiens
atggcgcgcgggaggggcggggccacgctgcgggcccgggccatggccgccgccgatgccgaggtgagcagcggggccggcggggggcggcgcgggggcggcgggcagcggcggaggcggcgcgggggcgaagaaccgggcggggcggcggcaggcggccggcgggcgggcggggccccgggtccccccgccgccgccgccgccgctgccgccgcctcaggccgaggccgggccgaggccgccgggcgtccggcccgcgctcccgccgggcgcgctttgtgcgcggcgcgggccgggcggcggctgggggagcgggcgggggcgcaggtgagggaggcgaccgcgtacctgtgcccgcgccccccacggaccccgtgccgccgccgccgcccgcaagccggatctgcggggagggcctcggccagggtgccggggaggtgcggaggacaaaaggaaaagtag

SEQ ID NO: 7267 - protein, 54 aa, homo sapiens
MAPSLTKSWPVPACFSPDNAAPALLAVRSRKARSVGSLRTQVYFQTSSFKGLSM

SEQ ID NO: 7268 - DNA, 165 bp, homo sapiens
atggcaccatctttaacgaaaagttggccagtcccggcgtgtttctccccagacaatgctgctccagccctgctggctgtcagaagcaggaaagcacgctcggtgggaagcttgcggactcaagtttatttccaaaccagcagctttaaagggctctcgatgtaa

SEQ ID NO: 7269 - protein, 43 aa, homo sapiens
MLLQPCWLSEAGKHARWEACGLKFISKPAALKGSRCKKFTFFC

SEQ ID NO: 7270 - DNA, 132 bp, homo sapiens
atgctgctccagccctgctggctgtcagaagcaggaaagcacgctcggtgggaagcttgcggactcaagtttatttccaaaccagcagctttaaagggctctcgatgtaaaaagttcacattcttttgttaa

SEQ ID NO: 7271 - protein, 23 aa, homo sapiens
MVSAFPVLILKDSLFPCLGKEAA

SEQ ID NO: 7272 - DNA, 72 bp, homo sapiens
atggtctcggccttccccgtgctcattctcaaggatagtttgtttccttgcttaggaaaggaagcagcgtag

SEQ ID NO: 7273 - protein, 55 aa, homo sapiens
MRARWLQVSAEQLPVGERGEARGRQPRPEVSAAEVCVGCPAAPPARVGGTSPLLG

SEQ ID NO: 7274 - DNA, 168 bp, homo sapiens
atgagagcgaggtggctccaggtctccgcggagcagctgccagtgggagagcgaggagaggcgagggggcggcagcctcggcccgaagtaagtgcagcagaagtttgcgtcggttgccccgccgctcccccagcgcgagtgggaggcacatctcccctccttggataa

SEQ ID NO: 7275 - protein, 133 aa, homo sapiens
MGCQKEKTPNWEEGLERNRTPGISEREGCGESEGGGSHTYPGDLGVPPWSGEPGAYIGATRMLPRFSLGAAKRALLFLMAGRQGQGEREPAPRRAGGWGHWGVWSWGFGVGGLGLLRRSRLSGGGRGRGRRRM

SEQ ID NO: 7276 - DNA, 402 bp, homo sapiens
atggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtga

SEQ ID NO: 7277 - protein, 4 aa, homo sapiens
MWGE

SEQ ID NO: 7278 - DNA, 15 bp, homo sapiens
atgtggggagagtga

SEQ ID NO: 7279 - protein, 27 aa, homo sapiens
MLGAFGSWSLILVIGRFRGGRQRPGAG

SEQ ID NO: 7280 - DNA, 84 bp, homo sapiens
atgttgggcgcctttggaagctggtcattaattcttgtcatcgggaggtttcgcggagggcgacagcgcccgggagcagggtga

SEQ ID NO: 7281 - protein, 25 aa, homo sapiens
MEENESQKCEPCLPYSADRRQMQGK

SEQ ID NO: 7282 - DNA, 78 bp, homo sapiens
atggaagaaaatgaaagccagaaatgtgagccgtgccttccttactcagcagacagaagacagatgcagggtaagtaa

SEQ ID NO: 7283 - protein, 69 aa, homo sapiens
MKARNVSRAFLTQQTEDRCRVSNRPIQRWSYRDACPLPLAAFYKLQLWDPAKEKKKKGNFLGWYIFQTE

SEQ ID NO: 7284 - DNA, 210 bp, homo sapiens
atgaaagccagaaatgtgagccgtgccttccttactcagcagacagaagacagatgcagggtaagtaacagacccattcaaagatggagttacagggacgcgtgccccttgccgcttgctgctttttataaactgcagctctgggacccggcaaaggaaaaaaaaaaaaaaggcaatttcttgggatggtacattttccaaactgagtag

SEQ ID NO: 7285 - protein, 15 aa, homo sapiens
MELQGRVPLAACCFL

SEQ ID NO: 7286 - DNA, 48 bp, homo sapiens
atggagttacagggacgcgtgccccttgccgcttgctgctttttataa

SEQ ID NO: 7287 - protein, 6 aa, homo sapiens
MVHFPN

SEQ ID NO: 7288 - DNA, 21 bp, homo sapiens
atggtacattttccaaactga

SEQ ID NO: 7289 - protein, 13 aa, homo sapiens
MAGRRVARGVARQ

SEQ ID NO: 7290 - DNA, 42 bp, homo sapiens
atggcggggaggcgggtggcccggggagtggcgcgccagtga

SEQ ID NO: 7291 - protein, 24 aa, homo sapiens
MRGAPGHPSCPRFCARAGSPKGVV

SEQ ID NO: 7292 - DNA, 75 bp, homo sapiens
atgcgtggtgcgccaggccaccccagctgcccacgtttctgcgcgcgtgcgggctccccgaagggagtggtttag

SEQ ID NO: 7293 - protein, 12 aa, homo sapiens
MRDLVKSDSLLQ

SEQ ID NO: 7294 - DNA, 39 bp, homo sapiens
atgagagatcttgtgaagtctgacagtttattgcaatga

SEQ ID NO: 7295 - protein, 61 aa, homo sapiens [sequence omitted]

SEQ ID NO: 7296 - DNA, 186 bp, homo sapiens
atgagaagttcctcacaaggggagaggccagctggggaaattaaaggagctcctgtccgccatccccagccccatcccgaggttgtgataacttgtgcctgtgcaaaccctagcacaggcacgcgttttgtcatagaaatgtcagaggcagcatctctactgcgccagatgtttctcagcatctga

SEQ ID NO: 7297 - protein, 89 aa, homo sapiens
MSELEEDFAKILMLKEERIKELEKRLSEKEEEIQELKRKLHKCQSVLPVPSTHIGPRTTRAQGISAEPQTYRSFHDLRQAFRKFTKSER

SEQ ID NO: 7298 - DNA, 270 bp, homo sapiens
atgagcgagctagaggaagactttgccaagattctcatgctcaaggaggagaggatcaaagagctggagaagcggctgtcagagaaggaggaagaaattcaggagctgaagaggaaactccacaaatgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtag

SEQ ID NO: 7299 - protein, 267 aa, homo sapiens [sequence omitted]

SEQ ID NO: 7300 - DNA, 804 bp, homo sapiens
atgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtaggcgcggaggccgtgggcccgggcgctcgtcccggcccgcggcgcagaggctgggggctctggccgcggcggcgggggcgggtcggcccagggcgccccctgctcgctgcggcgcgcggagtgggggtggccccgcggcccgggaatgggaagtgtttatttttatttctgcccatcacgtgctgtgcttgtctccgccgggctgggaaaggcgagctgcacggggagacgcgcccctgtggcgtgggggtggggaggaggaccgcggaaagtttactcgcgcgggctaacttgtgccctccacacatggctgcagtcgcgcggctgtccttcgtgcgccccgctgggagcgtccacgcagggacccaaccctgcccatccaggggcctggagagcttcccagcggcgaccccccggactcaggccactggacatgctcagtggggctgtccgagcctcctagggaggggcgactggaggctggacagggttgggctcaacttagggactgaacttgcccagaacccgagctctgctggcggatgcggggacagggagaggcgggacaggggcttgtctctagggcagggatccagcctggagcgtgggggcgaggaggggagaggtttattcacagggtcactttcaaggcagctgtga

SEQ ID NO: 7301 - protein, 105 aa, homo sapiens
MGSVYFYFCPSRAVLVSAGLGKASCTGRRAPVAWGWGGGPRKVYSRGLTCALHTWLQSRGCPSCAPLGASTQGPNPAHPGAWRASQRRPPGLRPLDMLSGAVRAS

SEQ ID NO: 7302 - DNA, 318 bp, homo sapiens
atgggaagtgtttatttttatttctgcccatcacgtgctgtgcttgtctccgccgggctgggaaaggcgagctgcacggggagacgcgcccctgtggcgtgggggtggggaggaggaccgcggaaagtttactcgcgcgggctaacttgtgccctccacacatggctgcagtcgcgcggctgtccttcgtgcgccccgctgggagcgtccacgcagggacccaaccctgcccatccaggggcctggagagcttcccagcggcgaccccccggactcaggccactggacatgctcagtggggctgtccgagcctcctag

SEQ ID NO: 7303 - protein, 70 aa, homo sapiens
MRGQGEAGQGLVSRAGIQPGAWGRGGERFIHRVTFKAAVMSARHCKETPPSGRFFALIVPLPEVQHLRLL

SEQ ID NO: 7304 - DNA, 213 bp, homo sapiens
atgcggggacagggagaggcgggacaggggcttgtctctagggcagggatccagcctggagcgtgggggcgaggaggggagaggtttattcacagggtcactttcaaggcagctgtgatgtcagcaagacattgcaaagaaaccccaccttctggacgtttctttgctctgattgtgcctcttccagaagttcaacacctaaggctgctctag

SEQ ID NO: 7305 - protein, 104 aa, homo sapiens
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQ

SEQ ID NO: 7306 - DNA, 315 bp, homo sapiens
atgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtaa

SEQ ID NO: 7307 - protein, 16 aa, homo sapiens
MLSSTSWSWSWIRRTN

SEQ ID NO: 7308 - DNA, 51 bp, homo sapiens
atgctctcatcgacgagctggagctggagttggatcagaaggacgaactga

SEQ ID NO: 7309 - protein, 75 aa, homo sapiens
MWRPGDGELRVSVLSVGPRPSRLPCLSSSSEMFHFNGHFLRGCARFSEPDSLHIRCLRVFVRCQGIIFKYTYTFV

SEQ ID NO: 7310 - DNA, 228 bp, homo sapiens
atgtggcgccctggcgatggggagctgcgggtctctgtattgtctgtcggcccccgcccctcccgcttgccatgtctgtcctcatcctcagaaatgtttcattttaacgggcacttcttgcggggctgtgcacgtttctcagagccagactcactgcacatacgttgccttcgtgtctttgtcagatgtcaaggtattatttttaaatatacatatacattcgtataa

SEQ ID NO: 7311 - protein, 78 aa, homo sapiens
MGSCGSLYCLSAPAPPACHVCPHPQKCFILTGTSCGAVHVSQSQTHCTYVAFVSLSDVKVLFLNIHIHSYKPPSVRRV

SEQ ID NO: 7312 - DNA, 237 bp, homo sapiens
atggggagctgcgggtctctgtattgtctgtcggcccccgcccctcccgcttgccatgtctgtcctcatcctcagaaatgtttcattttaacgggcacttcttgcggggctgtgcacgtttctcagagccagactcactgcacatacgttgccttcgtgtctttgtcagatgtcaaggtattatttttaaatatacatatacattcgtataagccacctagtgtacgtagagtttga

SEQ ID NO: 7313 - protein, 52 aa, homo sapiens
MAGLVVRGTQVSPGQPRLRPGRSPRGEGQRGTEAPQGLDTPVPASGGCVCRG

SEQ ID NO: 7314 - DNA, 159 bp, homo sapiens
atggccgggctcgtggtgcgtggaactcaagtaagtcccggccagccccgcctccgcccggggcgcagtccgcgtggggagggacagcggggcacagaggctccccagggcctagacacccctgtccccgcctcagggggctgcgtctgcagggggtga

SEQ ID NO: 7315 - protein, 22 aa, homo sapiens
MCGKNTRKVSRSPHFLLPLAPH

SEQ ID NO: 7316 - DNA, 69 bp, homo sapiens
atgtgcgggaagaacacccgcaaggtctcccgttctccccacttccttctgcccttagcgcctcactga

SEQ ID NO: 7317 - protein, 18 aa, homo sapiens
MFQFHNLNFKNFWSKNPF

SEQ ID NO: 7318 - DNA, 57 bp, homo sapiens
atgttccaatttcataatctgaattttaaaaacttttggtcaaagaatccattttga

SEQ ID NO: 7319 - protein, 11 aa, homo sapiens
MEEGVYEGKSV

SEQ ID NO: 7320 - DNA, 36 bp, homo sapiens
atggaggaaggggtttatgaaggcaaaagtgtctag

SEQ ID NO: 7321 - protein, 6 aa, homo sapiens
MQRELE

SEQ ID NO: 7322 - DNA, 21 bp, homo sapiens
atgcaaagagaattagaataa

SEQ ID NO: 7323 - protein, 30 aa, homo sapiens
MELRKSTGQDYIINLKIFQRLKSPAEKTNH

SEQ ID NO: 7324 - DNA, 93 bp, homo sapiens
atggaactcagaaaatctacaggacaggactacattataaatttaaaaatctttcaaagactaaaaagccctgctgaaaaaaccaatcactaa

SEQ ID NO: 7325 - protein, 18 aa, homo sapiens
MLLKTCYMLSSMIVRNTK

SEQ ID NO: 7326 - DNA, 57 bp, homo sapiens
atgcttctcaaaacctgctatatgctctcttctatgatagtccgaaataccaagtaa

SEQ ID NO: 7327 - protein, 8 aa, homo sapiens
MHNNTLKE

SEQ ID NO: 7328 - DNA, 27 bp, homo sapiens
atgcataataatactttgaaagaataa

SEQ ID NO: 7329 - protein, 20 aa, homo sapiens
MAPDPSAKVSKARSAGGALA

SEQ ID NO: 7330 - DNA, 63 bp, homo sapiens
atggccccggatccgagcgcaaaggtgagcaaggcgaggagtgcgggcggcgccctggcgtga

SEQ ID NO: 7331 - protein, 107 aa, homo sapiens [sequence omitted]

SEQ ID NO: 7332 - DNA, 324 bp, homo sapiens
atgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgaggttagacctgacgaagggagaggaccgcggactgtccaggatgttggagggagggggtcccgggggaggggctctctcaagccaggagagaccgccatcctactaggcagagggaaataccgcctacactag

SEQ ID NO: 7333 - protein, 21 aa, homo sapiens
MLEGGGPGGGALSSQERPPSY

SEQ ID NO: 7334 - DNA, 66 bp, homo sapiens
atgttggagggagggggtcccgggggaggggctctctcaagccaggagagaccgccatcctactag

SEQ ID NO: 7335 - protein, 10 aa, homo sapiens
MKVESLLILH

SEQ ID NO: 7336 - DNA, 33 bp, homo sapiens
atgaaggtcgagagcctgctgatcctccattga

SEQ ID NO: 7337 - protein, 124 aa, homo sapiens
MGAGLTVSGIRVYTAAASRPAAPRRRKGNRPALGCCVRCLLPPEENTAHGARPGARRRPPLRRRRVLVREVRCSRPRDRSGSRGTSCPKSPPPSSPSGSLGRLSPQLRPLPLCPQCLPSASLPV

SEQ ID NO: 7338 - DNA, 375 bp, homo sapiens
atgggcgcggggcttacggtctccgggatacgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgaggtgcggtgttcacggccccgcgaccgatctgggtctcgcggaacctcctgccccaagtcccctcctccctcctctccctccggttccttagggcggctttccccgcagcttcgacctcttcccctctgcccccagtgccttccctcagcctccctccccgtgtga

SEQ ID NO: 7339 - protein, 51 aa, homo sapiens
MAQGRERDEGPHSAGGASLSVRCGVHGPATDLGLAEPPAPSPLLPPLPPVP

SEQ ID NO: 7340 - DNA, 156 bp, homo sapiens
atggcgcaaggccgggagcgcgacgaaggcccccactccgccggcggcgcgtccttgtccgtgaggtgcggtgttcacggccccgcgaccgatctgggtctcgcggaacctcctgccccaagtcccctcctccctcctctccctccggttccttag

SEQ ID NO: 7341 - protein, 25 aa, homo sapiens
MSRGFSPNQCPSLAFSTIFKHTFNI

SEQ ID NO: 7342 - DNA, 78 bp, homo sapiens
atgtctcgaggtttctcaccaaaccagtgtccttcacttgccttttccaccatcttcaagcatacctttaatatttaa

SEQ ID NO: 7343 - protein, 38 aa, homo sapiens
MFFLCASLSFTSTSFLLFSTFICIFKSKIWPHTLHLCK

SEQ ID NO: 7344 - DNA, 117 bp, homo sapiens
atgttctttttgtgtgctagcctttcattcacgtcgacttcattccttttattttctacgtttatctgtatttttaaatctaaaatatggccacatactcttcatctgtgtaaataa

SEQ ID NO: 7345 - protein, 37 aa, homo sapiens
MPLAPEALPFPVVLGACSCRRVLPVAERRISLRGAKW

SEQ ID NO: 7346 - DNA, 114 bp, homo sapiens
atgccacttgcgccggaggcacttccttttccggttgtgctaggcgcctgctcctgccgacgtgttcttccggtggcggagcggcggattagccttcgcggggcaaaatggtga

SEQ ID NO: 7347 - protein, 34 aa, homo sapiens
MVRALRGVPDGDARTPRGLTHTALISSDAGDPEG

SEQ ID NO: 7348 - DNA, 105 bp, homo sapiens
atggtgagagcgttgaggggagttccagacggagatgcgaggacccctcggggtctgacccacaccgcgcttatctcctcagacgccggagatccagagggctag

SEQ ID NO: 7349 - protein, 7 aa, homo sapiens
MRGPLGV

SEQ ID NO: 7350 - DNA, 24 bp, homo sapiens
atgcgaggacccctcggggtctga

SEQ ID NO: 7351 - protein, 11 aa, homo sapiens
MNSLGFSARDF

SEQ ID NO: 7352 - DNA, 36 bp, homo sapiens
atgaactccttaggtttctcagctcgcgatttctaa

SEQ ID NO: 7353 - protein, 109 aa, homo sapiens [sequence omitted]

SEQ ID NO: 7354 - DNA, 330 bp, homo sapiens
atgacgaccgcgtccacctcgcaggtgcgccagaactaccaccaggactcagaggccgccatcaaccgccagatcaacctggagctctacgcctcctacgtttacctgtccatggtgagcgcgggcgggcctaagcggtggcgggggccgggcgcggttcccggggcgcgcgctggggcgggccgggggtgtggccacccgcgggctctcccgcctccctgcgcccttctggaaaatggaggctgctcgaggtttccgaggacttctctggcgcagaaagtcggggcagctggttcttctcggctgtaccctgagaatgctccctcctag

SEQ ID NO: 7355 - protein, 42 aa, homo sapiens
MEAARGFRGLLWRRKSGQLVLLGCTLRMLPPRPGPPLHTLLF

SEQ ID NO: 7356 - DNA, 129 bp, homo sapiens
atggaggctgctcgaggtttccgaggacttctctggcgcagaaagtcggggcagctggttcttctcggctgtaccctgagaatgctccctcctaggccagggccgcctctgcacacccttcttttttaa

SEQ ID NO: 7357 - protein, 6 aa, homo sapiens
MPAFFA

SEQ ID NO: 7358 - DNA, 21 bp, homo sapiens
atgccagcgttttttgcttag

SEQ ID NO: 7359 - protein, 20 aa, homo sapiens
MYLTVRGVEFGLLIEPPVLG

SEQ ID NO: 7360 - DNA, 63 bp, homo sapiens
atgtatcttactgtaagaggtgtggagtttggcctactaattgaacccccagttcttggataa

SEQ ID NO: 7361 - protein, 6 aa, homo sapiens
MGVFLR

SEQ ID NO: 7362 - DNA, 21 bp, homo sapiens
atgggcgtcttcctgcggtag

SEQ ID NO: 7363 - protein, 64 aa, homo sapiens
MEPTRPAQSCPGNRRFGSRTPGLANRTRKIGAMSKCFASLPAGSRAGLAPGINCTVLALGSGRR

SEQ ID NO: 7364 - DNA, 195 bp, homo sapiens
atggagccgacccgacccgctcaaagctgccccgggaaccgcaggtttggttcgcgcacgccgggacttgccaaccgcacccgaaaaatcggggccatgtccaaatgtttcgcttcgctgccggcagggagccgcgccgggctcgctcctgggatcaactgcacagtcctggctttggggagcgggaggcggtga

SEQ ID NO: 7365 - protein, 84 aa, homo sapiens
MFRFAAGREPRRARSWDQLHSPGFGEREAVSLPAPRPLPHQCVWGEVGMGSPGVRKRMGEEKEEVLGTGELSQTSTNPIVNAFN

SEQ ID NO: 7366 - DNA, 255 bp, homo sapiens
atgtttcgcttcgctgccggcagggagccgcgccgggctcgctcctgggatcaactgcacagtcctggctttggggagcgggaggcggtgagcctgcccgccccccgaccccttcctcaccagtgtgtctggggtgaggtggggatggggagtcctggggttcgaaaaaggatgggggaggagaaagaggaagtgttaggaactggtgaactttcacaaacttccacaaaccctattgtaaatgccttcaattaa

SEQ ID NO: 7367 - protein, 67 aa, homo sapiens
MPSINWDFFLYWLIDLRQGLARAPRLQCSGTIIAHCGLDLPGSNDPPTSASVVARTTGACHQARAHF

SEQ ID NO: 7368 - DNA, 204 bp, homo sapiens
atgccttcaattaactgggatttttttctttactggttgattgatttaagacaaggtcttgctcgggcacccaggctgcagtgcagtggcacaatcatagctcactgcggcctcgacctcccaggctcaaacgatcctcccacctcagcctctgtagtagctaggactacaggtgcctgccaccaagcccgggctcatttttaa

SEQ ID NO: 7369 - protein, 14 aa, homo sapiens
MGGASVPKISPKCG

SEQ ID NO: 7370 - DNA, 45 bp, homo sapiens
atgggcggagcttctgttccaaaaatttcccctaagtgcggttga

SEQ ID NO: 7371 - protein, 77 aa, homo sapiens
MFRAPCHRLRARGTRKARAGAWRGCTFPCLGKVELGSAGGWRWPGKEHLFATKKKKKKKKEEIEEKCVISTATQNPS

SEQ ID NO: 7372 - DNA, 234 bp, homo sapiens
atgttccgcgcgccgtgtcaccggctgcgggccaggggtactcggaaggcgcgggcaggagcctggcgaggatgcaccttcccctgccttggaaaggtagaactggggagtgcgggagggtggaggtggcccggaaaagaacacctcttcgcaaccaaaaaaaaaaaaaaaaaaaaaaaagaggaaatagaggaaaaatgtgttatttcaaccgccactcagaacccatcataa

SEQ ID NO: 7373 - protein, 83 aa, homo sapiens
MHLPLPWKGRTGECGRVEVARKRTPLRNQKKKKKKKRGNRGKMCYFNRHSEPIIIQPVGVIFIELNFKKVFFDFQSVFAGGIC

SEQ ID NO: 7374 - DNA, 252 bp, homo sapiens
atgcaccttcccctgccttggaaaggtagaactggggagtgcgggagggtggaggtggcccggaaaagaacacctcttcgcaaccaaaaaaaaaaaaaaaaaaaaaaaagaggaaatagaggaaaaatgtgttatttcaaccgccactcagaacccatcataattcagccagtcggtgtcatttttattgaattaaattttaaaaaagttttctttgatttccagagcgtttttgcgggaggaatatgttaa

SEQ ID NO: 7375 - protein, 9 aa, homo sapiens
MLKQTQDTK

SEQ ID NO: 7376 - DNA, 30 bp, homo sapiens
atgttaaaacaaactcaagatacgaaatga

SEQ ID NO: 7377 - protein, 8 aa, homo sapiens
MGDSFSFL

SEQ ID NO: 7378 - DNA, 27 bp, homo sapiens
atgggtgattccttttcttttctgtaa

SEQ ID NO: 7379 - protein, 13 aa, homo sapiens
MICKFIDLPVVSI

SEQ ID NO: 7380 - DNA, 42 bp, homo sapiens
atgatatgcaaatttatagaccttccagttgtttccatctga

SEQ ID NO: 7381 - protein, 42 aa, homo sapiens
MQIYRPSSCFHLSPLFRLFISASPCSPIRILSSQLFFPIPLS

SEQ ID NO: 7382 - DNA, 129 bp, homo sapiens
atgcaaatttatagaccttccagttgtttccatctgagtccccttttcaggctttttatctctgcttccccttgctccccaatcaggatcctctcctctcagctcttctttcccattccactctcctaa

SEQ ID NO: 7383 - protein, 168 aa, homo sapiens
MQSQDESRGSKINTAAAFSLCFYRKVCVAAFEEESCFRLCKMMLSLVKVLVWSQETWLFFFFFLRRSLALLPRLECSGMISACCDLHLPGSSNSPASASRVAGITGSQYHTQLIFVFLVETGFHHDDQAGLELLTSGDPSTSAFQIAGITGVNHCPQSKRLGFYSCLL

SEQ ID NO: 7384 - DNA, 507 bp, homo sapiens
atgcaatcacaggatgagtcaaggggaagcaaaataaatactgcagctgctttctctctttgtttttacagaaaagtctgtgtggctgcttttgaagaagaaagctgctttcgattatgtaagatgatgctctctttggtaaaagttttggtctggtctcaagagacttggctttttttttttttctttttgagacggagtcttgctctgttgcccaggctggagtgcagtggcatgatctcggcttgctgcgacctccacctcccaggttcaagcaattctcctgcttcagcctcccgagtagctgggattacaggctcacaataccacacccagctaatttttgtatttttagtagagacggggtttcaccatgatgaccaggctggtcttgaactcctgacctcaggtgatccatctacctcagccttccagattgctggcattacaggtgtgaaccattgcccccagtctaagaggcttggcttctattcttgtctcttgtga

SEQ ID NO: 7385 - protein, 71 aa, homo sapiens [sequence omitted]

SEQ ID NO: 7386 - DNA, 216 bp, homo sapiens
atgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttga

SEQ ID NO: 7387 - protein, 49 aa, homo sapiens [sequence omitted]

SEQ ID NO: 7388 - DNA, 150 bp, homo sapiens
atgcaggagcaggagttgagcttgggagctgcagatgcctccgcccctcctctctcccaggctcttcctcctgcccccttcttgcaactctccttaattttgtttggcttttggatgattataattatttttatttttgaatttatataa

SEQ ID NO: 7389 - protein, 20 aa, homo sapiens
MPPPLLSPRLFLLPPSCNSP

SEQ ID NO: 7390 - DNA, 63 bp, homo sapiens
atgcctccgcccctcctctctcccaggctcttcctcctgcccccttcttgcaactctccttaa

SEQ ID NO: 7391 - protein, 40 aa, homo sapiens [sequence omitted]

SEQ ID NO: 7392 - DNA, 123 bp, homo sapiens
atgtgtgtgtgtgtggagctgagacaggctcggcagcggcacagaatgagggaagacgagaaagagagtgggagagagagaggcagagagggagagagggagagtgacagcagcgctcggtaa

SEQ ID NO: 7393 - protein, 38 aa, homo sapiens
MRLGATGEEDGAEWLQIPCEGYPGACPAHPPGPPHSSW

SEQ ID NO: 7394 - DNA, 117 bp, homo sapiens
atgagacttggggctacgggggaagaggatggggccgaatggctgcagataccctgcgaaggctacccaggcgcctgccctgcccaccccccaggtccgccccattcctcttggtag

SEQ ID NO: 7395 - protein, 36 aa, homo sapiens
MGPNGCRYPAKATQAPALPTPQVRPIPLGSSEIALL

SEQ ID NO: 7396 - DNA, 111 bp, homo sapiens
atggggccgaatggctgcagataccctgcgaaggctacccaggcgcctgccctgcccaccccccaggtccgccccattcctcttggtagctcagaaattgctctcttgtga

SEQ ID NO: 7397 - protein, 89 aa, homo sapiens
MAADTLRRLPRRLPCPPPRSAPFLLVAQKLLSCEPYGFRSLESLAQRPFPQRAHNGPFPLPCSRNICGGFNLASPCPQLTSIFCLKPLA

SEQ ID NO: 7398 - DNA, 270 bp, homo sapiens
atggctgcagataccctgcgaaggctacccaggcgcctgccctgcccaccccccaggtccgccccattcctcttggtagctcagaaattgctctcttgtgaaccttatggattcaggtccctggaaagcctagcccagagaccttttccccaaagggcacataacgggccttttcctctgccatgctcacgtaatatttgtggaggcttcaatcttgcttctccatgtcctcaattaacatctattttctgtctaaaacctctggcatag

SEQ ID NO: 7399 - protein, 8 aa, homo sapiens
MDSGPWKA

SEQ ID NO: 7400 - DNA, 27 bp, homo sapiens
atggattcaggtccctggaaagcctag

SEQ ID NO: 7401 - protein, 154 aa, homo sapiens [sequence omitted]

SEQ ID NO: 7402 - DNA, 465 bp, homo sapiens
atgagctcctacgtagccaattcattctataagcagagccccaatatccctgcctataacatgcaaacttgtgggaactatggatcggcctcagaggtgcaggcatccaggtactgctacggcggattggacttaagcatcactttcccaccgcctgcgccttccaactctctccacggggtagacatggctgccaacccccgggctcaccccgaccgccccgcctgcagcgccgcggccgctccgggacacgctccgggcagagacgaagcggctcctctgaaccccgggatgtacagtcagaaggcggctcgcccggcgctggaggagcgagctaagagcagtggggagatcaaagaggagcaggcgcagacagggcagcccgccggactgagccagccaccggccccgccacagatttacccgtggatgaccaaactgcacatgagccacggtaaactttag

SEQ ID NO: 7403 - protein, 18 aa, homo sapiens
MDRPQRCRHPGTATADWT

SEQ ID NO: 7404 - DNA, 57 bp, homo sapiens
atggatcggcctcagaggtgcaggcatccaggtactgctacggcggattggacttaa

SEQ ID NO: 7405 - protein, 4 aa, homo sapiens
MRGK

SEQ ID NO: 7406 - DNA, 15 bp, homo sapiens
atgcggggcaaataa

SEQ ID NO: 7407 - protein, 7 aa, homo sapiens
MARKTVH

SEQ ID NO: 7408 - DNA, 24 bp, homo sapiens
atggctcgtaaaactgtccactaa

SEQ ID NO: 7409 - protein, 23 aa, homo sapiens
MPACHFLIGRFWGPAPERRARPW

SEQ ID NO: 7410 - DNA, 72 bp, homo sapiens
atgccggcgtgccactttctgattggtaggttttggggtcccgcccctgagaggagggcaaggccatggtaa

SEQ ID NO: 7411 - protein, 14 aa, homo sapiens
MVKDYSQALPRSET

SEQ ID NO: 7412 - DNA, 45 bp, homo sapiens
atggtaaaagattacagccaggcgctcccgaggtcagagacttaa

SEQ ID NO: 7413 - protein, 112 aa, homo sapiens [sequence omitted]

SEQ ID NO: 7414 - DNA, 339 bp, homo sapiens
atgttaaagatgagcgggtggcagcgacagagccaaaatcagagctggaacctgaggagagaggcgagtactgattcccatctaccttttaccctcccgtctcctcaaagttggggcgtccgctctttaggatcggcctcactcctccacagtgaagttagggaccgtccgagagaggaatggggagagtcccttattctggggtggtgcttacaaacccctattgcttcggacgacggcgtctctccacccctgcccggagccggaacacgggccctgctctgtgctgctgggcaaagggacctcggttgcccttgggaaattcattctttcccgtag

SEQ ID NO: 7415 - protein, 60 aa, homo sapiens
MGRVPYSGVVLTNPYCFGRRRLSTPARSRNTGPALCCWAKGPRLPLGNSFFPVANFRPHR

SEQ ID NO: 7416 - DNA, 183 bp, homo sapiens
atggggagagtcccttattctggggtggtgcttacaaacccctattgcttcggacgacggcgtctctccacccctgcccggagccggaacacgggccctgctctgtgctgctgggcaaagggacctcggttgcccttgggaaattcattctttcccgtagccaacttcaggcctcatcgttag

SEQ ID NO: 7417 - protein, 14 aa, homo sapiens
MQSLSDTCSAPHRN

SEQ ID NO: 7418 - DNA, 45 bp, homo sapiens
atgcagtcgctctcggatacctgctcagctccgcaccgcaactga

SEQ ID NO: 7419 - protein, 263 aa, homo sapiens [sequence omitted]

SEQ ID NO: 7420 - DNA, 792 bp, homo sapiens
atgctgaagccgagcgtcacttcggctcccacggcagacatggcgacattgacagtggtccagccgctcaccctggacagaggtaagggagcggctcgctcgccaggccaccgcgtcccctctcccctcctcccttccccgcctgccaattcccaacgggacatgggacgcgctcaggcaggaggagaaggggaacgaggacgagccaggaaggcgttcgcgccgagaacagaacactttcttcccctttctctccccgctacgttcccgctgccccttcccactgtactcgccccgccgaggggacgcctccttctggctctggggtccccgctgccactcccagcccctcgccgggtcgtctccggtcctctggctttgttggagccgctgcgcggggacggctataggcgccaggggctcggggttggagaggggcagagagcaagctcgcccggccagagcccagaggagaccggcgagggagccgcctgtcagcttgcttggcgcaggggcccgggaggaaggaagtttgtccaggcgccggagggcgagggtcggtccaactgctggagtcccggcggccactcggggggcgggctgggcgcacccctgggctgccgggcgcacagtggcggggctgcagcaggcagggagctgccctctgccgaaagggcaaggcagagcgcggggagccgagccccagcagccgagatcggctctccgcggcttcgagatcgaaagcggcgagggtcgcgtctgctcccgccgccggcagctcccggtcgatag

SEQ ID NO: 7421 - protein, 33 aa, homo sapiens
MESSAAIGASLVHPCGVIPVPECVGFLPGSSVQ

SEQ ID NO: 7422 - DNA, 102 bp, homo sapiens
atggagtcctccgctgcgatcggggcctcactggtgcacccctgtggggttatacctgtccctgagtgtgtgggtttccttcctggctccagcgtccagtga

SEQ ID NO: 7423 - protein, 15 aa, homo sapiens
MKALESYGSAEEDTL

SEQ ID NO: 7424 - DNA, 48 bp, homo sapiens
atgaaggcgctcgagtcctacggctctgcagaggaggacaccctctag

SEQ ID NO: 7425 - protein, 14 aa, homo sapiens
MQSLSDTCSAPHRN

SEQ ID NO: 7426 - DNA, 45 bp, homo sapiens; identical to SEQ ID NO: 7418

SEQ ID NO: 7427 - protein, 263 aa, homo sapiens [sequence omitted]

SEQ ID NO: 7428 - DNA, 792 bp, homo sapiens; identical to SEQ ID NO: 7420

SEQ ID NO: 7429 - protein, 33 aa, homo sapiens; identical to SEQ ID NO: 7421

SEQ ID NO: 7430 - DNA, 102 bp, homo sapiens; identical to SEQ ID NO: 7422

SEQ ID NO: 7431 - protein, 15 aa, homo sapiens
MKALESYGSAEEDTL

SEQ ID NO: 7432 - DNA, 48 bp, homo sapiens; identical to SEQ ID NO: 7424

SEQ ID NO: 7433 - protein, 63 aa, homo sapiens
MALVTLQRSPTPSAASSSASNSEVSPGLAAPGLGRRTPRRGRRSWGRACGAGGRLRGLLGAPP

SEQ ID NO: 7434 - DNA, 192 bp, homo sapiens
atggccctggtgaccctgcagcgctcgcccacgcccagcgccgcctcctcctcggccagcaacagcgaggtgagccccgggctcgccgcgcccggcctgggccgccggacgccgcgccgaggccgccggagctggggccgcgcgtgcggggcaggggggcggctgcgcgggctcctcggggccccgccgtag

SEQ ID NO: 7435 - protein, 28 aa, homo sapiens
MQCDPSGSVCRILCVRCDPHQGVTPILG

SEQ ID NO: 7436 - DNA, 87 bp, homo sapiens
atgcagtgcgacccctctgggagtgtctgcaggatactgtgtgtgcgctgtgacccacatcagggggttacccccatcttggggtga

SEQ ID NO: 7437 - protein, 6 aa, homo sapiens
MCNWDP

SEQ ID NO: 7438 - DNA, 21 bp, homo sapiens
atgtgcaactgggacccttga

SEQ ID NO: 7439 - protein, 6 aa, homo sapiens
MPGCAM

SEQ ID NO: 7440 - DNA, 21 bp, homo sapiens
atgcctggctgtgcgatgtga

SEQ ID NO: 7441 - protein, 12 aa, homo sapiens
MPRSGGRARGGS

SEQ ID NO: 7442 - DNA, 39 bp, homo sapiens
atgccccgctctggcggccgggctcgcggaggatcatga

SEQ ID NO: 7443 - protein, 188 aa, homo sapiens [sequence omitted]

SEQ ID NO: 7444 - DNA, 567 bp, homo sapiens
atgactgcggcagcgaactgggtggcgaacggggcgagcctggaggattgtcactccaacctcttttcgctggtgagtagccgggctgcggggagggggctgtgccggggaagggggggggtccccgacctccgccgccgaccaactttctcctcccgccgccgggacttcgcccctccctcgcgtctccccgccgttcgcctctcgccgattctcccccttttggatcgtctctctctcgccttggatcccatccagtgtttatttggctctttaaaaatcatttgtgagcgcggcgctcggcgtggaatttgcatgtggaagtctcggagctgcggattctgggtcgcacttcgaacgcccaccctctgttgcaatcgcactccccttctcctcccctttcccccctttttttccccccgtaaatgtggaaggctttgccttgtgctgccgcgcctccgatcggcaacctcttcccccgttgttggatcagctgcctgcccgcccgcctgccttttgaatttttttaaattccataatgacacctgcaatttcgccctaaaatag

SEQ ID NO: 7445 - protein, 34 aa, homo sapiens
MWKALPCAAAPPIGNLFPRCWISCLPARLPFEFF

SEQ ID NO: 7446 - DNA, 105 bp, homo sapiens
atgtggaaggctttgccttgtgctgccgcgcctccgatcggcaacctcttcccccgttgttggatcagctgcctgcccgcccgcctgccttttgaatttttttaa

SEQ ID NO: 7447 - protein, 7 aa, homo sapiens
MTPAISP

SEQ ID NO: 7448 - DNA, 24 bp, homo sapiens
atgacacctgcaatttcgccctaa

SEQ ID NO: 7449 - protein, 17 aa, homo sapiens
MPARREGRRAGRCRRGC

SEQ ID NO: 7450 - DNA, 54 bp, homo sapiens
atgcctgcgcgaagggaggggcgaagggccggccgttgccgacgtgggtgttaa

SEQ ID NO: 7451 - protein, 21 aa, homo sapiens
MEPLVNGDLLAAQEWAAGQGR

SEQ ID NO: 7452 - DNA, 66 bp, homo sapiens
atggagccgcttgtgaatggagacttgctggctgcccaggagtgggcggctgggcaggggcggtga

SEQ ID NO: 7453 - protein, 30 aa, homo sapiens
METCWLPRSGRLGRGGERLGSGQESWKSSP

SEQ ID NO: 7454 - DNA, 93 bp, homo sapiens
atggagacttgctggctgcccaggagtgggcggctgggcaggggcggtgaacgtttagggtccggccaagaaagttggaagtcgtctccctga

SEQ ID NO: 7455 - protein, 60 aa, homo sapiens
MASWPAAPLARSWDLPAAVRVPWWKMQPHLLTLPSKKKLFSPRVEKSGWSALLFLSCTLV

SEQ ID NO: 7456 - DNA, 183 bp, homo sapiens
atggcgagctggcctgcggctcctttagccagaagctgggatcttcccgcagcagttcgtgttccctggtggaaaatgcagcctcatctactgactctcccttccaaaaaaaagttattttccccaagggtcgagaaaagtgggtggtcggcactgttgttcctcagttgcaccctggtgtaa

SEQ ID NO: 7457 - protein, 188 aa, homo sapiens [sequence omitted]

SEQ ID NO: 7458 - DNA, 567 bp, homo sapiens
atgcgccgggtgcgccgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctgaaggaaggggccgtcccccttaccatgccccattcttttag

SEQ ID NO: 7459 - protein, 125 aa, homo sapiens
MFTSTGSSGLCEYRPPPSWLPPTRHPRHLFEEAGAAGTLGFAGGGGADPPDPRPNPASSRSWGSAETAPISAWRGEWGQSPAARPDPTWYPQVLCPGVSWGRCKWAGALVFSWAGPRPFAERVPR

SEQ ID NO: 7460 - DNA, 378 bp, homo sapiens
atgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctga

SEQ ID NO: 7461 - protein, 69 aa, homo sapiens
MGTKPRRPPRPHLVSPGALPRSLLGPLQVGRCPGVLVGRPQALCGACAALKEGAVPLTMPHSFRLGGPN

SEQ ID NO: 7462 - DNA, 210 bp, homo sapiens
atggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctgaaggaaggggccgtcccccttaccatgccccattcttttaggcttgggggaccgaactaa

SEQ ID NO: 7463 - protein, 72 aa, homo sapiens
MCFFFSLQEEFLDKHTLMRVLSSGGKLGSRGEGAQLCCWMLLFSWRVSGGQQVGGGVFLQPVKRLFSLSVWN

SEQ ID NO: 7464 - DNA, 219 bp, homo sapiens
atgtgtttcttcttcagtctccaagaagagtttttagacaaacacacactgatgagagtgctttcaagtggagggaagttaggaagtcgtggcgagggagcgcagctgtgctgctggatgttgctgttttcctggcgtgttagcggtggtcagcaggtagggggcggagtatttttacagccagttaaacggcttttctcactgagtgtgtggaattga

SEQ ID NO: 7465 - protein, 11 aa, homo sapiens
MTFTQSRTTSR

SEQ ID NO: 7466 - DNA, 36 bp, homo sapiens
atgaccttcacgcagtcaagaacgacttccaggtaa

SEQ ID NO: 7467 - protein, 26 aa, homo sapiens
MKQWQYFLLLGTFVFSFTFYSEKCNL

SEQ ID NO: 7468 - DNA, 81 bp, homo sapiens
atgaagcaatggcagtatttccttttattaggcacatttgttttcagtttcactttttactcagagaagtgtaatttataa

SEQ ID NO: 7469 - protein, 21 aa, homo sapiens
MAVFPFIRHICFQFHFLLREV

SEQ ID NO: 7470 - DNA, 66 bp, homo sapiens
atggcagtatttccttttattaggcacatttgttttcagtttcactttttactcagagaagtgtaa

SEQ ID NO: 7471 - protein, 12 aa, homo sapiens
MFNLFLMPSRHT

SEQ ID NO: 7472 - DNA, 39 bp, homo sapiens
atgtttaatctttttttaatgcccagtaggcatacttag

SEQ ID NO: 7473 - protein, 45 aa, homo sapiens
MVASPFAKWFAVKTTRVLLSRLHLKSFFANPQRMSIAPCWAPGLW

SEQ ID NO: 7474 - DNA, 138 bp, homo sapiens
atggtagcgtcaccatttgctaaatggtttgctgtgaagactactagagtactactgtccaggttacatttgaaaagcttctttgccaatcctcagcgaatgtcaattgctccctgctgggctccaggtctgtggtag

SEQ ID NO: 7475 - protein, 7 aa, homo sapiens
MVCCEDY

SEQ ID NO: 7476 - DNA, 24 bp, homo sapiens
atggtttgctgtgaagactactag

SEQ ID NO: 7477 - protein, 21 aa, homo sapiens
MIFSFLSVLPVTFLLLSRLLM

SEQ ID NO: 7478 - DNA, 66 bp, homo sapiens
atgattttcagttttctatctgtactacctgtcacttttcttttactctcacggcttttgatgtag

SEQ ID NO: 7479 - protein, 6 aa, homo sapiens
MCRLAF

SEQ ID NO: 7480 - DNA, 21 bp, homo sapiens
atgtgtcgcttggccttttga

SEQ ID NO: 7481 - protein, 4 aa, homo sapiens
MSGL

SEQ ID NO: 7482 - DNA, 15 bp, homo sapiens
atgtcaggcctctga

SEQ ID NO: 7483 - protein, 4 aa, homo sapiens
MSLK

SEQ ID NO: 7484 - DNA, 15 bp, homo sapiens
atgtcattaaagtaa

SEQ ID NO: 7485 - protein, 53 aa, homo sapiens [sequence omitted]

SEQ ID NO: 7486 - DNA, 162 bp, homo sapiens
atgtctgtcagactgtacacagtagaagcatcccttgcaggggctgttgggttgcatcctaagctgtgctggagcttcccgatgtactctgtagatgtctttgcaccttctgtcctcattgccatccccaatcagtccctggaacaccagctgtggccctga

SEQ ID NO: 7487 - protein, 58 aa, homo sapiens
MSLHLLSSLPSPISPWNTSCGPDPFSPCMECTGKACGLWDSSRLEQDRGRRDGAEGSR

SEQ ID NO: 7488 - DNA, 177 bp, homo sapiens
atgtctttgcaccttctgtcctcattgccatccccaatcagtccctggaacaccagctgtggccctgacccttttagcccctgcatggaatgcacaggcaaggcgtgtggcctttgggactccagccgactagagcaagacagaggaagaagagacggggcagagggcagccgatag

SEQ ID NO: 7489 - protein, 5 aa, homo sapiens
MEEGL

SEQ ID NO: 7490 - DNA, 18 bp, homo sapiens
atggaggagggattgtaa

SEQ ID NO: 7491 - protein, 9 aa, homo sapiens
MAAAGSSLL

SEQ ID NO: 7492 - DNA, 30 bp, homo sapiens
atggcggcagccggcagctccctgctctga

SEQ ID NO: 7493 - protein, 296 aa, homo sapiens [sequence omitted]

SEQ ID NO: 7494 - DNA, 891 bp, homo sapiens
atggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagtacactatcccggggatactgcactacatccagcacgagtgggctcggttcgagatggagcgggcgcactgggaggtggaacgggccgaactgcaggtacctcgttggggtcggtgtgcgggagctgcggcggctgggttcccggccggggggtggggctggggactccactcagccggagccggcgccttgggaggccgagcggaacctacctgtgctgctcaggttgtgatggtcctctcaacggcttttcctggagtccccctccctctttcccgcataagcttgctccccaaccttcactggctacgcggtgcgggcctcctcggggcagccattttggcttttagtatggcgtctgcgggggctcctccggaggcggccttcccgggcctccggggcttgggaccgagcacctctctgtgggagagtccggtttggggcctctcaacactgagtttgctcttgtttgttcctcttgagatgaagagcccgaagagagggactaggataggcatcttaccccccttttccggaccacccccctttccgatttggcgtatctggccccctccctcagacttggtacgcgcttgccccttgacagccacgcttctttcctgggctgctagggtgcacagtgacttgggactgacctgtgaagttttatttcccatcgtcaactttaagtactttctcacctga

SEQ ID NO: 7495 - protein, 23 aa, homo sapiens
MLPYSLGFSVVIPYLVTHQRFQH

SEQ ID NO: 7496 - DNA, 72 bp, homo sapiens
atgctgccttactcacttggattctctgtagttattccttacttagtgactcatcaacgctttcagcactga

SEQ ID NO: 7497 - protein, 64 aa, homo sapiens [sequence omitted]

SEQ ID NO: 7498 - DNA, 195 bp, homo sapiens
atgcaccaaatcctgggcaaaacattcctaggacaggtttttttttttttttttttcagttggaaggaggtagggaaaataagtgctttaattcctaggattttggaagtaaaaatggaacaccagacaaaaatggaatttttaggcaaatgtaaagctttgtacttgggtatctcaaagtattatacagtgtaa

SEQ ID NO: 7499 - protein, 16 aa, homo sapiens
MIINQLEVVLFFKFYF

SEQ ID NO: 7500 - DNA, 51 bp, homo sapiens
atgattattaaccaactagaagtagttcttttttttaaattttatttttaa

SEQ ID NO: 7501 - protein, 9 aa, homo sapiens
MRVLLCCPG

SEQ ID NO: 7502 - DNA, 30 bp, homo sapiens
atgagggtcttgctatgttgcccaggctga

SEQ ID NO: 7503 - protein, 49 aa, homo sapiens [sequence omitted]

SEQ ID NO: 7504 - DNA, 150 bp, homo sapiens
atgttgcccaggctgaagtggctactgacaggcacgatgtggcactgcagcctggaactcttgggcttaagtgatccttcctgcttcttctatcttaaaaaaaaaaagttacgcttgcttgttaaaatatttttaaaatgctgtgtttaa

SEQ ID NO: 7505 - protein, 314 aa, homo sapiens [sequence omitted]

SEQ ID NO: 7506 - DNA, 945 bp, homo sapiens
atgctgctgctacgctctccaccggcgcagcgaggaagggggcggggagaatccctggcacatgccagggtcgccgtaggtggcagcggccggcgcatgcgcgccctctcccagaagccaggaacgccgaggggcgcgctcccccattcgcgcgcgcacgccggcgctggccgaggcttccccgcctgcgctcgttgtcagagccgctccggcgcgtgcgcgcgttatctccggccgacccgagcagccggttccctcctctccaggccccctccccatcccacccccgccgcctggccccagccgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggtaagggggcgttttgggagccgggccccgcgcgcctcggggtcttgggctgggctgcgcgcgggatctgaggaggctccgcggctgtccctgctcgttcacccgggcctgttgctgcaactgctgccggttaaccagcggctctcggaaaagtggggagggagcccccgggacgctctggcggatgccttggcgcagccccgggggcgcgggcagagggtgaggggcgcccgcctctccagccgggacgcggagctgcgccgctgctgccctcggcgtcgcgcatccttgcctagggcaggggccaaagcctag

SEQ ID NO: 7507 - protein, 5 aa, homo sapiens
MPGSP

SEQ ID NO: 7508 - DNA, 18 bp, homo sapiens
atgccagggtcgccgtag

SEQ ID NO: 7509 - protein, 42 aa, homo sapiens
MGPALLRVARPGPSSLSVSRCQRLPGSRRLALCLSQWRRRLR

SEQ ID NO: 7510 - DNA, 129 bp, homo sapiens
atggggccggcactgctcagggtcgcgcgccctggacccagctcgctctcggtctcgcgctgtcagcgactgcccggctcgcgccgcctcgcgctctgcctcagtcagtggcgccgaaggctccgttaa

SEQ ID NO: 7511 - protein, 12 aa, homo sapiens
MPWRSPGGAGRG

SEQ ID NO: 7512 - DNA, 39 bp, homo sapiens
atgccttggcgcagccccgggggcgcgggcagagggtga

SEQ ID NO: 7513 - protein, 33 aa, homo sapiens
MLCSTPRGARRIPACIGERPRAMVPGSWRGVRS

SEQ ID NO: 7514 - DNA, 102 bp, homo sapiens
atgctctgcagcacaccgaggggcgccaggcgtatcccggcgtgcatcggggagcgcccaagggcgatggttcccggctcctggagaggcgtgcgaagttaa

SEQ ID NO: 7515 - protein, 5 aa, homo sapiens
MGLNP

SEQ ID NO: 7516 - DNA, 18 bp, homo sapiens
atgggtttaaatccataa

SEQ ID NO: 7517 - protein, 104 aa, homo sapiens [sequence omitted]

SEQ ID NO: 7518 - DNA, 315 bp, homo sapiens
atgactagccgggtggtccagcagcgcgaggattccgggacccgcgagcggagcggcgcgtgggtcggttgcggtcggccccggcaggtatgcgcaggcgccttgcttgccacgcgctacgcccgtccccacgcgcctggtggcgtgttcttggcgcgaagtgttaagagtctgggtgtttttgtgcgttggggggaaggagagggtggcgggggcgggggggcgctgaggcgtcacgtggacgccacagccaatctcaggccgaggcgcacccacagctttccccggcgccccggggtgcgacgtgttcactga

SEQ ID NO: 7519 - protein, 25 aa, homo sapiens
MRRRLACHALRPSPRAWWRVLGAKC

SEQ ID NO: 7520 - DNA, 78 bp, homo sapiens
atgcgcaggcgccttgcttgccacgcgctacgcccgtccccacgcgcctggtggcgtgttcttggcgcgaagtgttaa

SEQ ID NO: 7521 - protein, 65 aa, homo sapiens
MSPRARPRPHFRVAQLPNWEHRRQRERPRGGRGEKRPWLGPALACVGCRSAWYGPRDDFSPGAGL

SEQ ID NO: 7522 - DNA, 198 bp, homo sapiens
atgtcacctcgcgcgcgtccccggcctcacttccgcgtcgctcagctacctaactgggaacatcgacgccagagagagcggccacgaggcgggaggggtgagaagcgcccatggctcggccctgccctcgcgtgtgtggggtgccgctccgcgtggtacggtccgcgtgacgacttctcgcccggcgccgggctctag

SEQ ID NO: 7523 - protein, 19 aa, homo sapiens
MARPCPRVCGVPLRVVRSA

SEQ ID NO: 7524 - DNA, 60 bp, homo sapiens
atggctcggccctgccctcgcgtgtgtggggtgccgctccgcgtggtacggtccgcgtga

SEQ ID NO: 7525 - protein, 24 aa, homo sapiens
MREGKTGGKSRCYFLYSSVGQPFT

SEQ ID NO: 7526 - DNA, 75 bp, homo sapiens
atgagggaggggaaaacaggtgggaagagcaggtgttattttctttattcctctgtggggcagccttttacctag

SEQ ID NO: 7527 - protein, 38 aa, homo sapiens
MGFPVSVKWSSRSLPSVQGIWDINITPPPPPQSSSSQS

SEQ ID NO: 7528 - DNA, 117 bp, homo sapiens
atggggtttcccgtttctgttaaatggtcaagtaggtctctgccctcagtgcaaggtatctgggacattaacatcacccccccaccgcccccccaaagctccagtagccaaagttga

SEQ ID NO: 7529 - protein, 27 aa, homo sapiens
MATQQQNNSFRVHREEGAGLRLRKRRA

SEQ ID NO: 7530 - DNA, 84 bp, homo sapiens
atggcaactcagcaacaaaacaattcatttagagtgcaccgggaggaaggggcgggacttcggctgcggaagaggcgggcctaa

SEQ ID NO: 7531 - protein, 8 aa, homo sapiens
MAVLLKGL

SEQ ID NO: 7532 - DNA, 27 bp, homo sapiens
atggctgtgttgttgaagggcctgtag

SEQ ID NO: 7533 - protein, 96 aa, homo sapiens [sequence omitted]

SEQ ID NO: 7534 - DNA, 291 bp, homo sapiens
atgcacgacgctttcgagccagtgccgatcctagaaaagctgcctctgcaaatcgactgtctggctgcctggggtgagccgaggggccgcggggccgaggcggagtcagcacaggagcggtccggatcttttctgaggccggggaagtggacaggcgtccatccgtgtgggcttcggttggatgctacacgagaggggcttaggatgagagaaggcagagagatgaccaccggctatagacatcgatgtctgtggggctacttgggtgatcccagtgatccagtcatttag

SEQ ID NO: 7535 - protein, 8 aa, homo sapiens
MLHERGLG

SEQ ID NO: 7536 - DNA, 27 bp, homo sapiens
atgctacacgagaggggcttaggatga

SEQ ID NO: 7537 - protein, 22 aa, homo sapiens
MHCGAQPVTACRLQTPASRLFL

SEQ ID NO: 7538 - DNA, 69 bp, homo sapiens
atgcactgcggcgcccagccggtcaccgcctgccggctgcagacgcctgcgagcaggttgtttttataa

SEQ ID NO: 7539 - protein, 25 aa, homo sapiens
MKIHMVRCYVRHPAGFNASLSFDDI

SEQ ID NO: 7540 - DNA, 78 bp, homo sapiens
atgaaaatccatatggtaagatgttatgtgcgtcaccctgccgggtttaatgccagcctgtcttttgatgacatttga

SEQ ID NO: 7541 - protein, 9 aa, homo sapiens
MLCASPCRV

SEQ ID NO: 7542 - DNA, 30 bp, homo sapiens
atgttatgtgcgtcaccctgccgggtttaa

SEQ ID NO: 7543 - protein, 20 aa, homo sapiens
MCVTLPGLMPACLLMTFEPP

SEQ ID NO: 7544 - DNA, 63 bp, homo sapiens
atgtgcgtcaccctgccgggtttaatgccagcctgtcttttgatgacatttgagcccccgtga

SEQ ID NO: 7545 - protein, 9 aa, homo sapiens
MPGRLICTY

SEQ ID NO: 7546 - DNA, 30 bp, homo sapiens
atgccagggcgtttgatttgcacctactga

SEQ ID NO: 7547 - protein, 15 aa, homo sapiens
MLGAAPARPPTGATR

SEQ ID NO: 7548 - DNA, 48 bp, homo sapiens
atgcttggggctgccccggcgcgcccccctacaggcgcgacccgctga

SEQ ID NO: 7549 - protein, 25 aa, homo sapiens
MSAQSQALTRSTQPREGGRPLPAEP

SEQ ID NO: 7550 - DNA, 78 bp, homo sapiens
atgtccgcgcagtcccaggcattgacgcgctcgacgcagcccagggaaggcggccggccgctgcccgccgagccctag

SEQ ID NO: 7551 - protein, 60 aa, homo sapiens
MYPQGRHPVSNCNSVYLSIYHGRVNEAVYLAPPFCLLLPLWCVCLCVCSHTKGDAAGGRR

SEQ ID NO: 7552 - DNA, 183 bp, homo sapiens
atgtatccgcagggcagacatccggtgagtaattgcaactcggtttatttaagcatctatcatggcagggtaaacgaggcagtttatctggcacctccattttgcttgttgctacctttatggtgtgtgtgtttgtgtgtgtgctctcacacaaagggggatgcggccggggggcgccgttga

SEQ ID NO: 7553 - protein, 12 aa, homo sapiens
MEYIFPYLHSSY

SEQ ID NO: 7554 - DNA, 39 bp, homo sapiens
atggagtacatcttcccctacttgcactcatcctattag

SEQ ID NO: 7555 - protein, 19 aa, homo sapiens
MTKISLVKHNLSQSPSQKS

SEQ ID NO: 7556 - DNA, 60 bp, homo sapiens
atgaccaaaattagtctagtaaagcacaacctatcacaatctccctcacaaaaatcctag

SEQ ID NO: 7557 - protein, 47 aa, homo sapiens
MTNFIQRMENLQSSIREGVQTRDREMNQGFDFHLLSFASRGALSQVM

SEQ ID NO: 7558 - DNA, 144 bp, homo sapiens
atgacaaattttattcaaagaatggaaaatcttcaaagtagcataagagaaggagtacagactagagacagagagatgaatcagggctttgatttccacctcttatcatttgcaagccgaggagccttgagccaagttatgtaa

SEQ ID NO: 7559 - protein, 57 aa, homo sapiens
MAFLAGFCFVLRQGLALSPGWSAVVRSWLTATSASRVQAILVPQPSPRVAVITGKCH

SEQ ID NO: 7560 - DNA, 174 bp, homo sapiens
atggcatttctagcaggtttttgttttgttttgagacagggtctcgctctgtctccaggctggagtgcagtggtgcgatcttggctcactgcaacctctgcctcccgggttcaagcgattcttgtgcctcagccctccccccgagtagctgtgattacaggcaagtgccactag

SEQ ID NO: 7561 - protein, 22 aa, homo sapiens
MFYYSGVLFYKQHQRGPLENCI

SEQ ID NO: 7562 - DNA, 69 bp, homo sapiens
atgttctattattctggtgttttattctataagcaacatcagagaggcccactagagaactgtatttaa

SEQ ID NO: 7563 - protein, 25 aa, homo sapiens
MSRPGVVAHACNPSTLGGRGRWITR

SEQ ID NO: 7564 - DNA, 78 bp, homo sapiens
atgtctcggccgggggtggtggctcacgcctgtaatcccagcactttgggaggccgaggcaggtggatcacgaggtga

SEQ ID NO: 7565 - protein, 7 aa, homo sapiens
MVKPCLY

SEQ ID NO: 7566 - DNA, 24 bp, homo sapiens
atggtgaaaccctgtctctattaa

SEQ ID NO: 7567 - protein, 30 aa, homo sapiens
MSPGEFTDWLEFYFWDLSVLTSFSFHLSSF

SEQ ID NO: 7568 - DNA, 93 bp, homo sapiens
atgtctcctggggaatttactgactggctagagttttatttctgggatctttctgtgctcacttctttttccttccatctttcctcattttga

SEQ ID NO: 7569 - protein, 7 aa, homo sapiens
MQIPWVP

SEQ ID NO: 7570 - DNA, 24 bp, homo sapiens
atgcagattccctgggtgccgtga

SEQ ID NO: 7571 - protein, 15 aa, homo sapiens
MLLPVLAGKHGSPLP

SEQ ID NO: 7572 - DNA, 48 bp, homo sapiens
atgttgctccccgtgctggctggaaagcacggttctcctctgccttaa

SEQ ID NO: 7573 - protein, 43 aa, homo sapiens [sequence omitted]

SEQ ID NO: 7574 - DNA, 132 bp, homo sapiens
atgtttgtttctaagtatttttgtattgtgtacattctgtatatttttgttgtaacatattatttgagcacagattccattaaatattttttttctttttccaagccattggttattcaggaagtgacctga

SEQ ID NO: 7575 - protein, 5 aa, homo sapiens
MGGRG

SEQ ID NO: 7576 - DNA, 18 bp, homo sapiens
atgggtgggagagggtga

SEQ ID NO: 7577 - protein, 19 aa, homo sapiens
MGRKKKKQLKPWCWYPLSV

SEQ ID NO: 7578 - DNA, 60 bp, homo sapiens
atgggtcgcaagaagaagaagcagctgaagccgtggtgctggtatcctttgtcggtttga

SEQ ID NO: 7579 - protein, 17 aa, homo sapiens
MGFRGRQAFAVVGRVTL

SEQ ID NO: 7580 - DNA, 54 bp, homo sapiens
atggggttccgaggtcgacaggcttttgcagttgtgggtcgtgtgactctgtga

SEQ ID NO: 7581 - protein, 58 aa, homo sapiens
MEGWGQLHSLSPTFSVFIYFMCVLCLFFRIGGLVKNQVSQPWFRTFFFFFFFSGREEN

SEQ ID NO: 7582 - DNA, 177 bp, homo sapiens
atggagggttggggacagcttcacagtctgtcacccactttttctgtttttatttactttatgtgtgttttgtgtttattttttcgaattggcggtttagtaaagaaccaagttagtcaaccctggtttcgaacctttttttttttttttttcttttcggggcgggaggagaactag

SEQ ID NO: 7583 - protein, 32 aa, homo sapiens
MLFLEALIFFTLKLILFTVLYVKAACYSTAFM

SEQ ID NO: 7584 - DNA, 99 bp, homo sapiens
atgctttttctggaagcgttaatattctttacattaaaattgattttatttactgttttgtacgtaaaggcggcttgttacagtactgcgtttatgtaa

SEQ ID NO: 7585 - protein, 39 aa, homo sapiens
MCPRNTSQPHNSGIKPSEPRPDFTSPARMASVPLSQDAL

SEQ ID NO: 7586 - DNA, 120 bp, homo sapiens
atgtgccccaggaacacttcccagcctcataattctggtataaagccatcagaaccacgacccgactttacatctccagccagaatggcatctgttcctctatctcaggatgcactttga

SEQ ID NO: 7587 - protein, 43 aa, homo sapiens
MHFEKWELPLPSVGFFLLLFLRSDLHTPESGILIVLGDIIKVH

SEQ ID NO: 7588 - DNA, 132 bp, homo sapiens
atgcactttgagaagtgggagttgccacttccttcagttggtttctttttgttgttgttcttgcgatctgacttgcataccccagagtctggcattttaattgtcctcggtgacattattaaagttcattaa

SEQ ID NO: 7589 - protein, 24 aa, homo sapiens
MGRKVDLSPFQLPEWTTPNPCHPL

SEQ ID NO: 7590 - DNA, 75 bp, homo sapiens
atgggaagaaaagttgatttatccccattccagctccctgagtggacaactccaaacccttgccacccgctataa

SEQ ID NO: 7591 - protein, 7 aa, homo sapiens
MYIEIFS

SEQ ID NO: 7592 - DNA, 24 bp, homo sapiens
atgtatattgagatatttagttga

SEQ ID NO: 7593 - protein, 58 aa, homo sapiens [sequence omitted]

SEQ ID NO: 7594 - DNA, 177 bp, homo sapiens
atggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctggtag

SEQ ID NO: 7595 - protein, 48 aa, homo sapiens
MAQGQRDSFKIDPVGQARWLTPVIPALWEAEAGGSPKVSSSRPAWQTW

SEQ ID NO: 7596 - DNA, 147 bp, homo sapiens
atggcacaagggcagagggactcatttaaaatagaccctgtcggccaggcgcggtggctcacgcctgtaatcccagcactttgggaggccgaggcaggcggatcacctaaggtcagtagttcgagaccagcctggcaaacatggtga

SEQ ID NO: 7597 - protein, 11 aa, homo sapiens
MVKPRLLKIQN

SEQ ID NO: 7598 - DNA, 36 bp, homo sapiens
atggtgaaaccccgtctactaaaaatacaaaattag

SEQ ID NO: 7599 - protein, 9 aa, homo sapiens
MKQTLSTRD

SEQ ID NO: 7600 - DNA, 30 bp, homo sapiens
atgaaacagaccctgtcaactcgagattag

SEQ ID NO: 7601 - protein, 27 aa, homo sapiens
MEAEAADAPPGGVESALSCFSFNQDCT

SEQ ID NO: 7602 - DNA, 84 bp, homo sapiens
atggaggccgaggccgcggacgctcccccgggcggggttgagtcggcgctcagctgcttctctttcaaccaggactgcacgtaa

SEQ ID NO: 7603 - protein, 10 aa, homo sapiens
MGGAGRWESQ

SEQ ID NO: 7604 - DNA, 33 bp, homo sapiens
atggggggagcagggcggtgggaaagccagtga

SEQ ID NO: 7605 - protein, 20 aa, homo sapiens
MRKERKLQVDPGLCSWGPGR

SEQ ID NO: 7606 - DNA, 63 bp, homo sapiens
atgagaaaggagaggaagttgcaagttgacccaggactctgtagttggggcccaggaagatga

SEQ ID NO: 7607 - protein, 185 aa, homo sapiens [sequence omitted]

SEQ ID NO: 7608 - DNA, 558 bp, homo sapiens
atgagagtacaggaaaaactttcccatttgtccttgagcatctcaacgtggcatctgggcagggcctcggacaaagaggcagcctatccctgcggccaggccagcccctgtcccatccccgacgcagggcatcgtgcctgcccgctctggatggaagaaacctttggatttctttggctgttttcacatcgcccacccagccaggcaggatctccttctcggagtccaagactcttttcccgggcgcagactgctttctctccaggaaacaggagctccaccctgttgtttttgagtggatttttaatgttttacttcgatgttcacatttgggctttgagagggagctgggctgaagtgtgtttcaggcatctgcaggattctgtgacttacaggcaaacgcctgtttctttccctattttcatggaagcgagccctggggaccatatggaatcatctttttggaatgtgcaccctgagcatcaggcggggatgaccgattcccagtttcccacttcctgctgtaccagtttctgtgccttggctgctggtgactga

SEQ ID NO: 7609 - protein, 121 aa, homo sapiens
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRR

SEQ ID NO: 7610 - DNA, 366 bp, homo sapiens
atgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcaggtaa

SEQ ID NO: 7611 - protein, 4 aa, homo sapiens
MWRV

SEQ ID NO: 7612 - DNA, 15 bp, homo sapiens
atgtggagggtatga

SEQ ID NO: 7613 - protein, 52 aa, homo sapiens
MPWTGPCWTAASCGCKWRATAAPRTHTTAAGDRHPAGTGAVATDAGAAGKRG

SEQ ID NO: 7614 - DNA, 159 bp, homo sapiens
atgccatggacggggccgtgctggacggccgcgagctgcgggtgcaaatggcgcgctacggccgccccccggactcacaccacagccgccggggaccgccaccccgcaggtacgggggcggtggctacggacgccggagccgcaggtaaacggggctga

SEQ ID NO: 7615 - protein, 157 aa, homo sapiens
MASGGEIMAAWAGARGRGRPRCLELTPLCLLVPPAALGGVAAADPGVGVVPGLAADLATAARSLGPALVLDLGRPPSPDPHEGPSPSPRRSPDLVRGPGPGLGPGVLPQCPRGNPNPGRDRRVPPSLLKRKERCPLKKMVMSGNPRHITLIHKWDLG

SEQ ID NO: 7616 - DNA, 474 bp, homo sapiens
atggcgtctggcggcgagataatggcggcctgggcgggagcgcgcgggcggggccggccccgctgcctggaattaaccccgctgtgcttgctcgtcccgcccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtag

SEQ ID NO: 7617 - protein, 66 aa, homo sapiens
MLERSLRDGQGLGGGGRFCKGSHWGLPRGLCGDCGREGAEDGGGDSDGALFGGPFWGVGETAVGGL

SEQ ID NO: 7618 - DNA, 201 bp, homo sapiens
atgctggagcggagccttagggatgggcaaggccttgggggcggggggaggttctgcaaagggagccactggggtctgcctaggggcttgtgcggagattgcgggcgagaaggggcagaggacggtggaggagactcagatggggccctttttggcggcccgttttggggggtaggggagacggcggttgggggactttga

SEQ ID NO: 7619 - protein, 50 aa, homo sapiens [sequence omitted]

SEQ ID NO: 7620 - DNA, 153 bp, homo sapiens
atgggcaaggccttgggggcggggggaggttctgcaaagggagccactggggtctgcctaggggcttgtgcggagattgcgggcgagaaggggcagaggacggtggaggagactcagatggggccctttttggcggcccgttttggggggtag

SEQ ID NO: 7621 - protein, 7 aa, homo sapiens
MERGGRG

SEQ ID NO: 7622 - DNA, 24 bp, homo sapiens
atggagcgtggaggaagaggttaa

SEQ ID NO: 7623 - protein, 27 aa, homo sapiens
MVGGGRGCSIDEGLKRPAEGKDQEGLR

SEQ ID NO: 7624 - DNA, 84 bp, homo sapiens
atggttgggggtgggcgggggtgttccatcgatgagggtcttaagagacctgccgagggcaaggaccaggaggggttaaggtag

SEQ ID NO: 7625 - protein, 5 aa, homo sapiens
MRRRP

SEQ ID NO: 7626 - DNA, 18 bp, homo sapiens
atgaggcggcgaccgtga

SEQ ID NO: 7627 - protein, 54 aa, homo sapiens
MGNRGMEELIPLVNKLQDAFSSIGQSCHLDLPQIAVVGGQSAGKSSVLENFVGR

SEQ ID NO: 7628 - DNA, 165 bp, homo sapiens
atgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccggtga

SEQ ID NO: 7629 - protein, 8 aa, homo sapiens
MARRAPPA

SEQ ID NO: 7630 - DNA, 27 bp, homo sapiens
atggcgcgccgtgcgccgccggcgtaa

SEQ ID NO: 7631 - protein, 18 aa, homo sapiens
MTTPECLAQRLWKGVVGG

SEQ ID NO: 7632 - DNA, 57 bp, homo sapiens
atgactacccctgagtgtctggcacaacggctctggaaaggggtggtaggagggtag

SEQ ID NO: 7633 - protein, 56 aa, homo sapiens
MAEQQTLSRASLTGGNSLEAMGEELFCLSGESKEEPQVSTSHCQQQRRPPTNSISA

SEQ ID NO: 7634 - DNA, 171 bp, homo sapiens
atggctgaacagcagactctctctcgagcttcccttacagggggaaacagcttggaagccatgggggaggaacttttttgtctgtcaggggagagcaaggaagaaccccaagtttctacctctcactgccaacagcagagacgcccccctaccaacagtatttccgcgtag

SEQ ID NO: 7635 - protein, 40 aa, homo sapiens
MRLGVHLQVPPRPCHSWTDPSSWQHHQEMAKDTWSRVGFR

SEQ ID NO: 7636 - DNA, 123 bp, homo sapiens
atgcggttaggtgttcacctccaggtgccacctaggccctgccactcctggactgacccatcctcctggcaacatcaccaagagatggctaaagacacatggtccagggtcggctttcggtaa

SEQ ID NO: 7637 - protein, 20 aa, homo sapiens
MVQGRLSVSVYSQRFRANGA

SEQ ID NO: 7638 - DNA, 63 bp, homo sapiens
atggtccagggtcggctttcggtaagtgtttactctcaacgttttagggctaatggtgcgtag

SEQ ID NO: 7639 - protein, 110 aa, homo sapiens
MVRRKRRKKKTKINREFLNPHTLAFTATILAQKVSSRSSPEASLNHQRAQEQKALLSLPSEAAPLSGPGRPLPPACPAGARSSLPGNYPNPAPKPTNGVGSCIHNPSPRS

SEQ ID NO: 7640 - DNA, 333 bp, homo sapiens
atggtgcgtaggaagagaagaaaaaaaaaaacaaaaataaatagggagtttttaaatcctcacacattagcattcactgccaccatccttgcacaaaaagtcagctccagatcaagcccagaagccagcctgaatcatcaacgggcacaggaacaaaaagccctgctctccttaccctccgaggcggccccgctctccggacctgggcggccgctgcctcctgcgtgccctgccggggccaggtcatcacttcccgggaattatcccaacccagcccccaagcccacgaacggggtcggctcctgcattcacaacccctcgccccgcagctga

SEQ ID NO: 7641 - protein, 17 aa, homo sapiens
MKHYEVRSEKQGPCGHC

SEQ ID NO: 7642 - DNA, 54 bp, homo sapiens
atgaagcattacgaggtaagaagcgagaaacaggggccgtgtggccactgctga

SEQ ID NO: 7643 - protein, 41 aa, homo sapiens
MRMCAGSIYKSATQAVLGVLFLGGLCRGWDACRFLAAPPAG

SEQ ID NO: 7644 - DNA, 126 bp, homo sapiens
atgcgcatgtgcgcaggaagtatttataaatctgcaacccaggctgttttgggggtactttttcttgggggtctctgcaggggctgggacgcttgcaggttccttgcagctcccccagcgggctga

SEQ ID NO: 7645 - protein, 28 aa, homo sapiens
MGATKVRDPCSQSEGVLHKSCATPPSPA

SEQ ID NO: 7646 - DNA, 87 bp, homo sapiens
atgggagccacgaaggtgcgggacccttgctcccaatccgagggagtcttgcacaaatcttgcgccacgccgccgtcaccagcgtag

SEQ ID NO: 7647 - protein, 5 aa, homo sapiens
MCLSP

SEQ ID NO: 7648 - DNA, 18 bp, homo sapiens
atgtgcttatcgccctag

SEQ ID NO: 7649 - protein, 9 aa, homo sapiens
MLARLVSNF

SEQ ID NO: 7650 - DNA, 30 bp, homo sapiens
atgttggccaggctggtctcgaacttctga

SEQ ID NO: 7651 - protein, 65 aa, homo sapiens
MSAFTFLRGSPTSLKCPSDWIVSFLRYTPTLPVSFFSISSGPPNALWILQFSEGSPVSPEVFPLT

SEQ ID NO: 7652 - DNA, 198 bp, homo sapiens
atgagtgccttcactttcctgagggggtcccccacttctttgaaatgcccatctgactggatcgttagttttctgaggtatacccctactttaccagtatccttcttttctatttcttctgggcccccaaatgctctatggatcctgcagttttctgaggggtccccagtttctccagaggttttccccttaacttga

SEQ ID NO: 7653 - protein, 20 aa, homo sapiens
MLYGSCSFLRGPQFLQRFSP

SEQ ID NO: 7654 - DNA, 63 bp, homo sapiens
atgctctatggatcctgcagttttctgaggggtccccagtttctccagaggttttccccttaa

SEQ ID NO: 7655 - protein, 6 aa, homo sapiens
MDPAVF

SEQ ID NO: 7656 - DNA, 21 bp, homo sapiens
atggatcctgcagttttctga

SEQ ID NO: 7657 - protein, 75 aa, homo sapiens
MSRAVTPAPGSMCAAEGRIIWPAARAGGRTGAASAAGPGGPTGGTSARGPASPAPPPPGPAGDPGPAAPVTCALP

SEQ ID NO: 7658 - DNA, 228 bp, homo sapiens
atgtcccgggcggtgacgccggcgccgggctccatgtgtgcggccgaggggcgcattatctggccggcggcgcgggcgggcgggcggaccggcgcagcgagcgccgcgggcccgggcggccccacaggcggaacgagcgcgcgcggcccggcgtccccggcccctccgccgcccggccccgcgggcgaccccggaccagcagcccccgtaacctgcgcgctgccctag

SEQ ID NO: 7659 - protein, 5 aa, homo sapiens
MSVEK

SEQ ID NO: 7660 - DNA, 18 bp, homo sapiens
atgagcgtggaaaagtga

SEQ ID NO: 7661 - protein, 24 aa, homo sapiens
MGRAQAESLTDTWIVRTLGPRNEW

SEQ ID NO: 7662 - DNA, 75 bp, homo sapiens
atgggcagggcccaggctgagagcctgacggacacttggattgtgcgcacactgggacccagaaatgaatggtga

SEQ ID NO: 7663 - protein, 9 aa, homo sapiens
MNGDPSLRK

SEQ ID NO: 7664 - DNA, 30 bp, homo sapiens
atgaatggtgacccctcccttaggaagtga

SEQ ID NO: 7665 - protein, 15 aa, homo sapiens
MGGGRAPPERLGGCR

SEQ ID NO: 7666 - DNA, 48 bp, homo sapiens
atgggcgggggtagagccccgccggagaggctgggcggctgccggtga

SEQ ID NO: 7667 - protein, 56 aa, homo sapiens
MVASGPPAVPRWAVPPVPGGGTAALEPLLQELSGGGRAGAVGPASGGRGGGGGPYH

SEQ ID NO: 7668 - DNA, 171 bp, homo sapiens
atggtcgcgtccgggccccccgcggtgccgcgatgggctgtaccacccgtgcccggcggggggaccgcggccctcgagcccctccttcaggagctgagtgggggtggccgagcgggggcggtgggaccagcctcggggggccggggcggtggcggcgggccataccactga

SEQ ID NO: 7669 - protein, 85 aa, homo sapiens
MGCTTRARRGDRGPRAPPSGAEWGWPSGGGGTSLGGPGRWRRAIPLRRWGERCKFAGRGAQAAACAGRGLDLSGAAGRSSLACAG

SEQ ID NO: 7670 - DNA, 258 bp, homo sapiens
atgggctgtaccacccgtgcccggcggggggaccgcggccctcgagcccctccttcaggagctgagtgggggtggccgagcgggggcggtgggaccagcctcggggggccggggcggtggcggcgggccataccactgaggcggtggggggagcgctgcaagtttgcgggacggggagcgcaggccgcagcgtgcgcgggccgggggctggacctttcgggcgcggcgggcagatcgagcctggcgtgcgcgggctaa

SEQ ID NO: 7671 - protein, 29 aa, homo sapiens
MLPQLWLGYITTALGEPCLERRGTQIRGL

SEQ ID NO: 7672 - DNA, 90 bp, homo sapiens
atgcttccccaactgtggctgggttatatcaccacggcgttgggggagccctgcttagaacgtaggggaacccaaatcagaggactgtga

SEQ ID NO: 7673 - protein, 14 aa, homo sapiens
MSLSACFHLWLAAR

SEQ ID NO: 7674 - DNA, 45 bp, homo sapiens
atgtctctgtctgcgtgtttccatctctggttagctgctagataa

SEQ ID NO: 7675 - protein, 21 aa, homo sapiens
MLGKGCSTYSGLYLPPAGKVL

SEQ ID NO: 7676 - DNA, 66 bp, homo sapiens
atgctgggaaagggttgttccacttactctgggctttatctacccccagcggggaaagttttgtaa

SEQ ID NO: 7677 - protein, 164 aa, homo sapiens [sequence omitted]

SEQ ID NO: 7678 - DNA, 495 bp, homo sapiens
atgtgtgctagaaaaccctttgggcttggagagtgggagctcggatgggcgtttcaagttctccaccaggctgtgggaactcagatgggcgtttcaagtaccccactagggggtactgaaaaccttcaagtttttcagttccccatagaaaaggggtctaggctgacggtttctaccccctcctctccaaggcggtccccgggttcccaggagtctgtaggtccagacttcggtgacactgacacttccgcccagcgtagctctagggcaaccgcccgctcagcaaacaccccccccttccacctttgctgccccaacaacagtcaggggaggccggggaatcacttaaggggccccgcccaccaccggagttccacccactccgcgtgcctctccctccccccagatcatcacgcctgggagttgcgggagcgggtgcgctgcctcggagtcccgcgtgtatacggctccccagccgtctgcccctgtgtgtga

SEQ ID NO: 7679 - protein, 24 aa, homo sapiens
MGVSSSPPGCGNSDGRFKYPTRGY

SEQ ID NO: 7680 - DNA, 75 bp, homo sapiens
atgggcgtttcaagttctccaccaggctgtgggaactcagatgggcgtttcaagtaccccactagggggtactga

SEQ ID NO: 7681 - protein, 16 aa, homo sapiens
MAWRYGATAAREFSFV

SEQ ID NO: 7682 - DNA, 51 bp, homo sapiens
atggcgtggagatatggcgcaactgcggcgcgtgagttttcctttgtttag

SEQ ID NO: 7683 - protein, 54 aa, homo sapiens
MAQLRRVSFPLFRLSVRLAVPSRFCTRDVGGGTDLEIPAPLSPPRVNSCVPSEC

SEQ ID NO: 7684 - DNA, 165 bp, homo sapiens
atggcgcaactgcggcgcgtgagttttcctttgtttagattaagtgttcgcttagcggtgccctcacgcttctgtacccgggatgtggggggcggtacagaccttgaaatccccgcaccgctctctccaccccgagtaaattcatgcgtcccgtcagagtgttaa

SEQ ID NO: 7685 - protein, 18 aa, homo sapiens
MWGAVQTLKSPHRSLHPE

SEQ ID NO: 7686 - DNA, 57 bp, homo sapiens
atgtggggggcggtacagaccttgaaatccccgcaccgctctctccaccccgagtaa

SEQ ID NO: 7687 - protein, 10 aa, homo sapiens
MRPVRVLKSP

SEQ ID NO: 7688 - DNA, 33 bp, homo sapiens
atgcgtcccgtcagagtgttaaaatcgccctag

SEQ ID NO: 7689 - protein, 203 aa, homo sapiens [sequence omitted]

SEQ ID NO: 7690 - DNA, 612 bp, homo sapiens
atgagaatgttcggggagaacaagggtagaggagtgggacgcgcggttcgggaccccagagccgcggctgctccttcttccagagccggtgtctgtcgggggcgcggggagctcgggctactggcccgggccgggcggtgggggtgggctgtctggacgttcggagggatcagtgtctggcacaggcttccggaggccttcgcctcgcgggctccaagttgtgaaagggctgggccacgacgggcgtgggtaccgtccggcccctcgcccctcagccccgcctggggccactctccagcggttcggcctacgcgcggggcccggcggcggggccggcgcgggcgacgtggccctgtgaggggcggcggccgggtcccccgccacccagctggccttctcgagacttttccgagcccccagtcgctagaagggcccagcacagcggctgcctccccttctctctcccactcgcctcctccttccattgtccccccggcgtggtggtcccggctccggcgccctccccgacgtccgccaccgtcgtggcggcgccgacttttgcagacgtggagctgtcactgcccttcctccggagagtgcccttttctttag

SEQ ID NO: 7691 - protein, 33 aa, homo sapiens
MTFKWRTQVFQDSSRPRQKRESQNLCARSRRWA

SEQ ID NO: 7692 - DNA, 102 bp, homo sapiens
atgacttttaagtggagaactcaagttttccaagacagttcccgtccgcgacagaaaagagaatcgcagaatttgtgcgcccgaagtagacgctgggcctaa

SEQ ID NO: 7693 - protein, 29 aa, homo sapiens
MGNCGIFALKISKTLEPATHLGGFSCIFS

SEQ ID NO: 7694 - DNA, 90 bp, homo sapiens
atggggaattgtgggatttttgccttgaaaattagtaagaccctggagccagccacccacttaggtgggttctcctgcatcttttcctga

SEQ ID NO: 7695 - protein, 6 aa, homo sapiens
MVYQLR

SEQ ID NO: 7696 - DNA, 21 bp, homo sapiens
atggtttatcagttgaggtga

SEQ ID NO: 7697 - protein, 7 aa, homo sapiens
MVLHTSG

SEQ ID NO: 7698 - DNA, 24 bp, homo sapiens
atggttctccatacttcagggtag

SEQ ID NO: 7699 - protein, 19 aa, homo sapiens
MWIPMIPFSLGPWRAAAGD

SEQ ID NO: 7700 - DNA, 60 bp, homo sapiens
atgtggattcctatgatacctttctccctgggaccatggagggcagcagctggtgattga

SEQ ID NO: 7701 - protein, 6 aa, homo sapiens
MEGSSW

SEQ ID NO: 7702 - DNA, 21 bp, homo sapiens
atggagggcagcagctggtga

SEQ ID NO: 7703 - protein, 8 aa, homo sapiens
MSANYMCP

SEQ ID NO: 7704 - DNA, 27 bp, homo sapiens
atgtctgccaactacatgtgtccttag

SEQ ID NO: 7705 - protein, 8 aa, homo sapiens
MLPGSPAV

SEQ ID NO: 7706 - DNA, 27 bp, homo sapiens
atgctcccaggctctcccgcagtttaa

SEQ ID NO: 7707 - protein, 8 aa, homo sapiens
MGVLHDYS

SEQ ID NO: 7708 - DNA, 27 bp, homo sapiens
atgggggtcttacatgattattcatga

SEQ ID NO: 7709 - protein, 41 aa, homo sapiens
MIIHEGLGRGVAVKHVLGCLLVAHVLWLCMLVHTSHVSLAS

SEQ ID NO: 7710 - DNA, 126 bp, homo sapiens
atgattattcatgaagggctgggaaggggtgttgccgtgaagcatgttctgggctgtctcctggtggcacatgtgctgtggttgtgcatgctagtacacacatcgcatgtctcgttagcatcgtaa

SEQ ID NO: 7711 - protein, 9 aa, homo sapiens
MKGWEGVLP

SEQ ID NO: 7712 - DNA, 30 bp, homo sapiens
atgaagggctgggaaggggtgttgccgtga

SEQ ID NO: 7713 - protein, 212 aa, homo sapiens
MRAARPGPQRGLRAPWLRPRPARTLILRPRRHLRPETHQAGRLRKARPRARTGRRGPRLHSTGEREGAADPAELGGWSVPAASPSPPLPEARRRRPVLPRAGWNPAGLKRPGGRTWPKPAGSSGLGEGVRVRTPSVDLGLCPRWVGPSASSARRAVCLLDCASWSMLSARGVALPDPRGQGLGFGGAAAHGAFGLPRTRVAPSSLCGGFARA

SEQ ID NO: 7714 - DNA, 639 bp, homo sapiens
atgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccggtaggcgtgggcctcgcctccactccactggcgagcgggaaggggctgcagatccggccgagctgggcgggtggtccgtccccgccgcgagcccaagtcccccactcccggaggccaggcggcggcgccccgttctcccacgtgccgggtggaaccccgcgggcttgaagcggccgggaggacggacctggcccaagccggcaggctcctcggggctcggggaaggagtccgggtgcgcacccccagcgttgaccttggtctctgcccccggtgggtggggccctcggcctcgagcgcccggcgggctgtgtgcctgctcgactgtgcgagttggtctatgttgtcggctcggggtgtggccctgcccgacccgcgaggccagggcttaggatttggaggtgctgcggcgcacggtgccttcggattgcctcgcacgcgcgtggcaccttcgagcctctgcgggggctttgcaagagcatga

SEQ ID NO: 7715 - protein, 38 aa, homo sapiens
MAAPPARADADPSPTSPPTARDTPGRQAEKSETACEDR

SEQ ID NO: 7716 - DNA, 117 bp, homo sapiens
atggctgcgcccccggcccgcgcggacgctgatccttcgcccacgtcgccacctacggcccgagacacaccaggccggcaggctgagaaaagcgagaccgcgtgcgaggaccggtag

SEQ ID NO: 7717 - protein, 127 aa, homo sapiens
MKWGSCGGAAGGTRPHPGSSPRVAPLGAGPCAAPLGPWPSGGGGHAVPGAARGRSGRCPSLPGLKCPLGSPRGPQEGVVPTQAPLAWVQAVTPVRNAVSQDSLRDGLRWMPQGEGCPGTGSLLSRSC

SEQ ID NO: 7718 - DNA, 384 bp, homo sapiens
atgaagtggggaagttgtgggggtgcagcgggaggaacccgcccccaccccggttcgtcaccccgagtggcccctctgggagccgggccctgcgcggcgcctttggggccgtggccgtcagggggcggtggccacgcagtgcccggggctgcaagagggcgctctgggcgctgcccctcccttccgggtctgaagtgtcccttggggagcccgcggggtccccaggaaggggttgttcccactcaggcgcctcttgcctgggttcaggctgtgactcctgtcagaaacgctgtgagccaggactccctcagagatgggctgcgctggatgccgcagggggaagggtgtcccggcacagggtcgctcctctccaggagctgctga

SEQ ID NO: 7719 - protein, 45 aa, homo sapiens
MGCAGCRRGKGVPAQGRSSPGAAEQKELSPGPASLQVHTLPVGSD

SEQ ID NO: 7720 - DNA, 138 bp, homo sapiens
atgggctgcgctggatgccgcagggggaagggtgtcccggcacagggtcgctcctctccaggagctgctgagcagaaagagctttcccctggccctgcgtcccttcaggtccacaccctcccagtgggcagtgactag

SEQ ID NO: 7721 - protein, 4 aa, homo sapiens
MRQR

SEQ ID NO: 7722 - DNA, 15 bp, homo sapiens
atgaggcagaggtaa

SEQ ID NO: 7723 - protein, 87 aa, homo sapiens [sequence omitted]

SEQ ID NO: 7724 - DNA, 264 bp, homo sapiens
atgcgtggccaggtgcgccggctggtcctgagttccggggcagcaggcgcggggaagcgcggggaggctgcccgcttcaggcgggaggcggagggtgggggcttagcccggctctgggtgcggggtcggggggtgctttttggggcgggggaggtctctgtctttaccggagtccgcaggctccgggccgaggctccgccgggtcctgcctccgcggcctggccctcggggcctccccgtcccgctgccccggcctggagctag

SEQ ID NO: 7725 - protein, 29 aa, homo sapiens
MPLPWLPSEGTALLEVSGAHGKFPAKKPS

SEQ ID NO: 7726 - DNA, 90 bp, homo sapiens
atgccccttccctggctgccttccgaggggaccgcgcttttggaggtctccggggcacatgggaaattcccagctaagaaaccatcttga

SEQ ID NO: 7727 - protein, 38 aa, homo sapiens [sequence omitted]

SEQ ID NO: 7728 - DNA, 117 bp, homo sapiens
atgggaaattcccagctaagaaaccatcttgaggagccctacacggaaccgggcttgcctggcctagcagaaagccagccgcagcgagaccctccgcctggcatgcggcactggtga

SEQ ID NO: 7729 - protein, 11 aa, homo sapiens
MTRLCVLLDVF

SEQ ID NO: 7730 - DNA, 36 bp, homo sapiens
atgacaaggttatgtgttttgctggatgtcttctaa

SEQ ID NO: 7731 - protein, 124 aa, homo sapiens
MCFAGCLLRIIYLDCLWWGSVSFVTSLCFSDLFRFPLNAALSPLVGKTPSIRVSIIARHPPVRMPRTTHSPEPAREQGCLPATSTPFSLCFYPAGKGRAYPGTPEVGQVSGQPAGPWRSRVRSG

SEQ ID NO: 7732 - DNA, 375 bp, homo sapiens
atgtgttttgctggatgtcttctaagaatcatttatttagattgcttatggtggggaagcgtttcctttgtgacatctttgtgtttctcggatctatttcgtttccctctaaacgcagccctctctcccctagtgggaaagacacccagtatccgtgtctcgatcatcgcacgacacccaccagtgcggatgccacgtaccacacactccccagagcctgccagagagcagggctgtctcccagccacgtccaccccattttcattgtgcttctatcccgcaggcaaaggaagagcgtacccaggcacccccgaggtaggccaggtgtcaggacagccagcaggcccttggcgaagccgggtccgctctggctag

SEQ ID NO: 7733 - protein, 201 aa, homo sapiens [sequence omitted]

SEQ ID NO: 7734 - DNA, 606 bp, homo sapiens
atgtcttctaagaatcatttatttagattgcttatggtggggaagcgtttcctttgtgacatctttgtgtttctcggatctatttcgtttccctctaaacgcagccctctctcccctagtgggaaagacacccagtatccgtgtctcgatcatcgcacgacacccaccagtgcggatgccacgtaccacacactccccagagcctgccagagagcagggctgtctcccagccacgtccaccccattttcattgtgcttctatcccgcaggcaaaggaagagcgtacccaggcacccccgaggtaggccaggtgtcaggacagccagcaggcccttggcgaagccgggtccgctctggctagctcagcgcggtgaacccatgagctcattaggagcagcggctgctttgcgcggggaacgccggtttccctgcggcagaggggccctgcacccgcccgcggcgcgcggtggtggcccaggaccagtggcgcacacgcttgcgctcccaggctgcagggcgcgctgcgccggcgcagctcccgggcgtgtgcaacaaaaggacggccaagttcattccctcctggaagcagagggcggggccgcatga

SEQ ID NO: 7735 - protein, 14 aa, homo sapiens
MTSGGCMCLRIKWL

SEQ ID NO: 7736 - DNA, 45 bp, homo sapiens
atgacttctggaggctgcatgtgtcttagaatcaaatggttatga

SEQ ID NO: 7737 - protein, 26 aa, homo sapiens
MSKDQLFPSPGMASVTSTSHDGCDIH

SEQ ID NO: 7738 - DNA, 81 bp, homo sapiens
atgtccaaagatcaattatttccctctcctggcatggcctctgtgacatccactagtcatgatggctgtgacatccactag

SEQ ID NO: 7739 - protein, 94 aa, homo sapiens
MMAVTSTSASARPMTQPQPLPVPSNIFHYCPCHACMRLWPPRRPLDAPLASSLLLGAHHTAAKLNFHTRHHESLQPLFLPSGGPPPMIVATHPS

SEQ ID NO: 7740 - DNA, 285 bp, homo sapiens
atgatggctgtgacatccactagtgcctcagccagacccatgactcagcctcaaccccttcctgtcccttccaacatttttcactactgcccatgccatgcctgcatgagactatggcctcctagaaggcccttagatgcccctctcgcctcctccctactgcttggtgcacaccacacagcagccaagctgaactttcacaccaggcatcatgagagcctgcagcccctgtttctaccctcaggaggccccccgccaatgatagtggccacccatccctcctaa

SEQ ID NO: 7741 - protein, 10 aa, homo sapiens
MPCLHETMAS

SEQ ID NO: 7742 - DNA, 33 bp, homo sapiens
atgccatgcctgcatgagactatggcctcctag

SEQ ID NO: 7743 - protein, 18 aa, homo sapiens
MPLSPPPYCLVHTTQQPS

SEQ ID NO: 7744 - DNA, 57 bp, homo sapiens
atgcccctctcgcctcctccctactgcttggtgcacaccacacagcagccaagctga

SEQ ID NO: 7745 - protein, 51 aa, homo sapiens
MAWTALLLSLLAHFTGAAPSVPATYPAPRLWVQPGLTVISAGPCLWCAGCS

SEQ ID NO: 7746 - DNA, 156 bp, homo sapiens
atggcctggaccgctctccttctgagcctccttgctcactttacaggtgctgcccccagtgtcccagccacctacccagctccaaggctctgggtccagcctggcctgacagtgatctcagcagggccctgcctgtggtgtgcaggatgctcatga

SEQ ID NO: 7747 - protein, 69 aa, homo sapiens
MLMILLQGEGLLEVKSPHTVLLCSWSPEDTSIPETQARQVGRHCWVEPLSFKSILFSPLFLQVLWPPMS

SEQ ID NO: 7748 - DNA, 210 bp, homo sapiens
atgctcatgatcctgctgcagggggaggggctgctggaggtgaaatccccccacactgttcttctgtgctcatggtcccctgaggacacttctattcctgaaactcaggccaggcaggtgggaaggcattgttgggttgagcctctcagtttcaagtctattctattctctccccttttcttgcaggttctgtggcctcctatgagctga

SEQ ID NO: 7749 - protein, 41 aa, homo sapiens
MCTGTSRSQARPLCWSSIGIATGPLGSLSDSLAPTRGTRPP

SEQ ID NO: 7750 - DNA, 126 bp, homo sapiens
atgtgcactggtaccagcagaagccaggccaggcccctgtgctggtcatctatagggatagcaaccggccctctgggatccctgagcgattctctggctccaactcggggaacacggccaccctga

SEQ ID NO: 7751 - protein, 43 aa, homo sapiens
MRLTITVRCGTAALHTVTQADEEVRHKPFRHLCHPLSLIQGGL

SEQ ID NO: 7752 - DNA, 132 bp, homo sapiens
atgaggctgactattactgtcaggtgtgggacagcagcactgcacacagtaacacaggcagatgaagaagtgagacacaaaccctttcgccatctatgtcaccctctttctctaattcaaggaggactatga

SEQ ID NO: 7753 - protein, 56 aa, homo sapiens
MKQKIIRDRIKFQMNNTFVLGKCIRRFQIQFPTPLPNFYCEHPCFYERQYNYSVTQ

SEQ ID NO: 7754 - DNA, 171 bp, homo sapiens
atgaaacagaaaattattagagaccgtatcaaattccaaatgaacaatacatttgttcttggtaagtgtatcagaagatttcaaatacagttccctactccccttcccaatttctattgtgagcacccatgcttttatgaacgccaatacaattactcagtaacgcaataa

SEQ ID NO: 7755 - protein, 8 aa, homo sapiens
MNANTITQ

SEQ ID NO: 7756 - DNA, 27 bp, homo sapiens
atgaacgccaatacaattactcagtaa

SEQ ID NO: 7757 - protein, 67 aa, homo sapiens [sequence omitted]

SEQ ID NO: 7758 - DNA, 204 bp, homo sapiens
atgcaatacatttctttgccaagtatctcaacacaaactgaggtcatgcctggtgaaggcaatttaaggctctatgaaatgtcagccacgccactttatacttggaacacatctaaatacaaaattacatgttttcctatgcctcagtgcgcacaatttgcccaagtgaatgaaattgtgcctccacaaggctgtccattctga

SEQ ID NO: 7759 - protein, 31 aa, homo sapiens
MKCQPRHFILGTHLNTKLHVFLCLSAHNLPK

SEQ ID NO: 7760 - DNA, 96 bp, homo sapiens
atgaaatgtcagccacgccactttatacttggaacacatctaaatacaaaattacatgttttcctatgcctcagtgcgcacaatttgcccaagtga

SEQ ID NO: 7761 - protein, 74 aa, homo sapiens
MVHHPGNPLGLCSISLLLPVLWSRGTTASCPGIATRVSWTGSMGAWTPVLQAMGAPTVLPSSLGSSGCWKVWWS

SEQ ID NO: 7762 - DNA, 225 bp, homo sapiens
atggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctga

SEQ ID NO: 7763 - protein, 140 aa, homo sapiens [sequence omitted]

SEQ ID NO: 7764 - DNA, 423 bp, homo sapiens
atgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatgtgagtctgttgactttttcctgggcatcctaa

SEQ ID NO: 7765 - protein, 56 aa, homo sapiens
MCSGHSIVYSTSSRRAGGPLKMIFQRVAAFVPISGLAFFHLCTVRQPHSGGEEPCA

SEQ ID NO: 7766 - DNA, 171 bp, homo sapiens
atgtgctcaggacactccatagtgtacagcacctcatcccggcgggcagggggacctttaaaaatgattttccaacgagtggctgcctttgtgccgatttcaggtttggctttctttcacctttgcacagtgcgtcagccccacagtggaggtgaggaaccttgtgcctga

SEQ ID NO: 7767 - protein, 9 aa, homo sapiens
MTQLPCLLW

SEQ ID NO: 7768 - DNA, 30 bp, homo sapiens
atgacccagctcccttgccttctgtggtag

SEQ ID NO: 7769 - protein, 5 aa, homo sapiens
MGAEA

SEQ ID NO: 7770 - DNA, 18 bp, homo sapiens
atgggcgctgaagcttga

SEQ ID NO: 7771 - protein, 4 aa, homo sapiens
MSGT

SEQ ID NO: 7772 - DNA, 15 bp, homo sapiens
atgagcgggacttaa

SEQ ID NO: 7773 - protein, 19 aa, homo sapiens
MFNSAGAIGTLLFDYRNVV

SEQ ID NO: 7774 - DNA, 60 bp, homo sapiens; identical to SEQ ID NO: 6222

SEQ ID NO: 7775 - protein, 17 aa, homo sapiens
MWFDCGACGSHVGSARS

SEQ ID NO: 7776 - DNA, 54 bp, homo sapiens; identical to SEQ ID NO: 6224

SEQ ID NO: 7777 - protein, 22 aa, homo sapiens
MDQGVEGGGCGPGVGRQSACSL

SEQ ID NO: 7778 - DNA, 69 bp, homo sapiens; identical to SEQ ID NO: 4146

SEQ ID NO: 7779 - protein, 28 aa, homo sapiens
MKDGKEGYRDRGRVGLRIARAAWHTVLG

SEQ ID NO: 7780 - DNA, 87 bp, homo sapiens; identical to SEQ ID NO: 4148

SEQ ID NO: 7781 - protein, 41 aa, homo sapiens; identical to SEQ ID NO: 4149

SEQ ID NO: 7782 - DNA, 126 bp, homo sapiens; identical to SEQ ID NO: 4150

SEQ ID NO: 7783 - protein, 16 aa, homo sapiens
MILFPLDPAPLVPFSL

SEQ ID NO: 7784 - DNA, 51 bp, homo sapiens; identical to SEQ ID NO: 4152

SEQ ID NO: 7785 - protein, 22 aa, homo sapiens
MDQGVEGGGCGPGVGRQSACSL

SEQ ID NO: 7786 - DNA, 69 bp, homo sapiens; identical to SEQ ID NO: 4146

SEQ ID NO: 7787 - protein, 28 aa, homo sapiens
MKDGKEGYRDRGRVGLRIARAAWHTVLG

SEQ ID NO: 7788 - DNA, 87 bp, homo sapiens; identical to SEQ ID NO: 4148

SEQ ID NO: 7789 - protein, 41 aa, homo sapiens; identical to SEQ ID NO: 4149

SEQ ID NO: 7790 - DNA, 126 bp, homo sapiens; identical to SEQ ID NO: 4150

SEQ ID NO: 7791 - protein, 16 aa, homo sapiens
MILFPLDPAPLVPFSL

SEQ ID NO: 7792 - DNA, 51 bp, homo sapiens; identical to SEQ ID NO: 4152

SEQ ID NO: 7793 - protein, 22 aa, homo sapiens
MDQGVEGGGCGPGVGRQSACSL

SEQ ID NO: 7794 - DNA, 69 bp, homo sapiens; identical to SEQ ID NO: 4146

SEQ ID NO: 7795 - protein, 28 aa, homo sapiens
MKDGKEGYRDRGRVGLRIARAAWHTVLG

SEQ ID NO: 7796 - DNA, 87 bp, homo sapiens; identical to SEQ ID NO: 4148

SEQ ID NO: 7797 - protein, 41 aa, homo sapiens; identical to SEQ ID NO: 4149

SEQ ID NO: 7798 - DNA, 126 bp, homo sapiens; identical to SEQ ID NO: 4150

SEQ ID NO: 7799 - protein, 16 aa, homo sapiens
MILFPLDPAPLVPFSL

SEQ ID NO: 7800 - DNA, 51 bp, homo sapiens; identical to SEQ ID NO: 4152

SEQ ID NO: 7801 - protein, 83 aa, homo sapiens; identical to SEQ ID NO: 5561

SEQ ID NO: 7802 - DNA, 252 bp, homo sapiens; identical to SEQ ID NO: 5562

SEQ ID NO: 7803 - protein, 37 aa, homo sapiens; identical to SEQ ID NO: 5563

SEQ ID NO: 7804 - DNA, 114 bp, homo sapiens; identical to SEQ ID NO: 5564

SEQ ID NO: 7805 - protein, 118 aa, homo sapiens; identical to SEQ ID NO: 5565

SEQ ID NO: 7806 - DNA, 357 bp, homo sapiens; identical to SEQ ID NO: 5566

SEQ ID NO: 7807 - protein, 194 aa, homo sapiens; identical to SEQ ID NO: 5567

SEQ ID NO: 7808 - DNA, 585 bp, homo sapiens; identical to SEQ ID NO: 5568

SEQ ID NO: 7809 - protein, 202 aa, homo sapiens [sequence omitted]

SEQ ID NO: 7810 - DNA, 609 bp, homo sapiens
atggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacggtgagcggcgcgagcggcgcgggggcccggggcggggcagcccgggcgaggggcggggcctcagaggaccagtggccgcgctttggtcgcccccgaccctcagccggggtcccccgacgtctgcgctgagggccacactgacccttgagtctcctttcagtaacgatggtgatgatggtttttttagaaagtcttcctgctctgagccagtcaccccagtcttctctcactgggtaatttctgaatggaaacttcccatgactcggaacgcttattggtga

SEQ ID NO: 7811 - protein, 16 aa, homo sapiens
MRSRATSCAARYPLAG

SEQ ID NO: 7812 - DNA, 51 bp, homo sapiens
atgcggagccgcgcgacgagctgcgctgcaagatacccgctggccggctga

SEQ ID NO: 7813 - protein, 23 aa, homo sapiens
MVMMVFLESLPALSQSPQSSLTG

SEQ ID NO: 7814 - DNA, 72 bp, homo sapiens
atggtgatgatggtttttttagaaagtcttcctgctctgagccagtcaccccagtcttctctcactgggtaa

SEQ ID NO: 7815 - protein, 63 aa, homo sapiens
METSHDSERLLVNNKMRYWGTLLLSWRGEARACSQVVPACLNARTWTPLPQLDLRANDRPFQP

SEQ ID NO: 7816 - DNA, 192 bp, homo sapiens
atggaaacttcccatgactcggaacgcttattggtgaataataaaatgaggtactggggaacacttttattatcatggagaggggaggccagagcctgcagccaagtcgtaccagcttgtttaaatgcacggacttggactcctttaccacagttagaccttagggcaaatgatagaccctttcaaccttag

SEQ ID NO: 7817 - protein, 17 aa, homo sapiens
MARPPQKLNSGLRKIPF

SEQ ID NO: 7818 - DNA, 54 bp, homo sapiens
atggcaagaccaccccagaaactaaactcaggtctgcgtaaaattcccttttga

SEQ ID NO: 7819 - protein, 9 aa, homo sapiens
MNNCHLLNI

SEQ ID NO: 7820 - DNA, 30 bp, homo sapiens
atgaataactgtcaccttttaaatatatga

SEQ ID NO: 7821 - protein, 7 aa, homo sapiens
MTVPSYY

SEQ ID NO: 7822 - DNA, 24 bp, homo sapiens
atgactgtgccaagttactactaa

SEQ ID NO: 7823 - protein, 6 aa, homo sapiens
MDNTDY

SEQ ID NO: 7824 - DNA, 21 bp, homo sapiens
atggataacactgactactaa

SEQ ID NO: 7825 - protein, 16 aa, homo sapiens
MSRAPASLPLLPGWAV

SEQ ID NO: 7826 - DNA, 51 bp, homo sapiens; identical to SEQ ID NO: 4618

SEQ ID NO: 7827 - protein, 41 aa, homo sapiens; identical to SEQ ID NO: 4619

SEQ ID NO: 7828 - DNA, 126 bp, homo sapiens; identical to SEQ ID NO: 4620

SEQ ID NO: 7829 - protein, 13 aa, homo sapiens
MGLPRARRWQPGA

SEQ ID NO: 7830 - DNA, 42 bp, homo sapiens; identical to SEQ ID NO: 4622

SEQ ID NO: 7831 - protein, 36 aa, homo sapiens; identical to SEQ ID NO: 4623

SEQ ID NO: 7832 - DNA, 111 bp, homo sapiens; identical to SEQ ID NO: 4624

SEQ ID NO: 7833 - protein, 31 aa, homo sapiens
MDPSRAIQNEISSLKGAVLGPGPSRGARTTQ

SEQ ID NO: 7834 - DNA, 96 bp, homo sapiens
atggacccctcgcgagccatccagaacgagatcagctccctcaaaggtgcggtcctggggccgggcccgagccggggggcgcggaccacacagtga

SEQ ID NO: 7835 - protein, 93 aa, homo sapiens
MPQGGVCGAGRVGQEHSAPGSSLRLPFPPAGPWLVGGRGLPPSPAPSLLEEATALSCPEPAWGRRGWLGGGPAGVSPGTPAGLCRREPRSTCF

SEQ ID NO: 7836 - DNA, 282 bp, homo sapiens
atgccgcaggggggcgtgtgcggagctggcagggtgggccaggaacattctgctccgggctcctccctgcggcttcccttcccgcctgcaggcccctggctggtgggagggaggggactcccgccgagccccgccccatctctgctggaggaagctaccgccctttcctgcccggagccggcttgggggaggcggggctggttgggtggcggcccagcgggggtcagtcctggcacccctgcaggcctgtgtaggagagaacctaggtccacgtgcttttaa

SEQ ID NO: 7837 - protein, 23 aa, homo sapiens
MRSACRECRRSVWGGALRDWPRG

SEQ ID NO: 7838 - DNA, 72 bp, homo sapiens
atgcggtcggcctgccgggagtgcaggaggtcagtgtgggggggtgcgctgagggactggccaagagggtag

SEQ ID NO: 7839 - protein, 97 aa, homo sapiens
MPQRAGPARGLWEPWLCLRSFPATTPLCTQACACACVCARVCVCVCVCVFGACTVAPWRRPHKPAPTSCLLAACRLLASASHLGIPPLSHSPPPPYL

SEQ ID NO: 7840 - DNA, 294 bp, homo sapiens
atgccgcagcgagctggccctgccagagggctgtgggaaccgtggctatgccttcggagtttccccgccaccacacctctgtgtacgcaggcgtgcgcgtgcgcgtgcgtgtgtgcgcgcgtgtgtgtgtgtgtgtgtgtgtgtgtgtttggagcctgcaccgtggcgccatggcgacggccccataaacccgcccccacaagctgcttgttggccgcctgccggctgctggccagcgcctcccacctcgggatcccccctctctcccactcccccccaccgccctatttataa

SEQ ID NO: 7841 - protein, 81 aa, homo sapiens [sequence omitted]

SEQ ID NO: 7842 - DNA, 246 bp, homo sapiens
atgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcaggtaactgcgcagggccttgcctgtgcacctccttggcacgcgaggttgactga

SEQ ID NO: 7843 - protein, 85 aa, homo sapiens
MSPMEAVARPALGTHCPGTLGKRSGAGAAGVALGATGVSWTQLSGRSFASQVTAQGLACAPPWHARLTEFPLRARRWSGDWVGEA

SEQ ID NO: 7844 - DNA, 258 bp, homo sapiens
atgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcaggtaactgcgcagggccttgcctgtgcacctccttggcacgcgaggttgactgagttcccgctgcgtgctaggcgctggagcggggactgggtgggggaggcctag

SEQ ID NO: 7845 - protein, 53 aa, homo sapiens
MRPGVGLLAAASILDFNTVQCPDATRIIFWVPHQALGLGCHNGGQVGMYRSSV

SEQ ID NO: 7846 - DNA, 162 bp, homo sapiens
atgaggcctggggttgggcttcttgccgcggcgtccatccttgattttaacacggtccagtgcccagatgcaacaaggataattttttgggttccccaccaggccctcggtcttggctgccacaatggcggccaggtgggaatgtacaggagcagtgtatag

SEQ ID NO: 7847 - protein, 4 aa, homo sapiens
MQQG

SEQ ID NO: 7848 - DNA, 15 bp, homo sapiens
atgcaacaaggataa

SEQ ID NO: 7849 - protein, 63 aa, homo sapiens
MLIPGGQSRTVRCCQLWRGQASSIKSLFFFFNTESHSVAQAGVQWCDRSSLHATSASQVQPPG

SEQ ID NO: 7850 - DNA, 192 bp, homo sapiens
atgctgattcctggtggccagagccgcacggtgagatgctgtcagctgtggagagggcaggccagctccatcaagagtcttttttttttttttaacacagagtctcactctgttgcccaggctggagtgcagtggtgcgatcggagctcactgcatgcaacctccgcctcccaggttcagcctcctgggtag

SEQ ID NO: 7851 - protein, 19 aa, homo sapiens
MLSAVERAGQLHQESFFFF

SEQ ID NO: 7852 - DNA, 60 bp, homo sapiens
atgctgtcagctgtggagagggcaggccagctccatcaagagtcttttttttttttttaa

SEQ ID NO: 7853 - protein, 30 aa, homo sapiens
MQPPPPRFSLLGRWDYRREPPCLAKGIVFF

SEQ ID NO: 7854 - DNA, 93 bp, homo sapiens
atgcaacctccgcctcccaggttcagcctcctgggtagatgggattacaggcgtgaaccaccgtgcctggccaagggtatcgtttttttttga

SEQ ID NO: 7855 - protein, 5 aa, homo sapiens
MGLQA

SEQ ID NO: 7856 - DNA, 18 bp, homo sapiens
atgggattacaggcgtga

SEQ ID NO: 7857 - protein, 8 aa, homo sapiens
MVNPILCT

SEQ ID NO: 7858 - DNA, 27 bp, homo sapiens
atggttaatccaattctgtgcacctga

SEQ ID NO: 7859 - protein, 11 aa, homo sapiens
MTERMNGHMND

SEQ ID NO: 7860 - DNA, 36 bp, homo sapiens; identical to SEQ ID NO: 4068

SEQ ID NO: 7861 - protein, 48 aa, homo sapiens [sequence omitted]

SEQ ID NO: 7862 - DNA, 147 bp, homo sapiens; identical to SEQ ID NO: 4070

SEQ ID NO: 7863 - protein, 25 aa, homo sapiens
MKLNESERENKEKPIKKRTNTWVYL

SEQ ID NO: 7864 - DNA, 78 bp, homo sapiens; identical to SEQ ID NO: 4072

SEQ ID NO: 7865 - protein, 4 aa, homo sapiens
MRSP

SEQ ID NO: 7866 - DNA, 15 bp, homo sapiens
atgcggtcaccatag

SEQ ID NO: 7867 - protein, 47 aa, homo sapiens
MLSLARPPLPPTGLRTRSVPQSPSRDLRPRLAERPELVSRAPFSAAR

SEQ ID NO: 7868 - DNA, 144 bp, homo sapiens
atgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtga

SEQ ID NO: 7869 - protein, 18 aa, homo sapiens
MPCKMAPSAMALLRGCQC

SEQ ID NO: 7870 - DNA, 57 bp, homo sapiens
atgccctgcaagatggctccatcggccatggcgctcctgagaggctgtcagtgctga

SEQ ID NO: 7871 - protein, 11 aa, homo sapiens
MCAMRVAPDRS

SEQ ID NO: 7872 - DNA, 36 bp, homo sapiens
atgtgtgccatgcgagtggctccagaccgctcctga

SEQ ID NO: 7873 - protein, 25 aa, homo sapiens
MRPQLLALCNPRGARLSSPGARPRY

SEQ ID NO: 7874 - DNA, 78 bp, homo sapiens
atgcgaccccagctcctcgccctctgcaacccgcggggcgcccgcctctcctcaccgggcgcccggccgcggtattga

SEQ ID NO: 7875 - protein, 27 aa, homo sapiens
MDAWRAPGCECDCMTTLTPSFGKCALG

SEQ ID NO: 7876 - DNA, 84 bp, homo sapiens
atggacgcttggagggctcccgggtgtgagtgtgactgtatgactactctcacccccagcttcgggaaatgtgctctgggttga

SEQ ID NO: 7877 - protein, 15 aa, homo sapiens
MCSGLKCDHRAPQSF

SEQ ID NO: 7878 - DNA, 48 bp, homo sapiens
atgtgctctgggttgaaatgtgatcaccgagctcctcagtcattttaa

SEQ ID NO: 7879 - protein, 58 aa, homo sapiens
MRSLHWRSRLEGSGAACVCVCVCVCGHTHATEEYTTNYLGEGRGVHLVSPSWRGGRAS

SEQ ID NO: 7880 - DNA, 177 bp, homo sapiens
atgcggtcgttacattggaggagcagactggaaggtagtggggcggcgtgtgtgtgtgtgtgtgtgtgtgtgtgtggacacacacacgcaaccgaggaatacacaaccaactacttgggtgaagggcggggggttcacctagtgagtccttcttggcgggggggtcgggcgagttag

SEQ ID NO: 7881 - protein, 31 aa, homo sapiens [sequence omitted]

SEQ ID NO: 7882 - DNA, 96 bp, homo sapiens
atgagctggagctatgtggcactgggaactagggacctcgtggaggaaaggaggccggtgcggggagaaggtcgcgccgccgctctctttgtgtga

SEQ ID NO: 7883 - protein, 66 aa, homo sapiens
MWHWELGTSWRKGGRCGEKVAPPLSLCEPRLTLGLPARGRSWSGGDGTVRAASMALSRAVGGGCGG

SEQ ID NO: 7884 - DNA, 201 bp, homo sapiens
atgtggcactgggaactagggacctcgtggaggaaaggaggccggtgcggggagaaggtcgcgccgccgctctctttgtgtgagccccgcctcaccttgggtctcccggcccggggtcggagctggagcggcggggatggaacggtcagggctgcctcgatggctttgtctcgggcagtggggggaggatgcgggggatga

SEQ ID NO: 7885 - protein, 39 aa, homo sapiens [sequence omitted]

SEQ ID NO: 7886 - DNA, 120 bp, homo sapiens
atggaacggtcagggctgcctcgatggctttgtctcgggcagtggggggaggatgcgggggatgagacctcgggaccgcgtggtgggtgggggagggggtcggcgctcggctccgcctag

SEQ ID NO: 7887 - protein, 25 aa, homo sapiens
MRGMRPRDRVVGGGGGRRSAPPSST

SEQ ID NO: 7888 - DNA, 78 bp, homo sapiens
atgcgggggatgagacctcgggaccgcgtggtgggtgggggagggggtcggcgctcggctccgcctagtagcacgtag

SEQ ID NO: 7889 - protein, 24 aa, homo sapiens
MLAFSLSPANTDVGRLSKSIVKEL

SEQ ID NO: 7890 - DNA, 75 bp, homo sapiens
atgcttgctttctctctctctccagcaaataccgatgtaggcagactgagcaagtcaatcgtaaaggaactttag

SEQ ID NO: 7891 - protein, 77 aa, homo sapiens
MSGVQPCAPTVGRGPSVLPCCLTVTQSWILTKHTPRISAGVMQDSLWLTPLVPRPLLLAAVLVCKAELISPSPWRRV

SEQ ID NO: 7892 - DNA, 234 bp, homo sapiens
atgtcaggagtgcaaccatgtgctcccactgtgggcagagggccctcagtactaccgtgttgtctgacagttacacagtcttggatactcacaaaacacactcctcgtatcagtgctggggtcatgcaggactcactatggttgacacctcttgtgcccagacctctgctcttggccgctgtcctagtctgtaaagcagagctaataagccccagcccctggagaagggtgtaa

SEQ ID NO: 7893 - protein, 58 aa, homo sapiens [sequence omitted]

SEQ ID NO: 7894 - DNA, 177 bp, homo sapiens
atgtgctcccactgtgggcagagggccctcagtactaccgtgttgtctgacagttacacagtcttggatactcacaaaacacactcctcgtatcagtgctggggtcatgcaggactcactatggttgacacctcttgtgcccagacctctgctcttggccgctgtcctagtctgtaa

SEQ ID NO: 7895 - protein, 27 aa, homo sapiens
MQSTWHTMGVHPVPTPSSLLPFDDKLC

SEQ ID NO: 7896 - DNA, 84 bp, homo sapiens
atgcaaagtacctggcacacaatgggtgttcacccagtgccaacgccctcctctctcctcccctttgacgacaagctgtgctaa

SEQ ID NO: 7897 - protein, 48 aa, homo sapiens
MPGMRLVCRLAHGHFPRKGQRRRSLTVWKAETSRADCLGGKFWGHGTG

SEQ ID NO: 7898 - DNA, 147 bp, homo sapiens
atgccgggaatgaggctggtttgcaggttggcgcatggacattttcccagaaagggacagagacggcgaagtttgacggtctggaaagcagagaccagcagggctgactgcttgggaggtaagttctggggacatggtacagggtga

SEQ ID NO: 7899 - protein, 13 aa, homo sapiens
MDIFPERDRDGEV

SEQ ID NO: 7900 - DNA, 42 bp, homo sapiens
atggacattttcccagaaagggacagagacggcgaagtttga

SEQ ID NO: 7901 - protein, 26 aa, homo sapiens
MVQGEEQVSVLVATPLCLPPATPLPF

SEQ ID NO: 7902 - DNA, 81 bp, homo sapiens
atggtacagggtgaggagcaggtatcagtgctagttgcgacccctctgtgtctcccccccgccaccccattgccattctga

SEQ ID NO: 7903 - protein, 67 aa, homo sapiens
MLFISAPNIRTAPLGRSEKRTAICFSTGAQDSSQRAPFRLQNPGQLLQVTGEPFDPDFAGGGRERVV

SEQ ID NO: 7904 - DNA, 204 bp, homo sapiens
atgctatttatttcagcaccaaatatccggacagcgcctctcgggaggtccgagaagagaaccgcgatctgtttcagcaccggggctcaggacagttcccagcgggctccgtttcgtctccagaaccctggacagctcctccaggtaacgggagagccctttgaccctgattttgcagggggaggacgagagagggtggtctga

SEQ ID NO: 7905 - protein, 50 aa, homo sapiens
MAAPSPSGGGGSGGGSGSGTPGPVGSPAPGHPAVSSMQGKERGRAEIPAP

SEQ ID NO: 7906 - DNA, 153 bp, homo sapiens
atggcggctccgagcccgagcggcggcggcggctccgggggcggcagcggcagcggcacccccggccccgtagggtccccggcgccaggccacccggccgtcagcagcatgcagggtaaggaacgcggccgcgccgagatcccagccccctag

SEQ ID NO: 7907 - protein, 15 aa, homo sapiens
MGVGGGLPRPVPPVR

SEQ ID NO: 7908 - DNA, 48 bp, homo sapiens
atgggggtggggggcgggttgcccaggcctgtgccacctgtaaggtag

SEQ ID NO: 7909 - protein, 6 aa, homo sapiens
MERYRK

SEQ ID NO: 7910 - DNA, 21 bp, homo sapiens
atggagagatacaggaaatag

SEQ ID NO: 7911 - protein, 9 aa, homo sapiens
MTFPTGNAY

SEQ ID NO: 7912 - DNA, 30 bp, homo sapiens
atgactttccccactgggaatgcttattag

SEQ ID NO: 7913 - protein, 22 aa, homo sapiens
MDQGVEGGGCGPGVGRQSACSL

SEQ ID NO: 7914 - DNA, 69 bp, homo sapiens; identical to SEQ ID NO: 4146

SEQ ID NO: 7915 - protein, 28 aa, homo sapiens
MKDGKEGYRDRGRVGLRIARAAWHTVLG

SEQ ID NO: 7916 - DNA, 87 bp, homo sapiens; identical to SEQ ID NO: 4148

SEQ ID NO: 7917 - protein, 41 aa, homo sapiens; identical to SEQ ID NO: 4149

SEQ ID NO: 7918 - DNA, 126 bp, homo sapiens; identical to SEQ ID NO: 4150

SEQ ID NO: 7919 - protein, 16 aa, homo sapiens
MILFPLDPAPLVPFSL

SEQ ID NO: 7920 - DNA, 51 bp, homo sapiens; identical to SEQ ID NO: 4152

SEQ ID NO: 7921 - protein, 13 aa, homo sapiens
MTKDVKNADMGIK

SEQ ID NO: 7922 - DNA, 42 bp, homo sapiens
atgacaaaagatgttaaaaatgctgatatgggcataaaataa

SEQ ID NO: 7923 - protein, 8 aa, homo sapiens
MLKMLIWA

SEQ ID NO: 7924 - DNA, 27 bp, homo sapiens
atgttaaaaatgctgatatgggcataa

SEQ ID NO: 7925 - protein, 11 aa, homo sapiens
MACGENCKAGL

SEQ ID NO: 7926 - DNA, 36 bp, homo sapiens
atggcttgtggagagaattgcaaggctggactatag

SEQ ID NO: 7927 - protein, 10 aa, homo sapiens
MDVYFSLYLF

SEQ ID NO: 7928 - DNA, 33 bp, homo sapiens
atggatgtttacttttccctgtatcttttttga

SEQ ID NO: 7929 - protein, 8 aa, homo sapiens
MVNPILCT

SEQ ID NO: 7930 - DNA, 27 bp, homo sapiens
atggttaatccaattctgtgcacctga

SEQ ID NO: 7931 - protein, 11 aa, homo sapiens
MTERMNGHMND

SEQ ID NO: 7932 - DNA, 36 bp, homo sapiens; identical to SEQ ID NO: 4068

SEQ ID NO: 7933 - protein, 48 aa, homo sapiens [sequence omitted]

SEQ ID NO: 7934 - DNA, 147 bp, homo sapiens; identical to SEQ ID NO: 4070

SEQ ID NO: 7935 - protein, 25 aa, homo sapiens
MKLNESERENKEKPIKKRTNTWVYL

SEQ ID NO: 7936 - DNA, 78 bp, homo sapiens; identical to SEQ ID NO: 4072

SEQ ID NO: 7937 - protein, 5 aa, homo sapiens
MTSMC

SEQ ID NO: 7938 - DNA, 18 bp, homo sapiens
atgacatcaatgtgctag

SEQ ID NO: 7939 - protein, 6 aa, homo sapiens
MHTSWL

SEQ ID NO: 7940 - DNA, 21 bp, homo sapiens
atgcatacatcatggctttga

SEQ ID NO: 7941 - protein, 25 aa, homo sapiens
MALKKIGLRTRQSKTKQTDKNSNQT

SEQ ID NO: 7942 - DNA, 78 bp, homo sapiens
atggctttgaaaaaaataggtctgagaacgaggcaaagtaaaactaagcaaacagataagaatagcaaccaaacctga

SEQ ID NO: 7943 - protein, 16 aa, homo sapiens
MTTILSFYIAYLETYD

SEQ ID NO: 7944 - DNA, 51 bp, homo sapiens
atgacaacaattctaagtttttacattgcctaccttgaaacctatgattga

SEQ ID NO: 7945 - protein, 86 aa, homo sapiens [sequence omitted]

SEQ ID NO: 7946 - DNA, 261 bp, homo sapiens
atgggagcaggggagggtgtaggggccagtatttctcgggctagtgacgaactgcctgattctttgcagcctagacagaggaggcaggagccccaggggcgggctaatcgcctgggctggggatgcctgggcagatgcagaggaagctggaaaggtggcagtgcacctgggtcgctggagctgccgccgttcctaggagaccaaggagcagcaagcctgcgggggagggggagcaagtgggttgctgcttttagcagctga

SEQ ID NO: 7947 - protein, 43 aa, homo sapiens
MPGQMQRKLERWQCTWVAGAAAVPRRPRSSKPAGEGEQVGCCF

SEQ ID NO: 7948 - DNA, 132 bp, homo sapiens
atgcctgggcagatgcagaggaagctggaaaggtggcagtgcacctgggtcgctggagctgccgccgttcctaggagaccaaggagcagcaagcctgcgggggagggggagcaagtgggttgctgcttttag

SEQ ID NO: 7949 - protein, 6 aa, homo sapiens
MLNHCC

SEQ ID NO: 7950 - DNA, 21 bp, homo sapiens
atgctgaatcactgttgctga

SEQ ID NO: 7951 - protein, 35 aa, homo sapiens
MEGERYVCISVCCVVCVCKCMCACGAATSFCVCIG

SEQ ID NO: 7952 - DNA, 108 bp, homo sapiens
atggagggtgaaaggtatgtatgtataagtgtgtgctgtgttgtgtgtgtatgtaagtgtatgtgtgcttgcggtgcagccaccagcttttgtgtttgcattggctag

SEQ ID NO: 7953 - protein, 7 aa, homo sapiens
MIKTYNH

SEQ ID NO: 7954 - DNA, 24 bp, homo sapiens
atgataaaaacatataatcattag

SEQ ID NO: 7955 - protein, 4 aa, homo sapiens
MVFL

SEQ ID NO: 7956 - DNA, 15 bp, homo sapiens
atggtgtttctctaa

SEQ ID NO: 7957 - protein, 12 aa, homo sapiens
MMFLHSVFDCVY

SEQ ID NO: 7958 - DNA, 39 bp, homo sapiens
atgatgtttttgcacagtgtttttgactgtgtttattaa

SEQ ID NO: 7959 - protein, 13 aa, homo sapiens
MQIHINKCKLLRF

SEQ ID NO: 7960 - DNA, 42 bp, homo sapiens
atgcagattcacataaacaagtgcaaattgttgaggttttaa

SEQ ID NO: 7961 - protein, 51 aa, homo sapiens
MMGHRLPVRGVGLFLSPLPAPAAAVGTGAQPILKPCGEGPVTPVLASSQGP

SEQ ID NO: 7962 - DNA, 156 bp, homo sapiens
atgatgggtcacagactccccgtccgaggtgtcggtctgttcctctcgccgctcccggctcccgctgcggctgttggaactggagcgcagcccatcttgaagccctgcggggaggggccggtgacgccagtgctggccagctctcaggggccataa

SEQ ID NO: 7963 - protein, 119 aa, homo sapiens
MFSPPRHPIWDPPGCAWGESLLQGAVGTAPRASWRDSPPPTLHPSPPLPDVGGVGDPLRDRPRGLTRSHDPLPRSPEVQRAHPSFQMCGSPSPAPSSRSRTDLSSAPVCPATASSSASR

SEQ ID NO: 7964 - DNA, 360 bp, homo sapiens
atgttcagtcctcccagacaccctatttgggaccctcccggatgtgcgtggggggagtcactccttcagggagcagtggggacggcgccccgtgctagctggagggattcccctcccccaactctccatccttccccaccccttccagatgtagggggggtgggggatcccctccgcgataggccgcgagggttgacgcggtcccacgaccccctcccacgatccccagaggtgcagcgggcacacccctccttccagatgtgcggaagcccgagccccgccccctcctcccgctcccgcactgacctctcttccgctcccgtttgtcctgcaactgcttcttcttctgcttcacgctga

SEQ ID NO: 7965 - protein, 18 aa, homo sapiens
MCVGGVTPSGSSGDGAPC

SEQ ID NO: 7966 - DNA, 57 bp, homo sapiens
atgtgcgtggggggagtcactccttcagggagcagtggggacggcgccccgtgctag

SEQ ID NO: 7967 - protein, 68 aa, homo sapiens
MASSSAWPGPVTWPALRRAPAASTDCPPGQPPPQGPGTLEEAGLAGDVSGRARQNYRRGGDGRRTGEI

SEQ ID NO: 7968 - DNA, 207 bp, homo sapiens
atggcttcttcctcggcatggcccggaccagtcacctggcccgccctccgccgagctcccgccgcctcaactgactgccccccggggcagcccccgccgcaggggcccgggaccctagaggaggcggggctagcaggtgacgtcagcgggcgggcccgacagaattaccgccgcggcggcgatggaaggcggacgggggagatatag

SEQ ID NO: 7969 - protein, 6 aa, homo sapiens
MSIISQ

SEQ ID NO: 7970 - DNA, 21 bp, homo sapiens
atgtcaattatatctcagtaa

SEQ ID NO: 7971 - protein, 8 aa, homo sapiens
MNRSSTAP

SEQ ID NO: 7972 - DNA, 27 bp, homo sapiens
atgaaccgaagctccactgcaccgtga

SEQ ID NO: 7973 - protein, 16 aa, homo sapiens
MLGSSSLFTIVHFGIL

SEQ ID NO: 7974 - DNA, 51 bp, homo sapiens
atgttgggctccagttccctgtttacaattgtacacttcgggattttgtga

SEQ ID NO: 7975 - protein, 12 aa, homo sapiens
MTQSVSRPMTLS

SEQ ID NO: 7976 - DNA, 39 bp, homo sapiens
atgacccagtcagtctcgcgccccatgaccctctcctaa

SEQ ID NO: 7977 - protein, 36 aa, homo sapiens
MWPPVPGLCHSLCACPTGATTPDHVDASSREQHGPH

SEQ ID NO: 7978 - DNA, 111 bp, homo sapiens
atgtggcctccagtgcctggcctttgtcactcactctgtgcttgtcccacaggagccaccacccctgaccatgtagatgccagttccagggagcagcatgggccccactga

SEQ ID NO: 7979 - protein, 20 aa, homo sapiens
MPVPGSSMGPTEWRLLGLQP

SEQ ID NO: 7980 - DNA, 63 bp, homo sapiens
atgccagttccagggagcagcatgggccccactgaatggagactcctgggtctacagccctga

SEQ ID NO: 7981 - protein, 54 aa, homo sapiens
METPGSTALSPSGPWTSSHTGGHLLELTTTVTSPPRPPPPPGTRSRPPGATADQ

SEQ ID NO: 7982 - DNA, 165 bp, homo sapiens
atggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtga

SEQ ID NO: 7983 - protein, 78 aa, homo sapiens [sequence omitted]

SEQ ID NO: 7984 - DNA, 237 bp, homo sapiens
atgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtaagtgttcaagacttgaacccagggctgcagcctag

SEQ ID NO: 7985 - protein, 32 aa, homo sapiens
MGTRRRRRGEPLGGPGARAVRGAAPAGPQRGL

SEQ ID NO: 7986 - DNA, 99 bp, homo sapiens
atggggacccggcggcggcggcgcggtgagcctctgggcggccccggggcgcgggctgtgcgcggcgctgcgcccgccggcccccagcgcggattgtaa

SEQ ID NO: 7987 - protein, 9 aa, homo sapiens
MECPGRRRA

SEQ ID NO: 7988 - DNA, 30 bp, homo sapiens
atggagtgtcccgggagacggcgggcatga

SEQ ID NO: 7989 - protein, 49 aa, homo sapiens
MTATGWARTMANSTAVRVSGPPVLRLPDRVPPPLSLALPTGKGGSRPRP

SEQ ID NO: 7990 - DNA, 150 bp, homo sapiens
atgacggctacaggatgggcgcgaacaatggcaaacagtacggcagtgagggtgagtgggccgcccgtcctcagactcccggatcgcgtccctcctcccctttccctcgccctcccgactgggaagggaggttctcgcccgcggccgtga

SEQ ID NO: 7991 - protein, 63 aa, homo sapiens
MGANNGKQYGSEGEWAARPQTPGSRPSSPFPRPPDWEGRFSPAAVTHPIWHPVWVTTFSFGSE

SEQ ID NO: 7992 - DNA, 192 bp, homo sapiens
atgggcgcgaacaatggcaaacagtacggcagtgagggtgagtgggccgcccgtcctcagactcccggatcgcgtccctcctcccctttccctcgccctcccgactgggaagggaggttctcgcccgcggccgtgacgcaccccatttggcaccctgtctgggtcaccaccttctcctttggcagtgagtga

SEQ ID NO: 7993 - protein, 22 aa, homo sapiens
MDQGVEGGGCGPGVGRQSACSL

SEQ ID NO: 7994 - DNA, 69 bp, homo sapiens; identical to SEQ ID NO: 4146

SEQ ID NO: 7995 - protein, 28 aa, homo sapiens
MKDGKEGYRDRGRVGLRIARAAWHTVLG

SEQ ID NO: 7996 - DNA, 87 bp, homo sapiens; identical to SEQ ID NO: 4148

SEQ ID NO: 7997 - protein, 41 aa, homo sapiens; identical to SEQ ID NO: 4149

SEQ ID NO: 7998 - DNA, 126 bp, homo sapiens; identical to SEQ ID NO: 4150

SEQ ID NO: 7999 - protein, 16 aa, homo sapiens
MILFPLDPAPLVPFSL

SEQ ID NO: 8000 - DNA, 51 bp, homo sapiens; identical to SEQ ID NO: 4152

SEQ ID NO: 8001 - protein, 19 aa, homo sapiens
MGTLPDLFPGGVSAVSFSP

SEQ ID NO: 8002 - DNA, 60 bp, homo sapiens
atgggtactctcccggatctcttcccgggtggggtctctgctgtttccttctctccttga

SEQ ID NO: 8003 - protein, 172 aa, homo sapiens
MRPRSSREGQWRPGEAGEASAWVAAVFPGGTKSPRVPSTWDQRNSCSWPEWESGKWGTRNFLGLDRGQLPDFDATGHRVLSTPFSVSVVSVSPCLRFLLLFCLGLHFSLHPPPQLHSCPFPPTPADGRPGSCGGAGGGGGREAAWKRRRQQPGGGVGCYLWLSSCMSGVESS

SEQ ID NO: 8004 - DNA, 519 bp, homo sapiens
atgcgccctcgatcttccagagaagggcagtggagacccggcgaggctggggaggcctctgcctgggtcgctgcggtcttcccgggtggcacgaaaagcccgcgcgtcccttccacctgggaccagcggaactcctgctcctggcccgaatgggagagcgggaaatggggcaccagaaactttttgggtctggatcggggtcaactccccgacttcgacgccacgggtcatcgcgtcctttccacgcctttttcggtctctgtcgtgtctgtatctccgtgtctgaggtttttgttgttgttttgtctcggacttcatttctctcttcaccctccccctcaactccactcgtgtcccttccctcctactcccgctgacgggcgaccgggaagctgcggaggtgctggcggcggcggcggccgggaggctgcgtggaagaggcggcgacagcagccaggaggcggggttggttgttatctttggttatctagctgtatgagtggtgtggagtcttcataa

SEQ ID NO: 8005 - protein, 75 aa, homo sapiens
MGEREMGHQKLFGSGSGSTPRLRRHGSSRPFHAFFGLCRVCISVSEVFVVVLSRTSFLSSPSPSTPLVSLPSYSR

SEQ ID NO: 8006 - DNA, 228 bp, homo sapiens
atgggagagcgggaaatggggcaccagaaactttttgggtctggatcggggtcaactccccgacttcgacgccacgggtcatcgcgtcctttccacgcctttttcggtctctgtcgtgtctgtatctccgtgtctgaggtttttgttgttgttttgtctcggacttcatttctctcttcaccctccccctcaactccactcgtgtcccttccctcctactcccgctga

SEQ ID NO: 8007 - protein, 23 aa, homo sapiens
MGPFLAVWVTAWEADLREKSVEI

SEQ ID NO: 8008 - DNA, 72 bp, homo sapiens
atggggccttttctggcagtctgggtcactgcttgggaagctgatctaagggagaaatcagttgaaatctag

SEQ ID NO: 8009 - protein, 18 aa, homo sapiens
MDRQMLRHRSCILHSTRG

SEQ ID NO: 8010 - DNA, 57 bp, homo sapiens
atggatagacagatgctacgtcatcggagctgcatcctccactccacaagaggctag

SEQ ID NO: 8011 - protein, 28 aa, homo sapiens
MEAGAKSSQKEKADKRFRGVPKMDEACV

SEQ ID NO: 8012 - DNA, 87 bp, homo sapiens
atggaggctggtgcaaaatcatcacagaaagaaaaggctgataaaagatttaggggggtccccaaaatggatgaggcatgtgtgtag

SEQ ID NO: 8013 - protein, 23 aa, homo sapiens
MRHVCRGGVGSKALTSSLLGTYR

SEQ ID NO: 8014 - DNA, 72 bp, homo sapiens
atgaggcatgtgtgtagaggtggagttggcagcaaggctctcacctccagcctcctgggcacctatcgctga

SEQ ID NO: 8015 - protein, 51 aa, homo sapiens
MCVEVELAARLSPPASWAPIAEPKAVALPTRPRVSPGSPPSPSPCRLETAH

SEQ ID NO: 8016 - DNA, 156 bp, homo sapiens
atgtgtgtagaggtggagttggcagcaaggctctcacctccagcctcctgggcacctatcgctgagcccaaggcagtggctctgcccacccgccccagagtgtctcctggttcccctccttcccccagcccatgcaggctggagacagctcactaa

SEQ ID NO: 8017 - protein, 5 aa, homo sapiens
MKIDV

SEQ ID NO: 8018 - DNA, 18 bp, homo sapiens
atgaaaattgatgtttaa

SEQ ID NO: 8019 - protein, 20 aa, homo sapiens
MFKTIDKGSGFSLQQSCVQH

SEQ ID NO: 8020 - DNA, 63 bp, homo sapiens
atgtttaaaacaatagacaaaggctcaggattttcattacagcagagttgtgtacagcattag

SEQ ID NO: 8021 - protein, 30 aa, homo sapiens
MKSACLEHSVRTYRTKYAALSPWYIDTKHD

SEQ ID NO: 8022 - DNA, 93 bp, homo sapiens
atgaagtccgcttgcttagagcattcagttcgaacttacagaacaaaatatgctgccctatcgccatggtacatagatacaaaacatgactga

SEQ ID NO: 8023 - protein, 8 aa, homo sapiens
MLPYRHGT

SEQ ID NO: 8024 - DNA, 27 bp, homo sapiens
atgctgccctatcgccatggtacatag

SEQ ID NO: 8025 - protein, 13 aa, homo sapiens
MLLGHHLPGPRSR

SEQ ID NO: 8026 - DNA, 42 bp, homo sapiens; identical to SEQ ID NO: 1770

SEQ ID NO: 8027 - protein, 34 aa, homo sapiens; identical to SEQ ID NO: 1771

SEQ ID NO: 8028 - DNA, 105 bp, homo sapiens; identical to SEQ ID NO: 1772

SEQ ID NO: 8029 - protein, 4 aa, homo sapiens
MGCG

SEQ ID NO: 8030 - DNA, 15 bp, homo sapiens
atgggatgcgggtga

SEQ ID NO: 8031 - protein, 68 aa, homo sapiens; identical to SEQ ID NO: 1775

SEQ ID NO: 8032 - DNA, 207 bp, homo sapiens; identical to SEQ ID NO: 1776

SEQ ID NO: 8033 - protein, 142 aa, homo sapiens; identical to SEQ ID NO: 4497

SEQ ID NO: 8034 - DNA, 429 bp, homo sapiens; identical to SEQ ID NO: 4498

SEQ ID NO: 8035 - protein, 36 aa, homo sapiens; identical to SEQ ID NO: 4499

SEQ ID NO: 8036 - DNA, 111 bp, homo sapiens; identical to SEQ ID NO: 4500

SEQ ID NO: 8037 - protein, 125 aa, homo sapiens [sequence omitted]

SEQ ID NO: 8038 - DNA, 378 bp, homo sapiens; identical to SEQ ID NO: 4502

SEQ ID NO: 8039 - protein, 123 aa, homo sapiens [sequence omitted]

SEQ ID NO: 8040 - DNA, 372 bp, homo sapiens; identical to SEQ ID NO: 4504

SEQ ID NO: 8041 - protein, 5 aa, homo sapiens
MGGGE

SEQ ID NO: 8042 - DNA, 18 bp, homo sapiens
atggggggtggcgaatag

SEQ ID NO: 8043 - protein, 7 aa, homo sapiens
MSCLMNC

SEQ ID NO: 8044 - DNA, 24 bp, homo sapiens
atgtcttgtttaatgaactgctaa

SEQ ID NO: 8045 - protein, 15 aa, homo sapiens
MSLLGSYFYLFPLIG

SEQ ID NO: 8046 - DNA, 48 bp, homo sapiens; identical to SEQ ID NO: 3910

SEQ ID NO: 8047 - protein, 16 aa, homo sapiens
MISSFPTFFCLSNQDT

SEQ ID NO: 8048 - DNA, 51 bp, homo sapiens; identical to SEQ ID NO: 3912

SEQ ID NO: 8049 - protein, 20 aa, homo sapiens
MVVVKWVGRGQNRFRQALAA

SEQ ID NO: 8050 - DNA, 63 bp, homo sapiens
atggtggtggtgaaatgggtggggagggggcagaacagattcaggcaggcgctggctgcttga

SEQ ID NO: 8051 - protein, 38 aa, homo sapiens
MGGEGAEQIQAGAGCLRGGAGTGAYRFIPVPPLPARPP

SEQ ID NO: 8052 - DNA, 117 bp, homo sapiens
atgggtggggagggggcagaacagattcaggcaggcgctggctgcttgagaggtggagcgggcacaggcgcctaccgctttataccggtccccccactccccgcccgcccgccctag

SEQ ID NO: 8053 - protein, 6 aa, homo sapiens
MGNKAS

SEQ ID NO: 8054 - DNA, 21 bp, homo sapiens
atggggaacaaagccagctag

SEQ ID NO: 8055 - protein, 35 aa, homo sapiens
MSGLGASFGLPPPTTSRNSPTLLTAPCPVPHAVLP

SEQ ID NO: 8056 - DNA, 108 bp, homo sapiens
atgagtggactaggtgctagttttgggctccctccccccaccacttcccggaatagccccacccttctaaccgctccctgtcccgttccacacgcagttctaccctga

SEQ ID NO: 8057 - protein, 89 aa, homo sapiens; identical to SEQ ID NO: 3913

SEQ ID NO: 8058 - DNA, 270 bp, homo sapiens; identical to SEQ ID NO: 3914

SEQ ID NO: 8059 - protein, 32 aa, homo sapiens [sequence omitted]

SEQ ID NO: 8060 - DNA, 99 bp, homo sapiens; identical to SEQ ID NO: 3916

SEQ ID NO: 8061 - protein, 5 aa, homo sapiens
MLKKS

SEQ ID NO: 8062 - DNA, 18 bp, homo sapiens
atgttgaagaaaagctag

SEQ ID NO: 8063 - protein, 17 aa, homo sapiens
MANGWTGSRPGRRNPEL

SEQ ID NO: 8064 - DNA, 54 bp, homo sapiens; identical to SEQ ID NO: 3920

SEQ ID NO: 8065 - protein, 7 aa, homo sapiens
MSATEPS

SEQ ID NO: 8066 - DNA, 24 bp, homo sapiens
atgagtgccacagagccgtcataa

SEQ ID NO: 8067 - protein, 48 aa, homo sapiens
MILTTSACERPPHRPPRPGPQEPEEPRGAQRRPSGLQLDGAAAPRPGT

SEQ ID NO: 8068 - DNA, 147 bp, homo sapiens
atgattctcacaacttctgcgtgcgagcgcccgccccaccgaccgccccggcccggcccgcaagagccagaggagccgagaggagcccagcgccggcccagcggactccagctcgacggagcggccgcgccccgaccaggtacctga

SEQ ID NO: 8069 - protein, 11 aa, homo sapiens
MQMRWERDSGR

SEQ ID NO: 8070 - DNA, 36 bp, homo sapiens
atgcaaatgcgatgggagagagacagcggtcggtag

SEQ ID NO: 8071 - protein, 14 aa, homo sapiens
MGERQRSVGGGWRE

SEQ ID NO: 8072 - DNA, 45 bp, homo sapiens
atgggagagagacagcggtcggtagggggtgggtggagggagtga

SEQ ID NO: 8073 - protein, 67 aa, homo sapiens
MSAGGCWGPRDQRVPALARGAARAGWHSEAAPATPGKITQRLHPTFAPGFCSPEGPERSPLPCARSA

SEQ ID NO: 8074 - DNA, 204 bp, homo sapiens
atgagtgcaggtgggtgctggggaccgagggaccaacgggtccccgcgctggctcgcggcgccgcaagggctgggtggcattcggaggctgcacctgcaacgccggggaaaatcacccagcggctccacccaacttttgctccaggattttgcagccccgaggggccagagcgcagccctctgccctgcgcccggagcgcgtag

SEQ ID NO: 8075 - protein, 41 aa, homo sapiens
MSGRRPFFASHGGPGCSRLQKAVRVRAGAWGPGEGPGPQQT

SEQ ID NO: 8076 - DNA, 126 bp, homo sapiens
atgtctggaaggcgccccttctttgcttctcacgggggtccgggttgttccaggctgcagaaagcggtcagggtccgcgcgggggcctggggtccgggcgaagggccggggccccagcagacctag

SEQ ID NO: 8077 - protein, 122 aa, homo sapiens [sequence omitted]

SEQ ID NO: 8078 - DNA, 369 bp, homo sapiens
atgataggcggggctttgcagctgggggcgccgcccttgcgccgctctggcagcgcctgggttgggggcgtcaggccgaccctcggcgcccaggactctccgcagcagatctggggacccggagcccgcatgtgtcagacccggccccgacccgatctctgcgcgtctccagcccctcgcccctgcgcgtcgcacccctgcctttcccgccgcacccaccctccgggatctgacagcctctgtgcggggctggaaaaatcccacagcgctggagcccagccgcgccttgtgctgttggggaaactgagacctagaactggagcccttggcggtgagccctggaggcggcctgaggatgcccggatctga

SEQ ID NO: 8079 - protein, 13 aa, homo sapiens
MPGSESLLGPAPG

SEQ ID NO: 8080 - DNA, 42 bp, homo sapiens
atgcccggatctgagagcctcctggggcccgcaccgggctga

SEQ ID NO: 8081 - protein, 27 aa, homo sapiens
MCIFFIPRGASHSAHFANGKLRLREVK

SEQ ID NO: 8082 - DNA, 84 bp, homo sapiens; identical to SEQ ID NO: 4554

SEQ ID NO: 8083 - protein, 6 aa, homo sapiens
MPWGQG

SEQ ID NO: 8084 - DNA, 21 bp, homo sapiens
atgccatggggccagggttag

SEQ ID NO: 8085 - protein, 27 aa, homo sapiens
MGPGLAGEPHHSERGQWQNHGRISGSA

SEQ ID NO: 8086 - DNA, 84 bp, homo sapiens; identical to SEQ ID NO: 4558

SEQ ID NO: 8087 - protein, 22 aa, homo sapiens
MAEPRPHQWVCVRGLYPGHLSP

SEQ ID NO: 8088 - DNA, 69 bp, homo sapiens; identical to SEQ ID NO: 4560

SEQ ID NO: 8089 - protein, 59 aa, homo sapiens [sequence omitted]

SEQ ID NO: 8090 - DNA, 180 bp, homo sapiens; identical to SEQ ID NO: 3810

SEQ ID NO: 8091 - protein, 9 aa, homo sapiens
MDSQETSGK

SEQ ID NO: 8092 - DNA, 30 bp, homo sapiens; identical to SEQ ID NO: 3812

SEQ ID NO: 8093 - protein, 7 aa, homo sapiens
MQKGCVV

SEQ ID NO: 8094 - DNA, 24 bp, homo sapiens
atgcagaaaggatgtgtggtataa

SEQ ID NO: 8095 - protein, 14 aa, homo sapiens
MCGIMERADMGSDF

SEQ ID NO: 8096 - DNA, 45 bp, homo sapiens; identical to SEQ ID NO: 3816

SEQ ID NO: 8097 - protein, 26 aa, homo sapiens
MHLLCPCCRKEPADWPLSAAHSTGWL

SEQ ID NO: 8098 - DNA, 81 bp, homo sapiens; identical to SEQ ID NO: 3762

SEQ ID NO: 8099 - protein, 50 aa, homo sapiens; identical to SEQ ID NO: 3763

SEQ ID NO: 8100 - DNA, 153 bp, homo sapiens; identical to SEQ ID NO: 3764

SEQ ID NO: 8101 - protein, 8 aa, homo sapiens
MPCLISHS

SEQ ID NO: 8102 - DNA, 27 bp, homo sapiens
atgccctgtctcatttcgcatagctaa

SEQ ID NO: 8103 - protein, 24 aa, homo sapiens
MLIKIPCLNLKNNDSAVIRNLVRV

SEQ ID NO: 8104 - DNA, 75 bp, homo sapiens; identical to SEQ ID NO: 3768

SEQ ID NO: 8105 - protein, 25 aa, homo sapiens
MVCERISVCLGRKLFDLQKSQKTSR

SEQ ID NO: 8106 - DNA, 78 bp, homo sapiens; identical to SEQ ID NO: 3770

SEQ ID NO: 8107 - protein, 24 aa, homo sapiens
MFTFVEVQNVLTIVCLFFVCLFKS

SEQ ID NO: 8108 - DNA, 75 bp, homo sapiens; identical to SEQ ID NO: 3772

SEQ ID NO: 8109 - protein, 7 aa, homo sapiens
MLLWKEY

SEQ ID NO: 8110 - DNA, 24 bp, homo sapiens
atgttgctttggaaggaatattaa

SEQ ID NO: 8111 - protein, 6 aa, homo sapiens
MRPLCT

SEQ ID NO: 8112 - DNA, 21 bp, homo sapiens
atgaggcccctttgcacatga

SEQ ID NO: 8113 - protein, 17 aa, homo sapiens
MLLLDSSCLIFLLLWLF

SEQ ID NO: 8114 - DNA, 54 bp, homo sapiens; identical to SEQ ID NO: 3778

SEQ ID NO: 8115 - protein, 42 aa, homo sapiens [sequence omitted]

SEQ ID NO: 8116 - DNA, 129 bp, homo sapiens; identical to SEQ ID NO: 3780

SEQ ID NO: 8117 - protein, 13 aa, homo sapiens
MSVTVEILLMVFI

SEQ ID NO: 8118 - DNA, 42 bp, homo sapiens; identical to SEQ ID NO: 3782

SEQ ID NO: 8119 - protein, 57 aa, homo sapiens; identical to SEQ ID NO: 3783

SEQ ID NO: 8120 - DNA, 174 bp, homo sapiens; identical to SEQ ID NO: 3784

SEQ ID NO: 8121 - protein, 301 aa, homo sapiens; identical to SEQ ID NO: 33

SEQ ID NO: 8122 - DNA, 906 bp, homo sapiens; identical to SEQ ID NO: 34

SEQ ID NO: 8123 - protein, 41 aa, homo sapiens; identical to SEQ ID NO: 35

SEQ ID NO: 8124 - DNA, 126 bp, homo sapiens; identical to SEQ ID NO: 36

SEQ ID NO: 8125 - protein, 50 aa, homo sapiens [sequence omitted]

SEQ ID NO: 8126 - DNA, 153 bp, homo sapiens; identical to SEQ ID NO: 38

SEQ ID NO: 8127 - protein, 13 aa, homo sapiens
MGAGAGRIVAGRD

SEQ ID NO: 8128 - DNA, 42 bp, homo sapiens; identical to SEQ ID NO: 40

SEQ ID NO: 8129 - protein, 5 aa, homo sapiens
MKEGR

SEQ ID NO: 8130 - DNA, 18 bp, homo sapiens
atgaaggagggaaggtag

SEQ ID NO: 8131 - protein, 13 aa, homo sapiens
MPLLPAAKCSLPS

SEQ ID NO: 8132 - DNA, 42 bp, homo sapiens; identical to SEQ ID NO: 8

SEQ ID NO: 8133 - protein, 15 aa, homo sapiens
MSLASNALRSFNFLQ

SEQ ID NO: 8134 - DNA, 48 bp, homo sapiens
atgtccttggccagtaatgcccttcggtctttcaactttttacagtag

SEQ ID NO: 8135 - protein, 29 aa, homo sapiens
MPFGLSTFYSRFCVRGNGMYSSTYRFLKN

SEQ ID NO: 8136 - DNA, 90 bp, homo sapiens
atgcccttcggtctttcaactttttacagtagattctgtgtcagaggtaatggtatgtattcttcaacttaccggtttttaaaaaattga

SEQ ID NO: 8137 - protein, 73 aa, homo sapiens [sequence omitted]

SEQ ID NO: 8138 - DNA, 222 bp, homo sapiens
atggctacagctgtgcagatttctgccacagccttgctgcttcaagtgcacgatcctgtgcgtggcacaagtgtaaatatgcctgttacacgcctgggttataaaatctgggaggaacaacggcgctcctttcctctctatttttctttttctgtcttaccctcctccctttctatctctaccacccctcccccaacacaaagaccctgtaattctaattag

SEQ ID NO: 8139 - protein, 12 aa, homo sapiens
MNIKLLGKNPDF

SEQ ID NO: 8140 - DNA, 39 bp, homo sapiens
atgaatataaagctattaggaaaaaatcctgacttttag

SEQ ID NO: 8141 - protein, 15 aa, homo sapiens
MLDFMWLGLLQGRRP

SEQ ID NO: 8142 - DNA, 48 bp, homo sapiens
atgttggattttatgtggctgggcttgctgcaggggagacgaccataa

SEQ ID NO: 8143 - protein, 8 aa, homo sapiens
MLPHWSRC

SEQ ID NO: 8144 - DNA, 27 bp, homo sapiens
atgctgcctcattggagccgatgctga

SEQ ID NO: 8145 - protein, 13 aa, homo sapiens
MLPQLMVHQLSLA

SEQ ID NO: 8146 - DNA, 42 bp, homo sapiens
atgctgcctcagctaatggtacaccaactttcactggcttaa

SEQ ID NO: 8147 - protein, 18 aa, homo sapiens
MFQDPFKNIILNVIFSSH

SEQ ID NO: 8148 - DNA, 57 bp, homo sapiens
atgtttcaagatccgtttaaaaacattattttaaatgttatttttagcagccattaa

SEQ ID NO: 8149 - protein, 52 aa, homo sapiens [sequence omitted]

SEQ ID NO: 8150 - DNA, 159 bp, homo sapiens
atgttatttttagcagccattaatctctacactcttaattatcttattaagctccatgccaaatccaaatctcttttcagctttcgctacttcattgtgcaaaacctagtcgcttctttaacagccatcgtcctttcactttcaaaactgttactgtga

SEQ ID NO: 8151 - protein, 17 aa, homo sapiens
MPNPNLFSAFATSLCKT

SEQ ID NO: 8152 - DNA, 54 bp, homo sapiens
atgccaaatccaaatctcttttcagctttcgctacttcattgtgcaaaacctag

SEQ ID NO: 8153 - protein, 5 aa, homo sapiens
MKEGR

SEQ ID NO: 8154 - DNA, 18 bp, homo sapiens
atgaaggagggaaggtag

SEQ ID NO: 8155 - protein, 13 aa, homo sapiens
MPLLPAAKCSLPS

SEQ ID NO: 8156 - DNA, 42 bp, homo sapiens; identical to SEQ ID NO: 8

SEQ ID NO: 8157 - protein, 15 aa, homo sapiens
MSLASNALRSFNFLQ

SEQ ID NO: 8158 - DNA, 48 bp, homo sapiens; identical to SEQ ID NO: 8134

SEQ ID NO: 8159 - protein, 29 aa, homo sapiens
MPFGLSTFYSRFCVRGNGMYSSTYRFLKN

SEQ ID NO: 8160 - DNA, 90 bp, homo sapiens; identical to SEQ ID NO: 8136

SEQ ID NO: 8161 - protein, 50 aa, homo sapiens [sequence omitted]

SEQ ID NO: 8162 - DNA, 153 bp, homo sapiens; identical to SEQ ID NO: 38

SEQ ID NO: 8163 - protein, 48 aa, homo sapiens
MESARRRWGPACGPGAAEKTPSLRRGSRGSRESAEREGGGLGPALLGP

SEQ ID NO: 8164 - DNA, 147 bp, homo sapiens
atggagagcgctcggcggcggtggggcccggcctgcgggcccggggcggcggagaagaccccttccctgcgacgcgggagccgcgggagccgtgagtctgcggaaagggagggtggggggctggggcccgcactcctgggtccctga

SEQ ID NO: 8165 - protein, 13 aa, homo sapiens
MGAGAGRIVAGRD

SEQ ID NO: 8166 - DNA, 42 bp, homo sapiens; identical to SEQ ID NO: 40

SEQ ID NO: 8167 - protein, 109 aa, homo sapiens
MGLRGFEGSRVSRASGRGPRRRGRLSGLPDRPGSAAGAGDVWRRRGPASMLPRGPGIPGPRPLLPQIWEYTTQSPTHSRIRAPSPLFSRIQESEPPVCSLRPGNPHSSP

SEQ ID NO: 8168 - DNA, 330 bp, homo sapiens
atggggctgcggggctttgaggggtcaagggtgagccgtgccagtgggagggggccgaggaggagggggaggttgtctgggctgccagacaggccagggtcagcggcgggggcaggagatgtctggaggaggagaggcccagcatccatgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaa

SEQ ID NO: 8169 - protein, 5 aa, homo sapiens
MKEGR

SEQ ID NO: 8170 - DNA, 18 bp, homo sapiens
atgaaggagggaaggtag

SEQ ID NO: 8171 - protein, 13 aa, homo sapiens
MPLLPAAKCSLPS

SEQ ID NO: 8172 - DNA, 42 bp, homo sapiens; identical to SEQ ID NO: 8

SEQ ID NO: 8173 - protein, 15 aa, homo sapiens
MSLASNALRSFNFLQ

SEQ ID NO: 8174 - DNA, 48 bp, homo sapiens; identical to SEQ ID NO: 8134

SEQ ID NO: 8175 - protein, 29 aa, homo sapiens
MPFGLSTFYSRFCVRGNGMYSSTYRFLKN

SEQ ID NO: 8176 - DNA, 90 bp, homo sapiens; identical to SEQ ID NO: 8136

SEQ ID NO: 8177 - protein, 37 aa, homo sapiens
MFTTLGIASPTLLLYCRGELQRSVGFIGALVRIFTVL

SEQ ID NO: 8178 - DNA, 114 bp, homo sapiens
atgttcactaccctgggaatcgccagcccaaccctcctcttatactgcagaggtgagttacagagatctgttggattcatcggagctcttgtaagaattttcactgtgctttag

SEQ ID NO: 8179 - protein, 45 aa, homo sapiens
MFLSYTQIRYLFHFFVDYMCSLLGSAAFWGIPNYVNSSAHVFSNY

SEQ ID NO: 8180 - DNA, 138 bp, homo sapiens
atgttcttgtcatacacacaaataaggtatttgttccatttctttgtggattacatgtgtagccttttggggagtgcagccttttggggaataccaaattatgtcaatagttctgcgcatgtatttagcaattattaa

SEQ ID NO: 8181 - protein, 19 aa, homo sapiens
MSIVLRMYLAIIKCLMPST

SEQ ID NO: 8182 - DNA, 60 bp, homo sapiens
atgtcaatagttctgcgcatgtatttagcaattattaagtgtctcatgccaagcacttaa

SEQ ID NO: 8183 - protein, 10 aa, homo sapiens
MVGVQTTERV

SEQ ID NO: 8184 - DNA, 33 bp, homo sapiens
atggttggtgtacagacgacagagagggtgtag

SEQ ID NO: 8185 - protein, 54 aa, homo sapiens; identical to SEQ ID NO: 3817

SEQ ID NO: 8186 - DNA, 165 bp, homo sapiens; identical to SEQ ID NO: 3818

SEQ ID NO: 8187 - protein, 69 aa, homo sapiens; identical to SEQ ID NO: 3819

SEQ ID NO: 8188 - DNA, 210 bp, homo sapiens; identical to SEQ ID NO: 3820

SEQ ID NO: 8189 - protein, 21 aa, homo sapiens
MSSVSFERYASLAKPHLDLDL

SEQ ID NO: 8190 - DNA, 66 bp, homo sapiens; identical to SEQ ID NO: 3822

SEQ ID NO: 8191 - protein, 106 aa, homo sapiens; identical to SEQ ID NO: 3823

SEQ ID NO: 8192 - DNA, 321 bp, homo sapiens; identical to SEQ ID NO: 3824

SEQ ID NO: 8193 - protein, 70 aa, homo sapiens [sequence omitted]

SEQ ID NO: 8194 - DNA, 213 bp, homo sapiens; identical to SEQ ID NO: 3828

SEQ ID NO: 8195 - protein, 80 aa, homo sapiens [sequence omitted]

SEQ ID NO: 8196 - DNA, 243 bp, homo sapiens; identical to SEQ ID NO: 3830

SEQ ID NO: 8197 - protein, 31 aa, homo sapiens; identical to SEQ ID NO: 3831

SEQ ID NO: 8198 - DNA, 96 bp, homo sapiens; identical to SEQ ID NO: 3832

SEQ ID NO: 8199 - protein, 16 aa, homo sapiens
MHFKGWERAKPLDSFS

SEQ ID NO: 8200 - DNA, 51 bp, homo sapiens
atgcattttaaaggttgggaaagagctaagccattggattccttttcttga

SEQ ID NO: 8201 - protein, 73 aa, homo sapiens [sequence omitted]

SEQ ID NO: 8202 - DNA, 222 bp, homo sapiens; identical to SEQ ID NO: 8138

SEQ ID NO: 8203 - protein, 12 aa, homo sapiens
MNIKLLGKNPDF

SEQ ID NO: 8204 - DNA, 39 bp, homo sapiens; identical to SEQ ID NO: 8140

SEQ ID NO: 8205 - protein, 15 aa, homo sapiens
MLDFMWLGLLQGRRP

SEQ ID NO: 8206 - DNA, 48 bp, homo sapiens; identical to SEQ ID NO: 8142

SEQ ID NO: 8207 - protein, 8 aa, homo sapiens
MLPHWSRC

SEQ ID NO: 8208 - DNA, 27 bp, homo sapiens
atgctgcctcattggagccgatgctga

SEQ ID NO: 8209 - protein, 67 aa, homo sapiens
MGISAVLRGPRWGVSGNAGSPGRLARPPEGSGAEGRGVCVNVAHSLFPRPRPRPGCWRGSLAVRRRL

SEQ ID NO: 8210 - DNA, 204 bp, homo sapiens
atgggcatttccgcggttttgcgcggccctcgctggggtgtcagtggcaacgcggggagccccgggcgcctggctcggcccccggaggggagcggcgcggaggggcggggtgtgtgtgtaaatgttgcgcactcgcttttcccccgcccccgcccgcgtccagggtgctggcgtgggtcccttgccgtccggcggcgactgtaa

SEQ ID NO: 8211 - protein, 28 aa, homo sapiens
MLRTRFSPAPARVQGAGVGPLPSGGDCK

SEQ ID NO: 8212 - DNA, 87 bp, homo sapiens
atgttgcgcactcgcttttcccccgcccccgcccgcgtccagggtgctggcgtgggtcccttgccgtccggcggcgactgtaaatag

SEQ ID NO: 8213 - protein, 4 aa, homo sapiens
MLFT

SEQ ID NO: 8214 - DNA, 15 bp, homo sapiens
atgttgtttacatga

SEQ ID NO: 8215 - protein, 8 aa, homo sapiens
MKDPAGGV

SEQ ID NO: 8216 - DNA, 27 bp, homo sapiens
atgaaggatccggcgggaggagtctaa

SEQ ID NO: 8217 - protein, 27 aa, homo sapiens
MKIKDAKKPCKTGAGARQVGRAPLGPV

SEQ ID NO: 8218 - DNA, 84 bp, homo sapiens
atgaagatcaaagatgccaagaaaccctgtaagacgggggctggggcccgccaggttgggagggcacccttgggccccgtctga

SEQ ID NO: 8219 - protein, 51 aa, homo sapiens
MPRNPVRRGLGPARLGGHPWAPSESPLAGRSASKPVAPRRRFVRYGGGGTI

SEQ ID NO: 8220 - DNA, 156 bp, homo sapiens
atgccaagaaaccctgtaagacgggggctggggcccgccaggttgggagggcacccttgggccccgtctgaaagccccttggctgggcggtcggcttccaagcccgtcgctcctcgccggcgcttcgtccggtatgggggcggagggaccatttga

SEQ ID NO: 8221 - protein, 24 aa, homo sapiens
MGAEGPFEPRVRGFRPPHPPIHAW

SEQ ID NO: 8222 - DNA, 75 bp, homo sapiens
atgggggcggagggaccatttgagccacgagttcgaggcttccgtcctccccatccccctattcatgcatggtga

SEQ ID NO: 8223 - protein, 43 aa, homo sapiens
MHGECLPPPSLSSHFLFEIWEVPEGISDSDFCQTRLVSSPSSP

SEQ ID NO: 8224 - DNA, 132 bp, homo sapiens
atgcatggtgaatgcctgccgccccctagcctttcctcccactttctcttcgagatctgggaggtgccagagggaatttctgattctgatttttgtcaaaccagactagtctcctctcccagctccccctga

SEQ ID NO: 8225 - protein, 39 aa, homo sapiens
MVEREGSGFILHPFPPSLPPACLPGLSSSDPACSLVSDL

SEQ ID NO: 8226 - DNA, 120 bp, homo sapiens
atggtggaaagggaggggtccggcttcattttgcaccccttccctccttccttgccccccgcttgccttccagggctttcctcctccgacccagcgtgctcactggtctctgatttgtaa

SEQ ID NO: 8227 - protein, 26 aa, homo sapiens
MLNSILIVRLKLRHHFILQSAVGLWP

SEQ ID NO: 8228 - DNA, 81 bp, homo sapiens; identical to SEQ ID NO: 96

SEQ ID NO: 8229 - protein, 32 aa, homo sapiens
MRGESKIIAPYLPHICACIRWLLPLTIPAKKP

SEQ ID NO: 8230 - DNA, 99 bp, homo sapiens
atgagaggagaaagcaagataattgcaccgtatcttccgcacatttgcgcgtgtattcggtggctgctaccgttaacgatacctgccaagaaaccctga

SEQ ID NO: 8231 - protein, 4 aa, homo sapiens
MCRE

SEQ ID NO: 8232 - DNA, 15 bp, homo sapiens
atgtgcagagagtaa

SEQ ID NO: 8233 - protein, 17 aa, homo sapiens
MANGWTGSRPGRRNPEL

SEQ ID NO: 8234 - DNA, 54 bp, homo sapiens; identical to SEQ ID NO: 3920

SEQ ID NO: 8235 - protein, 51 aa, homo sapiens
MAGLAPALGGGIPSCEAAGIRAHVLLCLLRAEAMAGAGVGCGGGVRWRRSR

SEQ ID NO: 8236 - DNA, 156 bp, homo sapiens
atggctggactggctcccgccctgggcggaggaatcccgagctgtgaagcggctggaatccgggcccatgtgcttctttgtttactaagagcggaagcgatggcgggagcgggggtggggtgcggtggcggggtgcggtggcggaggtcccggtga

SEQ ID NO: 8237 - protein, 6 aa, homo sapiens
MCFFVY

SEQ ID NO: 8238 - DNA, 21 bp, homo sapiens
atgtgcttctttgtttactaa

SEQ ID NO: 8239 - protein, 21 aa, homo sapiens
MLDGPVHCHGLFILRWLETDL

SEQ ID NO: 8240 - DNA, 66 bp, homo sapiens
atgttggatggccctgtgcactgccacgggctctttattcttcgctggttagaaacagacttgtga

SEQ ID NO: 8241 - protein, 33 aa, homo sapiens; identical to SEQ ID NO: 2553

SEQ ID NO: 8242 - DNA, 102 bp, homo sapiens; identical to SEQ ID NO: 2554

SEQ ID NO: 8243 - protein, 36 aa, homo sapiens; identical to SEQ ID NO: 2555

SEQ ID NO: 8244 - DNA, 111 bp, homo sapiens; identical to SEQ ID NO: 2556

SEQ ID NO: 8245 - protein, 33 aa, homo sapiens; identical to SEQ ID NO: 2557

SEQ ID NO: 8246 - DNA, 102 bp, homo sapiens; identical to SEQ ID NO: 2558

SEQ ID NO: 8247 - protein, 84 aa, homo sapiens; identical to SEQ ID NO: 2559

SEQ ID NO: 8248 - DNA, 255 bp, homo sapiens; identical to SEQ ID NO: 2560

SEQ ID NO: 8249 - protein, 40 aa, homo sapiens; identical to SEQ ID NO: 3939

SEQ ID NO: 8250 - DNA, 123 bp, homo sapiens; identical to SEQ ID NO: 3940

SEQ ID NO: 8251 - protein, 8 aa, homo sapiens
MESPSILP

SEQ ID NO: 8252 - DNA, 27 bp, homo sapiens
atggagagcccctcaatcctaccctag

SEQ ID NO: 8253 - protein, 9 aa, homo sapiens
MCLVFESRL

SEQ ID NO: 8254 - DNA, 30 bp, homo sapiens; identical to SEQ ID NO: 3944

SEQ ID NO: 8255 - protein, 5 aa, homo sapiens
MLVNF

SEQ ID NO: 8256 - DNA, 18 bp, homo sapiens
atgctggttaatttctag

SEQ ID NO: 8257 - protein, 50 aa, homo sapiens [sequence omitted]

SEQ ID NO: 8258 - DNA, 153 bp, homo sapiens; identical to SEQ ID NO: 38

SEQ ID NO: 8259 - protein, 48 aa, homo sapiens; identical to SEQ ID NO: 8163

SEQ ID NO: 8260 - DNA, 147 bp, homo sapiens; identical to SEQ ID NO: 8164

SEQ ID NO: 8261 - protein, 13 aa, homo sapiens
MGAGAGRIVAGRD

SEQ ID NO: 8262 - DNA, 42 bp, homo sapiens; identical to SEQ ID NO: 40

SEQ ID NO: 8263 - protein, 109 aa, homo sapiens; identical to SEQ ID NO: 8167

SEQ ID NO: 8264 - DNA, 330 bp, homo sapiens; identical to SEQ ID NO: 8168

SEQ ID NO: 8265 - protein, 81 aa, homo sapiens [sequence omitted]

SEQ ID NO: 8266 - DNA, 246 bp, homo sapiens; identical to SEQ ID NO: 4046

SEQ ID NO: 8267 - protein, 4 aa, homo sapiens
MGVV

SEQ ID NO: 8268 - DNA, 15 bp, homo sapiens
atgggggtggtataa

SEQ ID NO: 8269 - protein, 30 aa, homo sapiens
MLWSKIVKPYSVLGKSMDLDLRAVLFFRFL

SEQ ID NO: 8270 - DNA, 93 bp, homo sapiens
atgctatggtcaaaaattgtaaagccatattcagttttagggaaaagcatggacttagatctaagggctgttttattttttcgctttttgtga

SEQ ID NO: 8271 - protein, 23 aa, homo sapiens
MGNQMINRKRSYIMMHYIMEQNI

SEQ ID NO: 8272 - DNA, 72 bp, homo sapiens
atgggaaatcaaatgataaacagaaagagatcttatataatgatgcattacatcatggagcagaatatttaa

SEQ ID NO: 8273 - protein, 6 aa, homo sapiens
MPVTYS

SEQ ID NO: 8274 - DNA, 21 bp, homo sapiens
atgcctgtgacctacagctga

SEQ ID NO: 8275 - protein, 9 aa, homo sapiens
MHFDLYLSM

SEQ ID NO: 8276 - DNA, 30 bp, homo sapiens
atgcattttgacctttatctttctatgtag

SEQ ID NO: 8277 - protein, 12 aa, homo sapiens
MHQLFKVIGLRK

SEQ ID NO: 8278 - DNA, 39 bp, homo sapiens
atgcatcagttgttcaaagttatagggctcagaaagtga

SEQ ID NO: 8279 - protein, 97 aa, homo sapiens [sequence omitted]

SEQ ID NO: 8280 - DNA, 294 bp, homo sapiens
atgaaactgatccaactgcccatgaaaacaacaggggaatatcccattttccaggctgctggtacagagaccataagaaagcattccctcccatgtgatatccagctcaggggattgcctaggaaggaaaagccttggggaagggaaaggtctgcacctaggagactttcaatactctcttgctgctgccccaaaaatgcattctttcctttcttatcaattctcaagcattttctggggctaatctgctgctccaggcaggagctcctctatgaatataaaggaggaaggtaa

SEQ ID NO: 8281 - protein, 9 aa, homo sapiens
MSLFSPAPS

SEQ ID NO: 8282 - DNA, 30 bp, homo sapiens
atgagtctattttctccagccccctcgtag

SEQ ID NO: 8283 - protein, 49 aa, homo sapiens
MQLSKYTFPKAVCCKHNAILQSVGGKRGKGMDDFFFPHLGISIVDSNRF

SEQ ID NO: 8284 - DNA, 150 bp, homo sapiens
atgcagctttcaaaatatacatttccaaaggcggtgtgttgcaaacacaacgcgattttgcagagcgtgggtgggaaacgtgggaagggtatggatgattttttttttcctcatctgggaatctccatcgtggatagcaatcgcttctag

SEQ ID NO: 8285 - protein, 77 aa, homo sapiens
MIFFFLIWESPSWIAIASRALLGSSSGEGAMPPHPLLSSACRESDQWRHAALRIQPLQRLLLGETARSLQQAETDGS

SEQ ID NO: 8286 - DNA, 234 bp, homo sapiens
atgattttttttttcctcatctgggaatctccatcgtggatagcaatcgcttctagagctctcctgggaagctcctctggggaaggggctatgcccccccaccccctactttcctcagcatgtagggaatctgatcaatggagacatgcagctctaagaatacaaccactccaacgccttctgctcggggagactgcgaggagcttgcaacaggcagagacagatgggagttaa

SEQ ID NO: 8287 - protein, 46 aa, homo sapiens
METCSSKNTTTPTPSARGDCEELATGRDRWELTGGRENIRNIWVFF

SEQ ID NO: 8288 - DNA, 141 bp, homo sapiens
atggagacatgcagctctaagaatacaaccactccaacgccttctgctcggggagactgcgaggagcttgcaacaggcagagacagatgggagttaacgggagggagggagaatataagaaatatttgggtatttttctga

SEQ ID NO: 8289 - protein, 23 aa, homo sapiens
MAGILFRLTLRVLTGPWAEGMSA

SEQ ID NO: 8290 - DNA, 72 bp, homo sapiens
atggccgggatcctcttccgtctaaccctccgcgtcctgaccgggccctgggcggaagggatgtctgcgtga

SEQ ID NO: 8291 - protein, 9 aa, homo sapiens
MLEKNPECI

SEQ ID NO: 8292 - DNA, 30 bp, homo sapiens
atgttagaaaagaatccagagtgtatctag

SEQ ID NO: 8293 - protein, 40 aa, homo sapiens
MESSARRGASSRGGAALFLLEPRAESGRRVVGLYPPRSGR

SEQ ID NO: 8294 - DNA, 123 bp, homo sapiens
atggagtcgtcagctagaaggggcgcgtcgtcccggggtggggccgccctttttctcctggagccgcgggccgagtcagggcgcagggtcgtcgggctgtacccaccccgctccgggcgctag

SEQ ID NO: 8295 - protein, 14 aa, homo sapiens
MDWTGALPHPPIHG

SEQ ID NO: 8296 - DNA, 45 bp, homo sapiens
atggactggacgggggctctgccccacccacccatccatggttga

SEQ ID NO: 8297 - protein, 38 aa, homo sapiens
MPSFFTHELGGLIKEQEVPILHWGQDADPAPVLRELTV

SEQ ID NO: 8298 - DNA, 117 bp, homo sapiens
atgccttcctttttcactcacgagctgggcgggctcatcaaagagcaggaagtgcccattttacactggggccaggatgcagacccagctcctgtcctccgcgaacttacagtctaa

SEQ ID NO: 8299 - protein, 14 aa, homo sapiens
MQTQLLSSANLQSN

SEQ ID NO: 8300 - DNA, 45 bp, homo sapiens
atgcagacccagctcctgtcctccgcgaacttacagtctaattag

SEQ ID NO: 8301 - protein, 66 aa, homo sapiens
MHHLNPRTGSFKAKNYRLFRSVQHLLTKKNLRVIFLSLNFYPCLHLARTLNTKFAVICSSANAFLL

SEQ ID NO: 8302 - DNA, 201 bp, homo sapiens
atgcatcatttaaatcctagaacaggcagctttaaagcaaagaactacagacttttccgcagtgtccagcatttgctgaccaaaaaaaacctgagggtgatttttctctctttgaatttttacccttgcctgcacctagccagaacccttaatactaaatttgcagttatatgcagctctgccaacgccttcctgctttag

SEQ ID NO: 8303 - protein, 20 aa, homo sapiens
MQLCQRLPALDWISTILFLY

SEQ ID NO: 8304 - DNA, 63 bp, homo sapiens
atgcagctctgccaacgccttcctgctttagactggatctctactatcctttttctctactag

SEQ ID NO: 8305 - protein, 18 aa, homo sapiens
MGARDLQLFRRDPGPEAA

SEQ ID NO: 8306 - DNA, 57 bp, homo sapiens; identical to SEQ ID NO: 4230

SEQ ID NO: 8307 - protein, 39 aa, homo sapiens; identical to SEQ ID NO: 4231

SEQ ID NO: 8308 - DNA, 120 bp, homo sapiens; identical to SEQ ID NO: 4232

SEQ ID NO: 8309 - protein, 48 aa, homo sapiens
MGPSPSSHPVRFVTWWIQNPQSTLSLGLARPLSRDLTWPVARVPCSNW

SEQ ID NO: 8310 - DNA, 147 bp, homo sapiens
atgggccccagcccctcctcccacccagtgcgatttgtcacctggtggatccagaacccacagtcgaccttgagcttggggttggctcgccccctctcaagagacctcacctggcctgtggccagggtcccctgtagcaactggtga

SEQ ID NO: 8311 - protein, 15 aa, homo sapiens
MAPGWVLSAVTFREP

SEQ ID NO: 8312 - DNA, 48 bp, homo sapiens
atggctcccgggtgggttctctcggcagtaaccttcagggagccctga

SEQ ID NO: 8313 - protein, 21 aa, homo sapiens
MSLGNQLEAGRHQSLLLLLRD

SEQ ID NO: 8314 - DNA, 66 bp, homo sapiens
atgtccctggggaatcagctggaggcaggcaggcatcagtctcttctgcttttgcttagggactaa

SEQ ID NO: 8315 - protein, 9 aa, homo sapiens
MISLQRDRL

SEQ ID NO: 8316 - DNA, 30 bp, homo sapiens
atgatatccttgcaaagggatcgtttatag

SEQ ID NO: 8317 - protein, 15 aa, homo sapiens
MAISRFKMGHLYYCI

SEQ ID NO: 8318 - DNA, 48 bp, homo sapiens
atggcaatttccaggttcaaaatgggccacctctattattgcatttga

SEQ ID NO: 8319 - protein, 17 aa, homo sapiens
MRKLSFHYISRPQSVAW

SEQ ID NO: 8320 - DNA, 54 bp, homo sapiens
atgagaaaactgagtttccattacatctctcgcccacagtcagtggcctggtga

SEQ ID NO: 8321 - protein, 43 aa, homo sapiens; identical to SEQ ID NO: 4273

SEQ ID NO: 8322 - DNA, 132 bp, homo sapiens; identical to SEQ ID NO: 4274

SEQ ID NO: 8323 - protein, 7 aa, homo sapiens
MLFLQDA

SEQ ID NO: 8324 - DNA, 24 bp, homo sapiens
atgctctttctccaagacgcttga

SEQ ID NO: 8325 - protein, 41 aa, homo sapiens; identical to SEQ ID NO: 275

SEQ ID NO: 8326 - DNA, 126 bp, homo sapiens; identical to SEQ ID NO: 276

SEQ ID NO: 8327 - protein, 5 aa, homo sapiens
MDRRQ

SEQ ID NO: 8328 - DNA, 18 bp, homo sapiens
atggacaggagacagtag

SEQ ID NO: 8329 - protein, 4 aa, homo sapiens
MGCP

SEQ ID NO: 8330 - DNA, 15 bp, homo sapiens
atggggtgcccctga

SEQ ID NO: 8331 - protein, 50 aa, homo sapiens
MKVCFRELFLLHSTIPGTSNLYSGFWGDFWGARTPGLGSYLGDPYLGDSL

SEQ ID NO: 8332 - DNA, 153 bp, homo sapiens
atgaaagtgtgcttcagggaactctttctcctccactccactatcccaggtacttcaaatctttattcagggttttggggagatttctggggagctaggactcctgggctgggctcctatcttggggatccatatcttggggactccctttag

SEQ ID NO: 8333 - protein, 63 aa, homo sapiens
MPFSVCVFWLFPQPLTPPAPHQAPPGTHLGRKRQMDPCHGPEPPPLLTYSNSCWNLWNSCPFP

SEQ ID NO: 8334 - DNA, 192 bp, homo sapiens
atgcccttctcagtgtgcgtgttctggctctttccccagcccctcacccctccagccccacatcaggccccaccaggaacacatctgggcaggaagcgacagatggatccctgccatggccctgagccccctcccctcttaacctactccaattcctgttggaatttatggaactcctgtccatttccttag

SEQ ID NO: 8335 - protein, 8 aa, homo sapiens
MALSPLPS

SEQ ID NO: 8336 - DNA, 27 bp, homo sapiens
atggccctgagccccctcccctcttaa

SEQ ID NO: 8337 - protein, 77 aa, homo sapiens [sequence omitted]

SEQ ID NO: 8338 - DNA, 234 bp, homo sapiens; identical to SEQ ID NO: 298

SEQ ID NO: 8339 - protein, 7 aa, homo sapiens
MWGEGVC

SEQ ID NO: 8340 - DNA, 24 bp, homo sapiens
atgtggggggagggggtctgctag

SEQ ID NO: 8341 - protein, 130 aa, homo sapiens; identical to SEQ ID NO: 301

SEQ ID NO: 8342 - DNA, 393 bp, homo sapiens; identical to SEQ ID NO: 302

SEQ ID NO: 8343 - protein, 35 aa, homo sapiens; identical to SEQ ID NO: 303

SEQ ID NO: 8344 - DNA, 108 bp, homo sapiens; identical to SEQ ID NO: 304

SEQ ID NO: 8345 - protein, 8 aa, homo sapiens
MGNRRSDC

SEQ ID NO: 8346 - DNA, 27 bp, homo sapiens
atggggaacagaagaagcgattgttaa

SEQ ID NO: 8347 - protein, 27 aa, homo sapiens
MISVASPSLMLAQVTSASSQKVCTTIE

SEQ ID NO: 8348 - DNA, 84 bp, homo sapiens
atgatctctgtggctagcccttccctcatgctcgctcaggtcacttcagcatcctcacagaaagtctgcacaaccatagagtag

SEQ ID NO: 8349 - protein, 4 aa, homo sapiens
MLTT

SEQ ID NO: 8350 - DNA, 15 bp, homo sapiens
atgttaactacataa

SEQ ID NO: 8351 - protein, 13 aa, homo sapiens
MRSQFVKANLSST

SEQ ID NO: 8352 - DNA, 42 bp, homo sapiens
atgagaagtcagtttgtaaaggccaacttgagctcaacgtga

SEQ ID NO: 8353 - protein, 57 aa, homo sapiens; identical to SEQ ID NO: 4345

SEQ ID NO: 8354 - DNA, 174 bp, homo sapiens; identical to SEQ ID NO: 4346

SEQ ID NO: 8355 - protein, 45 aa, homo sapiens; identical to SEQ ID NO: 4347

SEQ ID NO: 8356 - DNA, 138 bp, homo sapiens; identical to SEQ ID NO: 4348

SEQ ID NO: 8357 - protein, 106 aa, homo sapiens; identical to SEQ ID NO: 4349

SEQ ID NO: 8358 - DNA, 321 bp, homo sapiens; identical to SEQ ID NO: 4350

SEQ ID NO: 8359 - protein, 74 aa, homo sapiens [sequence omitted]

SEQ ID NO: 8360 - DNA, 225 bp, homo sapiens; identical to SEQ ID NO: 4352

SEQ ID NO: 8361 - protein, 140 aa, homo sapiens [sequence omitted]

SEQ ID NO: 8362 - DNA, 423 bp, homo sapiens; identical to SEQ ID NO: 4386

SEQ ID NO: 8363 - protein, 55 aa, homo sapiens; identical to SEQ ID NO: 4387

SEQ ID NO: 8364 - DNA, 168 bp, homo sapiens; identical to SEQ ID NO: 4388

SEQ ID NO: 8365 - protein, 57 aa, homo sapiens; identical to SEQ ID NO: 4389

SEQ ID NO: 8366 - DNA, 174 bp, homo sapiens; identical to SEQ ID NO: 4390

SEQ ID NO: 8367 - protein, 43 aa, homo sapiens; identical to SEQ ID NO: 4391

SEQ ID NO: 8368 - DNA, 132 bp, homo sapiens; identical to SEQ ID NO: 4392

SEQ ID NO: 8369 - protein, 259 aa, homo sapiens [sequence omitted]

SEQ ID NO: 8370 - DNA, 780 bp, homo sapiens; identical to SEQ ID NO: 4394

SEQ ID NO: 8371 - protein, 58 aa, homo sapiens [sequence omitted]

SEQ ID NO: 8372 - DNA, 177 bp, homo sapiens; identical to SEQ ID NO: 4396

SEQ ID NO: 8373 - protein, 27 aa, homo sapiens
MSLGTGQRSRAGGGDMGIVSEPQDSSF

SEQ ID NO: 8374 - DNA, 84 bp, homo sapiens; identical to SEQ ID NO: 4398

SEQ ID NO: 8375 - protein, 4 aa, homo sapiens
MDLF

SEQ ID NO: 8376 - DNA, 15 bp, homo sapiens
atggatctgttttaa

SEQ ID NO: 8377 - protein, 16 aa, homo sapiens
MDSRGQRQGEGGVFET

SEQ ID NO: 8378 - DNA, 51 bp, homo sapiens; identical to SEQ ID NO: 4436

SEQ ID NO: 8379 - protein, 7 aa, homo sapiens
MVGDVPV

SEQ ID NO: 8380 - DNA, 24 bp, homo sapiens
atggttggggacgtacctgtataa

SEQ ID NO: 8381 - protein, 15 aa, homo sapiens
MALDQLPCWSGQRSV

SEQ ID NO: 8382 - DNA, 48 bp, homo sapiens; identical to SEQ ID NO: 4440

SEQ ID NO: 8383 - protein, 56 aa, homo sapiens
MSSFNRSEDGANAQSASVFIRSCCARVRFCRAVAFLYSQNPLDVCPPRFTRESRIF

SEQ ID NO: 8384 - DNA, 171 bp, homo sapiens
atgtcttcatttaacagaagtgaagatggagcaaacgctcaatcagcgtctgtatttattcgctcctgttgtgccagggtgcgtttttgccgagcggttgcctttctttactcacaaaacccccttgatgtctgtcctccacgttttacgagggagagccggatcttttga

SEQ ID NO: 8385 - protein, 10 aa, homo sapiens
MAPFPKSRCL

SEQ ID NO: 8386 - DNA, 33 bp, homo sapiens
atggctcccttcccgaagtcccgctgcctctaa

SEQ ID NO: 8387 - protein, 48 aa, homo sapiens
MPRKGTQPSTARRREEGPPPPSPDGASSDAEPEPPSGRTESPATAAGE

SEQ ID NO: 8388 - DNA, 147 bp, homo sapiens
atgccccgtaaaggcacccagccctccactgcccggcgcagagaggaagggccgccgccgccgtcccctgacggcgccagcagcgacgcggagcctgagccgccgtccggccgcacggagagcccagccaccgccgcaggtgagtga

SEQ ID NO: 8389 - protein, 9 aa, homo sapiens
MGASKRVQL

SEQ ID NO: 8390 - DNA, 30 bp, homo sapiens
atgggggcgagcaaacgggttcagttgtga

SEQ ID NO: 8391 - protein, 16 aa, homo sapiens
MVQVTNKNSISLLYSR

SEQ ID NO: 8392 - DNA, 51 bp, homo sapiens
atggtacaggtcacaaacaaaaattcaatatctttattgtattcccgctaa

SEQ ID NO: 8393 - protein, 10 aa, homo sapiens
MAPFPKSRCL

SEQ ID NO: 8394 - DNA, 33 bp, homo sapiens; identical to SEQ ID NO: 8386

SEQ ID NO: 8395 - protein, 48 aa, homo sapiens; identical to SEQ ID NO: 8387

SEQ ID NO: 8396 - DNA, 147 bp, homo sapiens; identical to SEQ ID NO: 8388

SEQ ID NO: 8397 - protein, 9 aa, homo sapiens
MGASKRVQL

SEQ ID NO: 8398 - DNA, 30 bp, homo sapiens; identical to SEQ ID NO: 8390

SEQ ID NO: 8399 - protein, 16 aa, homo sapiens
MVQVTNKNSISLLYSR

SEQ ID NO: 8400 - DNA, 51 bp, homo sapiens; identical to SEQ ID NO: 8392

SEQ ID NO: 8401 - protein, 24 aa, homo sapiens
MYLIAKDFSTLFSYVFFNCKLLGF

SEQ ID NO: 8402 - DNA, 75 bp, homo sapiens
atgtatctgatagctaaggatttttcaactttattctcttacgtatttttcaactgtaaattattgggcttttaa

SEQ ID NO: 8403 - protein, 7 aa, homo sapiens
MDGINCC

SEQ ID NO: 8404 - DNA, 24 bp, homo sapiens
atggatggaattaattgctgttag

SEQ ID NO: 8405 - protein, 19 aa, homo sapiens
MELIAVRRLENSKYRFGRW

SEQ ID NO: 8406 - DNA, 60 bp, homo sapiens
atggaattaattgctgttaggaggttggaaaatagcaaatatagatttggacggtggtag

SEQ ID NO: 8407 - protein, 18 aa, homo sapiens
MFYLFFPYFSLFQSYTWT

SEQ ID NO: 8408 - DNA, 57 bp, homo sapiens
atgttttatcttttttttccttatttttccctattccagtcatacacgtggacctaa

SEQ ID NO: 8409 - protein, 54 aa, homo sapiens
METPKITRYTQTYSTPINTQSKVMLTHTYSPHNNTATCVDTSPTRARTSRDSAH

SEQ ID NO: 8410 - DNA, 165 bp, homo sapiens
atggagacccccaaaattacacgctatacacagacatacagcaccccgattaatacgcagtcgaaagtgatgctgacacacacatacagtccccacaataacactgccacgtgtgtagacacgtcacccacaagggctcggacatccagggatagtgcccattga

SEQ ID NO: 8411 - protein, 10 aa, homo sapiens
MEPPTKAATT

SEQ ID NO: 8412 - DNA, 33 bp, homo sapiens
atggagccaccaacgaaggcagctacaacatag

SEQ ID NO: 8413 - protein, 12 aa, homo sapiens
MSLRVAMTNADP

SEQ ID NO: 8414 - DNA, 39 bp, homo sapiens
atgtcactcagggtagcaatgacaaacgcagatccctaa

SEQ ID NO: 8415 - protein, 85 aa, homo sapiens
MCPPNQVHTCTLTVTHSHPHHTHTHTHTHRRYKACRNTSDSRSHIIFFIFIYLFILRWSLSWLPRLECRGTISRIQAILLPQPPE

SEQ ID NO: 8416 - DNA, 258 bp, homo sapiens
atgtgtcctcccaaccaagttcacacctgcacactcacagtcacccacagtcacccccaccacacacacacacatacacacacacacagacggtacaaggcctgcagaaacacatctgacagcaggtcacacataatcttttttatttttatttacttatttattttgagatggagtctctcttggctgcccaggttggaatgccgtggcacgatctcccggattcaagcaattctcttgcctcagcctcctgagtag

SEQ ID NO: 8417 - protein, 54 aa, homo sapiens; identical to SEQ ID NO: 8409

SEQ ID NO: 8418 - DNA, 165 bp, homo sapiens; identical to SEQ ID NO: 8410

SEQ ID NO: 8419 - protein, 10 aa, homo sapiens
MEPPTKAATT

SEQ ID NO: 8420 - DNA, 33 bp, homo sapiens; identical to SEQ ID NO: 8412

SEQ ID NO: 8421 - protein, 12 aa, homo sapiens
MSLRVAMTNADP

SEQ ID NO: 8422 - DNA, 39 bp, homo sapiens; identical to SEQ ID NO: 8414

SEQ ID NO: 8423 - protein, 85 aa, homo sapiens; identical to SEQ ID NO: 8415

SEQ ID NO: 8424 - DNA, 258 bp, homo sapiens; identical to SEQ ID NO: 8416

SEQ ID NO: 8425 - protein, 79 aa, homo sapiens [sequence omitted]

SEQ ID NO: 8426 - DNA, 240 bp, homo sapiens; identical to SEQ ID NO: 4596

SEQ ID NO: 8427 - protein, 10 aa, homo sapiens
MRPSWGGLGS

SEQ ID NO: 8428 - DNA, 33 bp, homo sapiens; identical to SEQ ID NO: 4598

SEQ ID NO: 8429 - protein, 38 aa, homo sapiens; identical to SEQ ID NO: 4599

SEQ ID NO: 8430 - DNA, 117 bp, homo sapiens; identical to SEQ ID NO: 4600

SEQ ID NO: 8431 - protein, 32 aa, homo sapiens
MPCPGQACLHCRVALDLLTTVLLPLWAQCPLP

SEQ ID NO: 8432 - DNA, 99 bp, homo sapiens
atgccctgccctggccaggcctgtttgcactgtcgtgtggctctagacctgctgaccactgttttgctgccactctgggcacagtgccctcttccatga

SEQ ID NO: 8433 - protein, 19 aa, homo sapiens
MSTKNFRVSDGDWICPDKK

SEQ ID NO: 8434 - DNA, 60 bp, homo sapiens; identical to SEQ ID NO: 4602

SEQ ID NO: 8435 - protein, 166 aa, homo sapiens [sequence omitted]

SEQ ID NO: 8436 - DNA, 501 bp, homo sapiens; identical to SEQ ID NO: 4604

SEQ ID NO: 8437 - protein, 59 aa, homo sapiens; identical to SEQ ID NO: 4605

SEQ ID NO: 8438 - DNA, 180 bp, homo sapiens; identical to SEQ ID NO: 4606

SEQ ID NO: 8439 - protein, 9 aa, homo sapiens
MPAAEKHVC

SEQ ID NO: 8440 - DNA, 30 bp, homo sapiens; identical to SEQ ID NO: 4608

SEQ ID NO: 8441 - protein, 24 aa, homo sapiens
MYLIAKDFSTLFSYVFFNCKLLGF

SEQ ID NO: 8442 - DNA, 75 bp, homo sapiens; identical to SEQ ID NO: 8402

SEQ ID NO: 8443 - protein, 7 aa, homo sapiens
MDGINCC

SEQ ID NO: 8444 - DNA, 24 bp, homo sapiens
atggatggaattaattgctgttag

SEQ ID NO: 8445 - protein, 19 aa, homo sapiens
MELIAVRRLENSKYRFGRW

SEQ ID NO: 8446 - DNA, 60 bp, homo sapiens; identical to SEQ ID NO: 8406

SEQ ID NO: 8447 - protein, 18 aa, homo sapiens
MFYLFFPYFSLFQSYTWT

SEQ ID NO: 8448 - DNA, 57 bp, homo sapiens; identical to SEQ ID NO: 8408

SEQ ID NO: 8449 - protein, 39 aa, homo sapiens; identical to SEQ ID NO: 8225

SEQ ID NO: 8450 - DNA, 120 bp, homo sapiens; identical to SEQ ID NO: 8226

SEQ ID NO: 8451 - protein, 26 aa, homo sapiens
MLNSILIVRLKLRHHFILQSAVGLWP

SEQ ID NO: 8452 - DNA, 81 bp, homo sapiens; identical to SEQ ID NO: 96

SEQ ID NO: 8453 - protein, 32 aa, homo sapiens; identical to SEQ ID NO: 8229

SEQ ID NO: 8454 - DNA, 99 bp, homo sapiens; identical to SEQ ID NO: 8230

SEQ ID NO: 8455 - protein, 4 aa, homo sapiens
MCRE

SEQ ID NO: 8456 - DNA, 15 bp, homo sapiens
atgtgcagagagtaa

SEQ ID NO: 8457 - protein, 4 aa, homo sapiens
MGGF

SEQ ID NO: 8458 - DNA, 15 bp, homo sapiens
atgggcgggttctga

SEQ ID NO: 8459 - protein, 6 aa, homo sapiens
MWPQGE

SEQ ID NO: 8460 - DNA, 21 bp, homo sapiens
atgtggccccagggcgagtga

SEQ ID NO: 8461 - protein, 4 aa, homo sapiens
MGCP

SEQ ID NO: 8462 - DNA, 15 bp, homo sapiens
atggggtgcccctga

SEQ ID NO: 8463 - protein, 35 aa, homo sapiens [sequence omitted]

SEQ ID NO: 8464 - DNA, 108 bp, homo sapiens
atgggtgtagacgtgggagagccgaggctggtggccatctctggaaccctggggaggattggcgagggagggtggacccaggacctctgggtagggctgcaatggtag

SEQ ID NO: 8465 - protein, 72 aa, homo sapiens; identical to SEQ ID NO: 4687

SEQ ID NO: 8466 - DNA, 219 bp, homo sapiens; identical to SEQ ID NO: 4688

SEQ ID NO: 8467 - protein, 32 aa, homo sapiens; identical to SEQ ID NO: 4695

SEQ ID NO: 8468 - DNA, 99 bp, homo sapiens; identical to SEQ ID NO: 4696

SEQ ID NO: 8469 - protein, 15 aa, homo sapiens
MDLCGCVPNGRSFVP

SEQ ID NO: 8470 - DNA, 48 bp, homo sapiens
atggatctttgtggatgtgttcccaatggccggtcttttgttccctga

SEQ ID NO: 8471 - protein, 15 aa, homo sapiens
MCSQWPVFCSLTDAT

SEQ ID NO: 8472 - DNA, 48 bp, homo sapiens
atgtgttcccaatggccggtcttttgttccctgaccgatgcaacataa

SEQ ID NO: 8473 - protein, 43 aa, homo sapiens
MDVSSEDISGAFQRSAWWGLEAKRNQKRHSPHPQIKMPFSFFF

SEQ ID NO: 8474 - DNA, 132 bp, homo sapiens
atggatgtgtcctcagaggacataagcggcgcattccaacgctccgcttggtggggattggaagcaaagagaaaccagaaacgccactccccccacccccaaatcaaaatgcctttttctttttttttctaa

SEQ ID NO: 8475 - protein, 6 aa, homo sapiens
MCPQRT

SEQ ID NO: 8476 - DNA, 21 bp, homo sapiens
atgtgtcctcagaggacataa

SEQ ID NO: 8477 - protein, 56 aa, homo sapiens
MPAGLGRTWSGGRGRPAPRAALRSGSRSESVSRAGFPGWGRGRGRSTASSISKPRH

SEQ ID NO: 8478 - DNA, 171 bp, homo sapiens
atgccagcggggctcgggcgcacgtggagcggcgggcgcggccggcctgctccgcgcgcggcattgagatcggggtcacgcagcgagtcagtttcccgagcgggctttccggggtgggggcggggacgcggacgctccaccgcctcgtcaatttccaagcccaggcactag

SEQ ID NO: 8479 - protein, 118 aa, homo sapiens
MGGERRKSFSAESAQPTGLHPASTVRCRHKAAPPPPPTPQRPMAGPGRGLGRPGVGRAGEAAAAAAQAAGRLLPGQAERARAWKPSAPARVGVGVGVGVGVGAGAGVGGRLPRNARQI

SEQ ID NO: 8480 - DNA, 357 bp, homo sapiens
atgggcggggagcgtagaaaatccttttctgcagagagcgcgcagccgacggggctgcacccggcctccacggtccgctgccgccacaaagccgcgcccccgccccccccaaccccccagcgccctatggccggcccggggcgggggctgggccggcccggggttggccgcgctggggaggcggcggcggcagcggcccaggcggcggggcggctcctccccggccaggcagagagggcgagagcctggaagcctagcgcgcccgcccgggtgggggtgggggtgggggtgggggtgggggtgggggcgggggccggggtgggggggcgccttcctagaaacgctcgccaaatatag

SEQ ID NO: 8481 - protein, 17 aa, homo sapiens
MRIRLGALPLASGWSII

SEQ ID NO: 8482 - DNA, 54 bp, homo sapiens
atgagaattagactaggggctctccctttggcatcaggatggagtattatttga

SEQ ID NO: 8483 - protein, 18 aa, homo sapiens
MEYYLISCGVSVYYGVLI

SEQ ID NO: 8484 - DNA, 57 bp, homo sapiens
atggagtattatttgatcagttgtggggtgtctgtttattatggggtgttgatttga

SEQ ID NO: 8485 - protein, 54 aa, homo sapiens [sequence omitted]

SEQ ID NO: 8486 - DNA, 165 bp, homo sapiens
atggtaagtttcaggtatggggctgacttggaagttacattagttctgggggttctgacacccacaatttggagattgtgctcacctgtgtcatcttggactatcagcagaaccaaagtactcatgctgatttgggggtgcagtctattttggggtgccatctaa

SEQ ID NO: 8487 - protein, 8 aa, homo sapiens
MGLTWKLH

SEQ ID NO: 8488 - DNA, 27 bp, homo sapiens
atggggctgacttggaagttacattag

SEQ ID NO: 8489 - protein, 36 aa, homo sapiens
MGVGVWLVCVSSPHSPTHSHTAFCSPCKVKIESIRL

SEQ ID NO: 8490 - DNA, 111 bp, homo sapiens
atgggggtgggagtgtggctggtgtgtgtgtcaagccctcactcacccacgcactcacacacagcattctgttctccatgcaaagttaagatcgaatccatccgcttgtag

SEQ ID NO: 8491 - protein, 27 aa, homo sapiens
MSLPPSRSKNLLEVSYLYCFLLFSHPS

SEQ ID NO: 8492 - DNA, 84 bp, homo sapiens
atgtctttacctcccagtcgctctaagaatctgcttgaagtctcgtatttgtactgctttctgcttttctcccacccctcctag

SEQ ID NO: 8493 - protein, 17 aa, homo sapiens
MPPPPNIVLSLSGSCVI

SEQ ID NO: 8494 - DNA, 54 bp, homo sapiens
atgcccccccccccaaatattgtcctgtccctgtctgggagttgtgttatttaa

SEQ ID NO: 8495 - protein, 22 aa, homo sapiens
MLYLLHVASLMEKKKPNKFPES

SEQ ID NO: 8496 - DNA, 69 bp, homo sapiens
atgttgtatcttttgcatgtagcttccttaatggagaaaaaaaaacctaataaatttccagaatcataa

SEQ ID NO: 8497 - protein, 24 aa, homo sapiens
MYLIAKDFSTLFSYVFFNCKLLGF

SEQ ID NO: 8498 - DNA, 75 bp, homo sapiens; identical to SEQ ID NO: 8402

SEQ ID NO: 8499 - protein, 7 aa, homo sapiens
MDGINCC

SEQ ID NO: 8500 - DNA, 24 bp, homo sapiens
atggatggaattaattgctgttag

SEQ ID NO: 8501 - protein, 19 aa, homo sapiens
MELIAVRRLENSKYRFGRW

SEQ ID NO: 8502 - DNA, 60 bp, homo sapiens; identical to SEQ ID NO: 8406

SEQ ID NO: 8503 - protein, 18 aa, homo sapiens
MFYLFFPYFSLFQSYTWT

SEQ ID NO: 8504 - DNA, 57 bp, homo sapiens; identical to SEQ ID NO: 8408

SEQ ID NO: 8505 - protein, 24 aa, homo sapiens
MYLIAKDFSTLFSYVFFNCKLLGF

SEQ ID NO: 8506 - DNA, 75 bp, homo sapiens; identical to SEQ ID NO: 8402

SEQ ID NO: 8507 - protein, 7 aa, homo sapiens
MDGINCC

SEQ ID NO: 8508 - DNA, 24 bp, homo sapiens
atggatggaattaattgctgttag

SEQ ID NO: 8509 - protein, 19 aa, homo sapiens
MELIAVRRLENSKYRFGRW

SEQ ID NO: 8510 - DNA, 60 bp, homo sapiens; identical to SEQ ID NO: 8406

SEQ ID NO: 8511 - protein, 18 aa, homo sapiens
MFYLFFPYFSLFQSYTWT

SEQ ID NO: 8512 - DNA, 57 bp, homo sapiens; identical to SEQ ID NO: 8408

SEQ ID NO: 8513 - protein, 39 aa, homo sapiens; identical to SEQ ID NO: 8225

SEQ ID NO: 8514 - DNA, 120 bp, homo sapiens; identical to SEQ ID NO: 8226

SEQ ID NO: 8515 - protein, 26 aa, homo sapiens
MLNSILIVRLKLRHHFILQSAVGLWP

SEQ ID NO: 8516 - DNA, 81 bp, homo sapiens; identical to SEQ ID NO: 96

SEQ ID NO: 8517 - protein, 32 aa, homo sapiens; identical to SEQ ID NO: 8229

SEQ ID NO: 8518 - DNA, 99 bp, homo sapiens; identical to SEQ ID NO: 8230

SEQ ID NO: 8519 - protein, 4 aa, homo sapiens
MCRE

SEQ ID NO: 8520 - DNA, 15 bp, homo sapiens
atgtgcagagagtaa

SEQ ID NO: 8521 - protein, 18 aa, homo sapiens
MGARDLQLFRRDPGPEAA

SEQ ID NO: 8522 - DNA, 57 bp, homo sapiens; identical to SEQ ID NO: 4230

SEQ ID NO: 8523 - protein, 39 aa, homo sapiens; identical to SEQ ID NO: 4231

SEQ ID NO: 8524 - DNA, 120 bp, homo sapiens; identical to SEQ ID NO: 4232

SEQ ID NO: 8525 - protein, 48 aa, homo sapiens; identical to SEQ ID NO: 8309

SEQ ID NO: 8526 - DNA, 147 bp, homo sapiens; identical to SEQ ID NO: 8310

SEQ ID NO: 8527 - protein, 15 aa, homo sapiens
MAPGWVLSAVTFREP

SEQ ID NO: 8528 - DNA, 48 bp, homo sapiens; identical to SEQ ID NO: 8312

SEQ ID NO: 8529 - protein, 24 aa, homo sapiens
MYLIAKDFSTLFSYVFFNCKLLGF

SEQ ID NO: 8530 - DNA, 75 bp, homo sapiens; identical to SEQ ID NO: 8402

SEQ ID NO: 8531 - protein, 7 aa, homo sapiens
MDGINCC

SEQ ID NO: 8532 - DNA, 24 bp, homo sapiens
atggatggaattaattgctgttag

SEQ ID NO: 8533 - protein, 19 aa, homo sapiens
MELIAVRRLENSKYRFGRW

SEQ ID NO: 8534 - DNA, 60 bp, homo sapiens; identical to SEQ ID NO: 8406

SEQ ID NO: 8535 - protein, 18 aa, homo sapiens
MFYLFFPYFSLFQSYTWT

SEQ ID NO: 8536 - DNA, 57 bp, homo sapiens; identical to SEQ ID NO: 8408

SEQ ID NO: 8537 - protein, 39 aa, homo sapiens; identical to SEQ ID NO: 8225

SEQ ID NO: 8538 - DNA, 120 bp, homo sapiens; identical to SEQ ID NO: 8226

SEQ ID NO: 8539 - protein, 26 aa, homo sapiens
MLNSILIVRLKLRHHFILQSAVGLWP

SEQ ID NO: 8540 - DNA, 81 bp, homo sapiens; identical to SEQ ID NO: 96

SEQ ID NO: 8541 - protein, 32 aa, homo sapiens; identical to SEQ ID NO: 8229

SEQ ID NO: 8542 - DNA, 99 bp, homo sapiens; identical to SEQ ID NO: 8230

SEQ ID NO: 8543 - protein, 4 aa, homo sapiens
MCRE

SEQ ID NO: 8544 - DNA, 15 bp, homo sapiens
atgtgcagagagtaa

SEQ ID NO: 8545 - protein, 89 aa, homo sapiens; identical to SEQ ID NO: 499

SEQ ID NO: 8546 - DNA, 270 bp, homo sapiens; identical to SEQ ID NO: 500

SEQ ID NO: 8547 - protein, 8 aa, homo sapiens
MGTPQVRL

SEQ ID NO: 8548 - DNA, 27 bp, homo sapiens
atgggcacaccacaggtaagactttaa

SEQ ID NO: 8549 - protein, 36 aa, homo sapiens; identical to SEQ ID NO: 503

SEQ ID NO: 8550 - DNA, 111 bp, homo sapiens; identical to SEQ ID NO: 504

SEQ ID NO: 8551 - protein, 14 aa, homo sapiens
MVLLHRMSCCLDLK

SEQ ID NO: 8552 - DNA, 45 bp, homo sapiens
atggttctgttacatagaatgagttgttgccttgatcttaaatga

SEQ ID NO: 8553 - protein, 10 aa, homo sapiens
MGGIRGGGQD

SEQ ID NO: 8554 - DNA, 33 bp, homo sapiens
atgggggggattaggggagggggccaggattag

SEQ ID NO: 8555 - protein, 127 aa, homo sapiens; identical to SEQ ID NO: 5033

SEQ ID NO: 8556 - DNA, 384 bp, homo sapiens; identical to SEQ ID NO: 5034

SEQ ID NO: 8557 - protein, 105 aa, homo sapiens; identical to SEQ ID NO: 5035

SEQ ID NO: 8558 - DNA, 318 bp, homo sapiens; identical to SEQ ID NO: 5036

SEQ ID NO: 8559 - protein, 94 aa, homo sapiens; identical to SEQ ID NO: 5037

SEQ ID NO: 8560 - DNA, 285 bp, homo sapiens; identical to SEQ ID NO: 5038

SEQ ID NO: 8561 - protein, 139 aa, homo sapiens; identical to SEQ ID NO: 5049

SEQ ID NO: 8562 - DNA, 420 bp, homo sapiens; identical to SEQ ID NO: 5050

SEQ ID NO: 8563 - protein, 23 aa, homo sapiens
MLCKGGGERSRGRRCRGLMQPKG

SEQ ID NO: 8564 - DNA, 72 bp, homo sapiens; identical to SEQ ID NO: 5052

SEQ ID NO: 8565 - protein, 40 aa, homo sapiens; identical to SEQ ID NO: 5053

SEQ ID NO: 8566 - DNA, 123 bp, homo sapiens; identical to SEQ ID NO: 5054

SEQ ID NO: 8567 - protein, 82 aa, homo sapiens [sequence omitted]

SEQ ID NO: 8568 - DNA, 249 bp, homo sapiens; identical to SEQ ID NO: 5056

SEQ ID NO: 8569 - protein, 5 aa, homo sapiens
MWKIS

SEQ ID NO: 8570 - DNA, 18 bp, homo sapiens
atgtggaaaatttcatga

SEQ ID NO: 8571 - protein, 9 aa, homo sapiens
MSLDICKHL

SEQ ID NO: 8572 - DNA, 30 bp, homo sapiens
atgagtttggatatatgcaaacacctgtga

SEQ ID NO: 8573 - protein, 9 aa, homo sapiens
MQTPVIPSP

SEQ ID NO: 8574 - DNA, 30 bp, homo sapiens
atgcaaacacctgtgataccatcaccataa

SEQ ID NO: 8575 - protein, 29 aa, homo sapiens
MDVFNISQSFIVSLWFCVCVCVYVKNHLT

SEQ ID NO: 8576 - DNA, 90 bp, homo sapiens
atggatgtattcaacatctctcaaagtttcattgtatccctttggttttgtgtctgtgtttgtgtatatgttaagaatcacttaacatga

SEQ ID NO: 8577 - protein, 5 aa, homo sapiens
MWKIS

SEQ ID NO: 8578 - DNA, 18 bp, homo sapiens
atgtggaaaatttcatga

SEQ ID NO: 8579 - protein, 9 aa, homo sapiens
MSLDICKHL

SEQ ID NO: 8580 - DNA, 30 bp, homo sapiens; identical to SEQ ID NO: 8572

SEQ ID NO: 8581 - protein, 9 aa, homo sapiens
MQTPVIPSP

SEQ ID NO: 8582 - DNA, 30 bp, homo sapiens; identical to SEQ ID NO: 8574

SEQ ID NO: 8583 - protein, 29 aa, homo sapiens
MDVFNISQSFIVSLWFCVCVCVYVKNHLT

SEQ ID NO: 8584 - DNA, 90 bp, homo sapiens; identical to SEQ ID NO: 8576

SEQ ID NO: 8585 - protein, 17 aa, homo sapiens
MANGWTGSRPGRRNPEL

SEQ ID NO: 8586 - DNA, 54 bp, homo sapiens; identical to SEQ ID NO: 3920

SEQ ID NO: 8587 - protein, 51 aa, homo sapiens; identical to SEQ ID NO: 8235

SEQ ID NO: 8588 - DNA, 156 bp, homo sapiens; identical to SEQ ID NO: 8236

SEQ ID NO: 8589 - protein, 6 aa, homo sapiens
MCFFVY

SEQ ID NO: 8590 - DNA, 21 bp, homo sapiens
atgtgcttctttgtttactaa

SEQ ID NO: 8591 - protein, 21 aa, homo sapiens
MLDGPVHCHGLFILRWLETDL

SEQ ID NO: 8592 - DNA, 66 bp, homo sapiens; identical to SEQ ID NO: 8240

SEQ ID NO: 8593 - protein, 161 aa, homo sapiens; identical to SEQ ID NO: 5211

SEQ ID NO: 8594 - DNA, 486 bp, homo sapiens; identical to SEQ ID NO: 5212

SEQ ID NO: 8595 - protein, 156 aa, homo sapiens; identical to SEQ ID NO: 5213

SEQ ID NO: 8596 - DNA, 471 bp, homo sapiens; identical to SEQ ID NO: 5214

SEQ ID NO: 8597 - protein, 21 aa, homo sapiens
MATGHWPQAAGLHPCLWAQPQ

SEQ ID NO: 8598 - DNA, 66 bp, homo sapiens; identical to SEQ ID NO: 5216

SEQ ID NO: 8599 - protein, 17 aa, homo sapiens
MEGGQGWTALGPRPWLS

SEQ ID NO: 8600 - DNA, 54 bp, homo sapiens
atggagggagggcaggggtggactgccctgggtcccaggccctggctgtcctga

SEQ ID NO: 8601 - protein, 15 aa, homo sapiens
MEAEVDKLELMVSAK

SEQ ID NO: 8602 - DNA, 48 bp, homo sapiens; identical to SEQ ID NO: 5326

SEQ ID NO: 8603 - protein, 43 aa, homo sapiens; identical to SEQ ID NO: 5327

SEQ ID NO: 8604 - DNA, 132 bp, homo sapiens; identical to SEQ ID NO: 5328

SEQ ID NO: 8605 - protein, 46 aa, homo sapiens
MAGDAEGAGPLEFLVPCPHLYTPYETAPGADRILCLYQKRCEWNGP

SEQ ID NO: 8606 - DNA, 141 bp, homo sapiens
atggcgggagatgctgagggtgcggggcctttggaattccttgttccttgccctcacctttacaccccttacgaaactgcgccgggtgcagaccgcattctgtgtttgtaccaaaaaagatgtgaatggaacggtccctaa

SEQ ID NO: 8607 - protein, 65 aa, homo sapiens
MLRVRGLWNSLFLALTFTPLTKLRRVQTAFCVCTKKDVNGTVPKRPKKGEVVHTPRKGNGGWGGE

SEQ ID NO: 8608 - DNA, 198 bp, homo sapiens
atgctgagggtgcggggcctttggaattccttgttccttgccctcacctttacaccccttacgaaactgcgccgggtgcagaccgcattctgtgtttgtaccaaaaaagatgtgaatggaacggtccctaagcgtcccaagaagggagaggtggttcacactccaagaaaggggaacggagggtggggtggggaataa

SEQ ID NO: 8609 - protein, 27 aa, homo sapiens
MGFQSDVCSCLLPRTSRGYFRSNYLVY

SEQ ID NO: 8610 - DNA, 84 bp, homo sapiens
atgggctttcagtcggatgtttgcagctgcctactgcctcggacttcaaggggctactttaggagcaattatcttgtttactaa

SEQ ID NO: 8611 - protein, 54 aa, homo sapiens [sequence omitted]

SEQ ID NO: 8612 - DNA, 165 bp, homo sapiens
atgtttgcagctgcctactgcctcggacttcaaggggctactttaggagcaattatcttgtttactaaaactgaataccttgctatctctttgatacatttttacaaagctgaattaaaatggtataaattaaatcactttaaaaccatgtctgtacatttttag

SEQ ID NO: 8613 - protein, 29 aa, homo sapiens
MHRICNIKKKVFVREMRKCVTVFLFFLKA

SEQ ID NO: 8614 - DNA, 90 bp, homo sapiens
atgcatagaatttgcaatatcaaaaagaaagtattcgtaagagaaatgaggaaatgtgttacagtatttttattttttttaaaagcgtag

SEQ ID NO: 8615 - protein, 23 aa, homo sapiens
MCYSIFIFFKSVVGQYFPEKSMK

SEQ ID NO: 8616 - DNA, 72 bp, homo sapiens
atgtgttacagtatttttattttttttaaaagcgtagtagggcaatatttcccagaaaaatctatgaagtga

SEQ ID NO: 8617 - protein, 10 aa, homo sapiens
MCVQHFSPSS

SEQ ID NO: 8618 - DNA, 33 bp, homo sapiens
atgtgtgtgcaacatttttctccgtcctcttag

SEQ ID NO: 8619 - protein, 8 aa, homo sapiens
MGMHVFLY

SEQ ID NO: 8620 - DNA, 27 bp, homo sapiens
atgggtatgcatgtctttttatattaa

SEQ ID NO: 8621 - protein, 44 aa, homo sapiens
MSFYINIFPKYFQIVAFRFIASSLKYSCPESSCIVSIFCVSPQI

SEQ ID NO: 8622 - DNA, 135 bp, homo sapiens
atgtctttttatattaatatttttcctaagtattttcagattgttgctttcagatttattgcttcctccttaaaatatagctgccctgaaagcagctgtattgtatctattttttgtgtttccccacagatctga

SEQ ID NO: 8623 - protein, 6 aa, homo sapiens
MTLSVD

SEQ ID NO: 8624 - DNA, 21 bp, homo sapiens
atgacactcagtgtggactaa

SEQ ID NO: 8625 - protein, 10 aa, homo sapiens
MCVQHFSPSS

SEQ ID NO: 8626 - DNA, 33 bp, homo sapiens; identical to SEQ ID NO: 8618

SEQ ID NO: 8627 - protein, 8 aa, homo sapiens
MGMHVFLY

SEQ ID NO: 8628 - DNA, 27 bp, homo sapiens
atgggtatgcatgtctttttatattaa

SEQ ID NO: 8629 - protein, 44 aa, homo sapiens; identical to SEQ ID NO: 8621

SEQ ID NO: 8630 - DNA, 135 bp, homo sapiens; identical to SEQ ID NO: 8622

SEQ ID NO: 8631 - protein, 6 aa, homo sapiens
MTLSVD

SEQ ID NO: 8632 - DNA, 21 bp, homo sapiens
atgacactcagtgtggactaa

SEQ ID NO: 8633 - protein, 31 aa, homo sapiens; identical to SEQ ID NO: 699

SEQ ID NO: 8634 - DNA, 96 bp, homo sapiens; identical to SEQ ID NO: 700

SEQ ID NO: 8635 - protein, 15 aa, homo sapiens
MGRGARRGAESETWT

SEQ ID NO: 8636 - DNA, 48 bp, homo sapiens; identical to SEQ ID NO: 702

SEQ ID NO: 8637 - protein, 30 aa, homo sapiens; identical to SEQ ID NO: 703

SEQ ID NO: 8638 - DNA, 93 bp, homo sapiens; identical to SEQ ID NO: 704

SEQ ID NO: 8639 - protein, 9 aa, homo sapiens
MLSPIPQTV

SEQ ID NO: 8640 - DNA, 30 bp, homo sapiens
atgttatcccccatcccccagaccgtataa

SEQ ID NO: 8641 - protein, 7 aa, homo sapiens
MGDKGTR

SEQ ID NO: 8642 - DNA, 24 bp, homo sapiens
atgggcgacaaagggacccggtga

SEQ ID NO: 8643 - protein, 89 aa, homo sapiens [sequence omitted]

SEQ ID NO: 8644 - DNA, 270 bp, homo sapiens; identical to SEQ ID NO: 5484

SEQ ID NO: 8645 - protein, 35 aa, homo sapiens; identical to SEQ ID NO: 5485

SEQ ID NO: 8646 - DNA, 108 bp, homo sapiens; identical to SEQ ID NO: 5486

SEQ ID NO: 8647 - protein, 70 aa, homo sapiens; identical to SEQ ID NO: 5487

SEQ ID NO: 8648 - DNA, 213 bp, homo sapiens; identical to SEQ ID NO: 5488

SEQ ID NO: 8649 - protein, 7 aa, homo sapiens
MSSFGAG

SEQ ID NO: 8650 - DNA, 24 bp, homo sapiens
atgagtagctttggagctgggtga

SEQ ID NO: 8651 - protein, 6 aa, homo sapiens
MVSPLF

SEQ ID NO: 8652 - DNA, 21 bp, homo sapiens
atggtttctccccttttctga

SEQ ID NO: 8653 - protein, 12 aa, homo sapiens
MGKGSVEACLLG

SEQ ID NO: 8654 - DNA, 39 bp, homo sapiens; identical to SEQ ID NO: 5518

SEQ ID NO: 8655 - protein, 124 aa, homo sapiens [sequence omitted]

SEQ ID NO: 8656 - DNA, 375 bp, homo sapiens; identical to SEQ ID NO: 5520

SEQ ID NO: 8657 - protein, 25 aa, homo sapiens
MPGWILQLRGFSGKQRPLLSRDPGS

SEQ ID NO: 8658 - DNA, 78 bp, homo sapiens
atgcccggatggatcctgcagctccgtggcttttctgggaagcagcggcccctgctctcaagagaccctggctcctga

SEQ ID NO: 8659 - protein, 65 aa, homo sapiens
MDPAAPWLFWEAAAPALKRPWLLMVAPRLPAGARDSGQFPRKGQAGSPSRGRVRKLGGAEATLGP

SEQ ID NO: 8660 - DNA, 198 bp, homo sapiens
atggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctga

SEQ ID NO: 8661 - protein, 4 aa, homo sapiens
MAFP

SEQ ID NO: 8662 - DNA, 15 bp, homo sapiens
atggccttcccctga

SEQ ID NO: 8663 - protein, 38 aa, homo sapiens
MSGRGTGGEVSCPGGRRGAGGRRVRPGSRGRWRRSSRG

SEQ ID NO: 8664 - DNA, 117 bp, homo sapiens
atgagtggacggggcacaggaggagaagtgtcctgtcctgggggccggcgtggggcgggtgggagaagagtaaggcctggaagccggggccggtggaggcggagcagccgtgggtga

SEQ ID NO: 8665 - protein, 134 aa, homo sapiens; identical to SEQ ID NO: 5579

SEQ ID NO: 8666 - DNA, 405 bp, homo sapiens; identical to SEQ ID NO: 5580

SEQ ID NO: 8667 - protein, 123 aa, homo sapiens [sequence omitted]

SEQ ID NO: 8668 - DNA, 372 bp, homo sapiens; identical to SEQ ID NO: 5582

SEQ ID NO: 8669 - protein, 6 aa, homo sapiens
MSNSPN

SEQ ID NO: 8670 - DNA, 21 bp, homo sapiens
atgagtaactcaccgaattga

SEQ ID NO: 8671 - protein, 45 aa, homo sapiens
MNSLCSLRSCGKVRKPNPYLVPRCECFKLCVTTNKIDMMIHFTDI

SEQ ID NO: 8672 - DNA, 138 bp, homo sapiens
atgaattcgttgtgttcactgaggagttgtggcaaagtgagaaaacctaacccgtacttagttcccagatgtgagtgttttaaactatgtgtaacaactaacaaaattgacatgatgatacacttcacggacatttaa

SEQ ID NO: 8673 - protein, 19 aa, homo sapiens
MPPSPAGSPGVGGHAGYAT

SEQ ID NO: 8674 - DNA, 60 bp, homo sapiens; identical to SEQ ID NO: 5612

SEQ ID NO: 8675 - protein, 34 aa, homo sapiens; identical to SEQ ID NO: 5613

SEQ ID NO: 8676 - DNA, 105 bp, homo sapiens; identical to SEQ ID NO: 5614

SEQ ID NO: 8677 - protein, 10 aa, homo sapiens
MGNPAVESPL

SEQ ID NO: 8678 - DNA, 33 bp, homo sapiens; identical to SEQ ID NO: 5616

SEQ ID NO: 8679 - protein, 15 aa, homo sapiens
MTCDLGGPQTRRVST

SEQ ID NO: 8680 - DNA, 48 bp, homo sapiens
atgacttgtgacctggggggtccacaaaccaggagagtttctacttga

SEQ ID NO: 8681 - protein, 6 aa, homo sapiens
MGCGDE

SEQ ID NO: 8682 - DNA, 21 bp, homo sapiens
atgggctgcggggatgaatga

SEQ ID NO: 8683 - protein, 6 aa, homo sapiens
MNESRV

SEQ ID NO: 8684 - DNA, 21 bp, homo sapiens
atgaatgagagccgagtctga

SEQ ID NO: 8685 - protein, 121 aa, homo sapiens
MRAESDSAPQESLTFAVARDCPGPCGASHSVTSHQPFPSASGGPDCQVGAWEQGRARRFLFAVGVRSALGRAQLPSLGPAGRQGHTVCHVSRFRVTWFFYPNSSGYLPPGGAGRKVLCIWY

SEQ ID NO: 8686 - DNA, 366 bp, homo sapiens
atgagagccgagtctgactcggccccccaggagtccctgacattcgcagtggcaagggactgccctggtccctgtggagcgtcccattcggtgacttcccaccagcccttccccagcgcctctggaggtccagactgtcaggttggagcctgggagcagggacgggccaggcgctttctcttcgctgtaggagtcagatcagccttaggccgggcccagcttccttctttagggcctgcaggcaggcaaggccacaccgtgtgccacgtttccaggtttagggtcacatggttcttttatccaaattccagtgggtacctacctcctggaggtgcaggtcgaaaggttctgtgtatttggtactag

SEQ ID NO: 8687 - protein, 34 aa, homo sapiens
MVLLSKFQWVPTSWRCRSKGSVYLVLGHTGRCCQ

SEQ ID NO: 8688 - DNA, 105 bp, homo sapiens
atggttcttttatccaaattccagtgggtacctacctcctggaggtgcaggtcgaaaggttctgtgtatttggtactaggacacacaggtaggtgttgtcagtag

SEQ ID NO: 8689 - protein, 39 aa, homo sapiens; identical to SEQ ID NO: 8225

SEQ ID NO: 8690 - DNA, 120 bp, homo sapiens; identical to SEQ ID NO: 8226

SEQ ID NO: 8691 - protein, 26 aa, homo sapiens
MLNSILIVRLKLRHHFILQSAVGLWP

SEQ ID NO: 8692 - DNA, 81 bp, homo sapiens; identical to SEQ ID NO: 96

SEQ ID NO: 8693 - protein, 32 aa, homo sapiens; identical to SEQ ID NO: 8229

SEQ ID NO: 8694 - DNA, 99 bp, homo sapiens; identical to SEQ ID NO: 8230

SEQ ID NO: 8695 - protein, 4 aa, homo sapiens
MCRE

SEQ ID NO: 8696 - DNA, 15 bp, homo sapiens
atgtgcagagagtaa

SEQ ID NO: 8697 - protein, 43 aa, homo sapiens; identical to SEQ ID NO: 8473

SEQ ID NO: 8698 - DNA, 132 bp, homo sapiens; identical to SEQ ID NO: 8474

SEQ ID NO: 8699 - protein, 6 aa, homo sapiens
MCPQRT

SEQ ID NO: 8700 - DNA, 21 bp, homo sapiens
atgtgtcctcagaggacataa

SEQ ID NO: 8701 - protein, 56 aa, homo sapiens; identical to SEQ ID NO: 8477

SEQ ID NO: 8702 - DNA, 171 bp, homo sapiens; identical to SEQ ID NO: 8478

SEQ ID NO: 8703 - protein, 118 aa, homo sapiens; identical to SEQ ID NO: 8479

SEQ ID NO: 8704 - DNA, 357 bp, homo sapiens; identical to SEQ ID NO: 8480

SEQ ID NO: 8705 - protein, 72 aa, homo sapiens; identical to SEQ ID NO: 4687

SEQ ID NO: 8706 - DNA, 219 bp, homo sapiens; identical to SEQ ID NO: 4688

SEQ ID NO: 8707 - protein, 32 aa, homo sapiens; identical to SEQ ID NO: 4695

SEQ ID NO: 8708 - DNA, 99 bp, homo sapiens; identical to SEQ ID NO: 4696

SEQ ID NO: 8709 - protein, 15 aa, homo sapiens
MDLCGCVPNGRSFVP

SEQ ID NO: 8710 - DNA, 48 bp, homo sapiens; identical to SEQ ID NO: 8470

SEQ ID NO: 8711 - protein, 15 aa, homo sapiens
MCSQWPVFCSLTDAT

SEQ ID NO: 8712 - DNA, 48 bp, homo sapiens; identical to SEQ ID NO: 8472

SEQ ID NO: 8713 - protein, 21 aa, homo sapiens
MMTCALVFFTEPLFIKCSIKS

SEQ ID NO: 8714 - DNA, 66 bp, homo sapiens
atgatgacatgcgctttggtctttttcactgaacctctttttataaagtgttcaataaaaagctga

SEQ ID NO: 8715 - protein, 7 aa, homo sapiens
MRFGLFH

SEQ ID NO: 8716 - DNA, 24 bp, homo sapiens
atgcgctttggtctttttcactga

SEQ ID NO: 8717 - protein, 7 aa, homo sapiens
MYSLHLA

SEQ ID NO: 8718 - DNA, 24 bp, homo sapiens
atgtattctttgcatctggcatag

SEQ ID NO: 8719 - protein, 60 aa, homo sapiens
MQEDHLSPGVPVQPGLTGRTPSLERKKCKKAFFVYYFFETGSPSIPQTGVPWYHHSLLQP

SEQ ID NO: 8720 - DNA, 183 bp, homo sapiens
atgcaggaggatcatttgagtccaggagttccagtccagcctgggttaacaggtagaaccccttctctggaaagaaaaaaatgtaaaaaggcattctttgtgtattatttttttgaaacagggtctccctctataccccagactggagtgccttggtatcatcacagcttactacagccttga

SEQ ID NO: 8721 - protein, 21 aa, homo sapiens
MMTCALVFFTEPLFIKCSIKS

SEQ ID NO: 8722 - DNA, 66 bp, homo sapiens; identical to SEQ ID NO: 8714

SEQ ID NO: 8723 - protein, 7 aa, homo sapiens
MRFGLFH

SEQ ID NO: 8724 - DNA, 24 bp, homo sapiens
atgcgctttggtctttttcactga

SEQ ID NO: 8725 - protein, 7 aa, homo sapiens
MYSLHLA

SEQ ID NO: 8726 - DNA, 24 bp, homo sapiens
atgtattctttgcatctggcatag

SEQ ID NO: 8727 - protein, 60 aa, homo sapiens; identical to SEQ ID NO: 8719

SEQ ID NO: 8728 - DNA, 183 bp, homo sapiens; identical to SEQ ID NO: 8720

SEQ ID NO: 8729 - protein, 21 aa, homo sapiens
MMTCALVFFTEPLFIKCSIKS

SEQ ID NO: 8730 - DNA, 66 bp, homo sapiens; identical to SEQ ID NO: 8714

SEQ ID NO: 8731 - protein, 7 aa, homo sapiens
MRFGLFH

SEQ ID NO: 8732 - DNA, 24 bp, homo sapiens
atgcgctttggtctttttcactga

SEQ ID NO: 8733 - protein, 7 aa, homo sapiens
MYSLHLA

SEQ ID NO: 8734 - DNA, 24 bp, homo sapiens
atgtattctttgcatctggcatag

SEQ ID NO: 8735 - protein, 60 aa, homo sapiens; identical to SEQ ID NO: 8719

SEQ ID NO: 8736 - DNA, 183 bp, homo sapiens; identical to SEQ ID NO: 8720

SEQ ID NO: 8737 - protein, 15 aa, homo sapiens
MARGEVSCLCLAILG

SEQ ID NO: 8738 - DNA, 48 bp, homo sapiens
atggcgaggggggaggtaagctgtctttgcttggccatcttgggctag

SEQ ID NO: 8739 - protein, 13 aa, homo sapiens
MLWPDPLEINPES

SEQ ID NO: 8740 - DNA, 42 bp, homo sapiens
atgctgtggccagatccactagaaattaacccagaatcttag

SEQ ID NO: 8741 - protein, 4 aa, homo sapiens
MRRR

SEQ ID NO: 8742 - DNA, 15 bp, homo sapiens
atgaggaggcgatga

SEQ ID NO: 8743 - protein, 13 aa, homo sapiens
MMTLQKVAAAGGA

SEQ ID NO: 8744 - DNA, 42 bp, homo sapiens
atgatgactctgcaaaaggttgcggcagctggcggtgcgtag

SEQ ID NO: 8745 - protein, 15 aa, homo sapiens
MARGEVSCLCLAILG

SEQ ID NO: 8746 - DNA, 48 bp, homo sapiens; identical to SEQ ID NO: 8738

SEQ ID NO: 8747 - protein, 13 aa, homo sapiens
MLWPDPLEINPES

SEQ ID NO: 8748 - DNA, 42 bp, homo sapiens; identical to SEQ ID NO: 8740

SEQ ID NO: 8749 - protein, 4 aa, homo sapiens
MRRR

SEQ ID NO: 8750 - DNA, 15 bp, homo sapiens
atgaggaggcgatga

SEQ ID NO: 8751 - protein, 13 aa, homo sapiens
MMTLQKVAAAGGA

SEQ ID NO: 8752 - DNA, 42 bp, homo sapiens; identical to SEQ ID NO: 8744

SEQ ID NO: 8753 - protein, 60 aa, homo sapiens [sequence omitted]

SEQ ID NO: 8754 - DNA, 183 bp, homo sapiens; identical to SEQ ID NO: 5906

SEQ ID NO: 8755 - protein, 133 aa, homo sapiens; identical to SEQ ID NO: 5907

SEQ ID NO: 8756 - DNA, 402 bp, homo sapiens; identical to SEQ ID NO: 5908

SEQ ID NO: 8757 - protein, 130 aa, homo sapiens; identical to SEQ ID NO: 5909

SEQ ID NO: 8758 - DNA, 393 bp, homo sapiens; identical to SEQ ID NO: 5910

SEQ ID NO: 8759 - protein, 38 aa, homo sapiens; identical to SEQ ID NO: 5911

SEQ ID NO: 8760 - DNA, 117 bp, homo sapiens; identical to SEQ ID NO: 5912

SEQ ID NO: 8761 - protein, 7 aa, homo sapiens
MAIPGRQ

SEQ ID NO: 8762 - DNA, 24 bp, homo sapiens
atggcgattccgggcaggcagtga

SEQ ID NO: 8763 - protein, 26 aa, homo sapiens
MRNYGDCIFGRGVLNALEVKGLCRQG

SEQ ID NO: 8764 - DNA, 81 bp, homo sapiens; identical to SEQ ID NO: 6004

SEQ ID NO: 8765 - protein, 4 aa, homo sapiens
MRWK

SEQ ID NO: 8766 - DNA, 15 bp, homo sapiens
atgcgctggaagtga

SEQ ID NO: 8767 - protein, 13 aa, homo sapiens
MEARSLREKLVRK

SEQ ID NO: 8768 - DNA, 42 bp, homo sapiens; identical to SEQ ID NO: 6008

SEQ ID NO: 8769 - protein, 12 aa, homo sapiens
MGANLTFKVFNK

SEQ ID NO: 8770 - DNA, 39 bp, homo sapiens
atgggggcaaatctgacatttaaagtgtttaacaaatga

SEQ ID NO: 8771 - protein, 32 aa, homo sapiens
MSAAGKFSGNGLGKKKQQLTWRGGERKLSKGQ

SEQ ID NO: 8772 - DNA, 99 bp, homo sapiens
atgagtgcggccgggaaattctcaggaaacggactgggaaaaaaaaaacaacaactaacatggaggggcggggagagaaaactgagtaaggggcagtga

SEQ ID NO: 8773 - protein, 9 aa, homo sapiens
MEGRGEKTE

SEQ ID NO: 8774 - DNA, 30 bp, homo sapiens
atggaggggcggggagagaaaactgagtaa

SEQ ID NO: 8775 - protein, 18 aa, homo sapiens
MNFSSYLQEVSYVLERNV

SEQ ID NO: 8776 - DNA, 57 bp, homo sapiens
atgaacttttcctcttatttgcaagaagttagttatgtcttggaaagaaatgtgtga

SEQ ID NO: 8777 - protein, 4 aa, homo sapiens
MGGF

SEQ ID NO: 8778 - DNA, 15 bp, homo sapiens
atgggcgggttctga

SEQ ID NO: 8779 - protein, 6 aa, homo sapiens
MWPQGE

SEQ ID NO: 8780 - DNA, 21 bp, homo sapiens
atgtggccccagggcgagtga

SEQ ID NO: 8781 - protein, 4 aa, homo sapiens
MGCP

SEQ ID NO: 8782 - DNA, 15 bp, homo sapiens
atggggtgcccctga

SEQ ID NO: 8783 - protein, 35 aa, homo sapiens [sequence omitted]

SEQ ID NO: 8784 - DNA, 108 bp, homo sapiens; identical to SEQ ID NO: 8464

SEQ ID NO: 8785 - protein, 10 aa, homo sapiens
MVLGDGTPGV

SEQ ID NO: 8786 - DNA, 33 bp, homo sapiens; identical to SEQ ID NO: 6076

SEQ ID NO: 8787 - protein, 42 aa, homo sapiens; identical to SEQ ID NO: 6077

SEQ ID NO: 8788 - DNA, 129 bp, homo sapiens; identical to SEQ ID NO: 6078

SEQ ID NO: 8789 - protein, 59 aa, homo sapiens [sequence omitted]

SEQ ID NO: 8790 - DNA, 180 bp, homo sapiens; identical to SEQ ID NO: 6080

SEQ ID NO: 8791 - protein, 15 aa, homo sapiens
MRILVSYYILKKISL

SEQ ID NO: 8792 - DNA, 48 bp, homo sapiens
atgagaattttagtatcttattacatactaaaaaaaatttctttatga

SEQ ID NO: 8793 - protein, 12 aa, homo sapiens
MGANLTFKVFNK

SEQ ID NO: 8794 - DNA, 39 bp, homo sapiens; identical to SEQ ID NO: 8770

SEQ ID NO: 8795 - protein, 32 aa, homo sapiens; identical to SEQ ID NO: 8771

SEQ ID NO: 8796 - DNA, 99 bp, homo sapiens; identical to SEQ ID NO: 8772

SEQ ID NO: 8797 - protein, 9 aa, homo sapiens
MEGRGEKTE

SEQ ID NO: 8798 - DNA, 30 bp, homo sapiens; identical to SEQ ID NO: 8774

SEQ ID NO: 8799 - protein, 18 aa, homo sapiens
MNFSSYLQEVSYVLERNV

SEQ ID NO: 8800 - DNA, 57 bp, homo sapiens; identical to SEQ ID NO: 8776

SEQ ID NO: 8801 - protein, 12 aa, homo sapiens
MGANLTFKVFNK

SEQ ID NO: 8802 - DNA, 39 bp, homo sapiens; identical to SEQ ID NO: 8770

SEQ ID NO: 8803 - protein, 32 aa, homo sapiens; identical to SEQ ID NO: 8771

SEQ ID NO: 8804 - DNA, 99 bp, homo sapiens; identical to SEQ ID NO: 8772

SEQ ID NO: 8805 - protein, 9 aa, homo sapiens
MEGRGEKTE

SEQ ID NO: 8806 - DNA, 30 bp, homo sapiens; identical to SEQ ID NO: 8774

SEQ ID NO: 8807 - protein, 18 aa, homo sapiens
MNFSSYLQEVSYVLERNV

SEQ ID NO: 8808 - DNA, 57 bp, homo sapiens; identical to SEQ ID NO: 8776

SEQ ID NO: 8809 - protein, 23 aa, homo sapiens
MLGTPGGAGPRGPAASSGSVPSR

SEQ ID NO: 8810 - DNA, 72 bp, homo sapiens
atgctgggaaccccggggggggcggggcctcgcggccctgcagcctcgtcaggctcagtcccctcccgataa

SEQ ID NO: 8811 - protein, 25 aa, homo sapiens
MKNPVPSAFFFSSLGSRHVMVLLYF

SEQ ID NO: 8812 - DNA, 78 bp, homo sapiens
atgaaaaaccctgtcccttcggctttttttttttcctctctcgggtctcgtcacgtgatggtcctactttatttttaa

SEQ ID NO: 8813 - protein, 13 aa, homo sapiens
MAHIPQHPKSSAT

SEQ ID NO: 8814 - DNA, 42 bp, homo sapiens
atggcgcatattccccagcatcctaaatctagtgcaacctag

SEQ ID NO: 8815 - protein, 36 aa, homo sapiens
MNTAFPVTGWASRKEILRLVSNTLCFRWPDMLCGLL

SEQ ID NO: 8816 - DNA, 111 bp, homo sapiens
atgaatactgcgtttccagtgacaggttgggcgagcagaaaggaaatcttacggttagtttcaaacactttgtgttttaggtggccagatatgctgtgtggtttgctttaa

SEQ ID NO: 8817 - protein, 17 aa, homo sapiens
MRIRLGALPLASGWSII

SEQ ID NO: 8818 - DNA, 54 bp, homo sapiens; identical to SEQ ID NO: 8482

SEQ ID NO: 8819 - protein, 18 aa, homo sapiens
MEYYLISCGVSVYYGVLI

SEQ ID NO: 8820 - DNA, 57 bp, homo sapiens; identical to SEQ ID NO: 8484

SEQ ID NO: 8821 - protein, 54 aa, homo sapiens [sequence omitted]

SEQ ID NO: 8822 - DNA, 165 bp, homo sapiens; identical to SEQ ID NO: 8486

SEQ ID NO: 8823 - protein, 8 aa, homo sapiens
MGLTWKLH

SEQ ID NO: 8824 - DNA, 27 bp, homo sapiens
atggggctgacttggaagttacattag

SEQ ID NO: 8825 - protein, 12 aa, homo sapiens
MGANLTFKVFNK

SEQ ID NO: 8826 - DNA, 39 bp, homo sapiens; identical to SEQ ID NO: 8770

SEQ ID NO: 8827 - protein, 32 aa, homo sapiens; identical to SEQ ID NO: 8771

SEQ ID NO: 8828 - DNA, 99 bp, homo sapiens; identical to SEQ ID NO: 8772

SEQ ID NO: 8829 - protein, 9 aa, homo sapiens
MEGRGEKTE

SEQ ID NO: 8830 - DNA, 30 bp, homo sapiens; identical to SEQ ID NO: 8774

SEQ ID NO: 8831 - protein, 18 aa, homo sapiens
MNFSSYLQEVSYVLERNV

SEQ ID NO: 8832 - DNA, 57 bp, homo sapiens; identical to SEQ ID NO: 8776

SEQ ID NO: 8833 - protein, 36 aa, homo sapiens
MFRRSLNRFVSTLAAAPRVPVCLLASPFAGSLTTIF

SEQ ID NO: 8834 - DNA, 111 bp, homo sapiens
atgttccgccggagcttgaatcgttttgtaagtacactcgctgcggctccgcgcgtgccggtttgcttgctcgccagccccttcgccgggtccctcacaacaattttctga

SEQ ID NO: 8835 - protein, 48 aa, homo sapiens
MAFYSQGGCFLLFPLPRAHGGKPRPVTVAQKKSWGLREPETRARLSLA

SEQ ID NO: 8836 - DNA, 147 bp, homo sapiens
atggcgttttattctcagggaggttgctttcttttgtttcctctgccacgagcacatggaggtaaacctagacctgtcacggtggcccaaaagaagagctgggggctgagggagccggagactagggcaagactcagccttgcctag

SEQ ID NO: 8837 - protein, 17 aa, homo sapiens
MEVNLDLSRWPKRRAGG

SEQ ID NO: 8838 - DNA, 54 bp, homo sapiens
atggaggtaaacctagacctgtcacggtggcccaaaagaagagctgggggctga

SEQ ID NO: 8839 - protein, 38 aa, homo sapiens [sequence omitted]

SEQ ID NO: 8840 - DNA, 117 bp, homo sapiens
atgtgcagccgcgaggaggctgcgccgccactgcccgtgctgccgatctctggtctgaagcctcgcggaggactgagcactccagaccttgaacccatgggagaaggcggactgtga

SEQ ID NO: 8841 - protein, 12 aa, homo sapiens
MGANLTFKVFNK

SEQ ID NO: 8842 - DNA, 39 bp, homo sapiens; identical to SEQ ID NO: 8770

SEQ ID NO: 8843 - protein, 32 aa, homo sapiens; identical to SEQ ID NO: 8771

SEQ ID NO: 8844 - DNA, 99 bp, homo sapiens; identical to SEQ ID NO: 8772

SEQ ID NO: 8845 - protein, 9 aa, homo sapiens
MEGRGEKTE

SEQ ID NO: 8846 - DNA, 30 bp, homo sapiens; identical to SEQ ID NO: 8774

SEQ ID NO: 8847 - protein, 18 aa, homo sapiens
MNFSSYLQEVSYVLERNV

SEQ ID NO: 8848 - DNA, 57 bp, homo sapiens; identical to SEQ ID NO: 8776

SEQ ID NO: 8849 - protein, 15 aa, homo sapiens
MARGEVSCLCLAILG

SEQ ID NO: 8850 - DNA, 48 bp, homo sapiens; identical to SEQ ID NO: 8738

SEQ ID NO: 8851 - protein, 13 aa, homo sapiens
MLWPDPLEINPES

SEQ ID NO: 8852 - DNA, 42 bp, homo sapiens; identical to SEQ ID NO: 8740

SEQ ID NO: 8853 - protein, 4 aa, homo sapiens
MRRR

SEQ ID NO: 8854 - DNA, 15 bp, homo sapiens
atgaggaggcgatga

SEQ ID NO: 8855 - protein, 13 aa, homo sapiens
MMTLQKVAAAGGA

SEQ ID NO: 8856 - DNA, 42 bp, homo sapiens; identical to SEQ ID NO: 8744

SEQ ID NO: 8857 - protein, 127 aa, homo sapiens
MSLDWACLSSWGRATSWGPAHTRTHVERVCKSTPVLLTEGDYSTVFLGILFFFTSGLTLAARGSPPGLGCWIPATRGKHWRHDPGSTSRGARTGRGAAGLAAAAAAARGWAGLGCGEMTSPSPRAPW

SEQ ID NO: 8858 - DNA, 384 bp, homo sapiens
atgtctctggattgggcttgcctctcttcttggggaagagccacttcttggggccctgcacacacgaggacgcatgtggaaagggtctgtaaatcgacacccgttctgctaaccgaaggtgattacagcaccgtcttcttggggatactttttttttttacgtcaggcctcacgctcgctgcacggggatcgccgccagggctgggctgctggatccccgccacacgggggaagcactggcggcacgatcccggatcgacctcgcgaggcgcccgcactggccgcggggctgcgggactggcggcggcggcggcggctgcgcggggctgggcggggcttggctgcggggaaatgacgtcgccgtccccgcgcgcgccctggtaa

SEQ ID NO: 8859 - protein, 12 aa, homo sapiens
MWKGSVNRHPFC

SEQ ID NO: 8860 - DNA, 39 bp, homo sapiens
atgtggaaagggtctgtaaatcgacacccgttctgctaa

SEQ ID NO: 8861 - protein, 144 aa, homo sapiens
MSPPIPAAARPVSSSLRSLAESSVRAASGTRGAALSSTPPPGAGRGASKSWPGPRPPPPNPGHLPRAVVPAASGRRDRPVPSRGDPGVAGGTAPAAESGGRRVSGREAAAATLASRASLLHGPASTRGDRCPGWGLLGRWRPRA

SEQ ID NO: 8862 - DNA, 435 bp, homo sapiens
atgtccccgcctatccccgccgcagcccgccccgtctcctcctccctccgcagcctcgccgagtcctcggtgcgggctgcgagcgggacccgcggagctgcgctgtcctcgacgcctccgccaggcgcgggccgaggagcctccaagagctggcccggcccccggccgccgccgcccaaccccgggcatctgccccgcgccgttgtccccgcggcttcgggccggcgggaccgccccgtcccttccaggggtgacccgggggtcgcgggtgggacggcgcctgcggccgagtctggggggcgccgggtgtcgggtcgggaagcggccgccgcgactcttgcctcccgggcgtcgttgctccacgggcctgcctccacccgcggggacaggtgccccggctggggtctgttgggaagatggcgaccccgggcatga

SEQ ID NO: 8863 - protein, 112 aa, homo sapiens [sequence omitted]

SEQ ID NO: 8864 - DNA, 339 bp, homo sapiens; identical to SEQ ID NO: 6802

SEQ ID NO: 8865 - protein, 5 aa, homo sapiens
MVKRQ

SEQ ID NO: 8866 - DNA, 18 bp, homo sapiens
atggtgaaaagacagtag

SEQ ID NO: 8867 - protein, 18 aa, homo sapiens
MINACKGASLLYDKSWLT

SEQ ID NO: 8868 - DNA, 57 bp, homo sapiens
atgataaatgcatgcaaaggagcttctcttctatatgacaagtcttggctaacttag

SEQ ID NO: 8869 - protein, 14 aa, homo sapiens
MHAKELLFYMTSLG

SEQ ID NO: 8870 - DNA, 45 bp, homo sapiens
atgcatgcaaaggagcttctcttctatatgacaagtcttggctaa

SEQ ID NO: 8871 - protein, 8 aa, homo sapiens
MQRSFSSI

SEQ ID NO: 8872 - DNA, 27 bp, homo sapiens
atgcaaaggagcttctcttctatatga

SEQ ID NO: 8873 - protein, 4 aa, homo sapiens
MPSS

SEQ ID NO: 8874 - DNA, 15 bp, homo sapiens
atgccatcatcttag

SEQ ID NO: 8875 - protein, 36 aa, homo sapiens; identical to SEQ ID NO: 6839

SEQ ID NO: 8876 - DNA, 111 bp, homo sapiens; identical to SEQ ID NO: 6840

SEQ ID NO: 8877 - protein, 13 aa, homo sapiens
MVVCTCSPSFSGG

SEQ ID NO: 8878 - DNA, 42 bp, homo sapiens
atggtggtgtgcacctgcagtcctagcttctcaggaggctga

SEQ ID NO: 8879 - protein, 54 aa, homo sapiens
MSYGSCHCTPALATEGDKKIKIKRRRILRIARIVCVNFRSVVLSMGRFCSPGHI

SEQ ID NO: 8880 - DNA, 165 bp, homo sapiens
atgagctatggatcatgccactgcactccagccttggcaacagagggagacaaaaaaataaaaataaagagaagaagaatcctacggattgccagaattgtgtgtgttaattttagatctgtggttctcagcatggggcgattttgctccccagggcacatttga

SEQ ID NO: 8881 - protein, 67 aa, homo sapiens
MFGGTDPSPRTRARSSRGCTWAVAAGYFYPSPFLLLPGRRGLPPGPARVGLHPGRNPALNTGGAATA

SEQ ID NO: 8882 - DNA, 204 bp, homo sapiens
atgtttggaggtacggacccctctccgcgcacccgcgctcggtcctcccgcggctgcacgtgggccgtggccgccggctatttttacccttctccttttctccttctgccggggcgccgggggctgcctcccggaccagcccgcgtcggtctccatcctggaagaaacccggcgcttaacaccggcggtgccgctaccgcatag

SEQ ID NO: 8883 - protein, 57 aa, homo sapiens [sequence omitted]

SEQ ID NO: 8884 - DNA, 174 bp, homo sapiens; identical to SEQ ID NO: 6856

SEQ ID NO: 8885 - protein, 27 aa, homo sapiens
MLFYNKPTKQPLWLWFLVPGSQEETSC

SEQ ID NO: 8886 - DNA, 84 bp, homo sapiens
atgttgttttacaacaaaccgacgaaacagcccttgtggttgtggtttttagtaccaggaagtcaggaggagaccagttgctaa

SEQ ID NO: 8887 - protein, 13 aa, homo sapiens
MNTELPCLDRLLV

SEQ ID NO: 8888 - DNA, 42 bp, homo sapiens
atgaacactgagttaccatgtttggaccgacttttagtataa

SEQ ID NO: 8889 - protein, 80 aa, homo sapiens; identical to SEQ ID NO: 6907

SEQ ID NO: 8890 - DNA, 243 bp, homo sapiens; identical to SEQ ID NO: 6908

SEQ ID NO: 8891 - protein, 20 aa, homo sapiens
MSSSDWVPERLWTLCPAEEA

SEQ ID NO: 8892 - DNA, 63 bp, homo sapiens; identical to SEQ ID NO: 6910

SEQ ID NO: 8893 - protein, 29 aa, homo sapiens
MVLWMISNKKNGRVNYRAWTGGRGASRGR

SEQ ID NO: 8894 - DNA, 90 bp, homo sapiens; identical to SEQ ID NO: 6912

SEQ ID NO: 8895 - protein, 51 aa, homo sapiens [sequence omitted]

SEQ ID NO: 8896 - DNA, 156 bp, homo sapiens
atgcagaacccgggccgagaaggggagggaagtgacccaagcgaaggcttctggacggggagagggttgcggagaaagggggcgttctccagtgcaggctggtctacccctctctcctctttctctggctcccagtcccagttctccccaccctag

SEQ ID NO: 8897 - protein, 43 aa, homo sapiens
MWAWGWGGAKLRGRAADTLKLRAGRAQRKGRRPHGYPSAARVK

SEQ ID NO: 8898 - DNA, 132 bp, homo sapiens
atgtgggcatgggggtggggaggcgcgaagctccgaggccgggccgcggatactttaaagctcagagctgggagggcccaaaggaaggggcggcgtccacatggttacccttctgctgcgcgggtcaagtag

SEQ ID NO: 8899 - protein, 52 aa, homo sapiens
MGVGRREAPRPGRGYFKAQSWEGPKEGAASTWLPFCCAGQVASSGGRKARRG

SEQ ID NO: 8900 - DNA, 159 bp, homo sapiens
atgggggtggggaggcgcgaagctccgaggccgggccgcggatactttaaagctcagagctgggagggcccaaaggaaggggcggcgtccacatggttacccttctgctgcgcgggtcaagtagcttcttctggagggcgcaaggcgcggcgggggtga

SEQ ID NO: 8901 - protein, 67 aa, homo sapiens [sequence omitted]

SEQ ID NO: 8902 - DNA, 204 bp, homo sapiens
atggttacccttctgctgcgcgggtcaagtagcttcttctggagggcgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctga

SEQ ID NO: 8903 - protein, 5 aa, homo sapiens
MCLRC

SEQ ID NO: 8904 - DNA, 18 bp, homo sapiens
atgtgtttacgatgttga

SEQ ID NO: 8905 - protein, 126 aa, homo sapiens
MRRKPQGWARGRGSGGAGESAGVRAGGGRPGVPAPRRCRLRRGRRSPGRRWRGEVGNGPGLARGGGARTPPSARARLRSWVRDRKGWKGWAPGGCGEWRWASRTCTWRKRENVPLGLGRVGSQGVG

SEQ ID NO: 8906 - DNA, 381 bp, homo sapiens
atgcggaggaagccgcaagggtgggcgcggggccgcggctcgggcggggcgggggagtcggcaggggtgcgggccgggggagggcggccaggtgtcccggctcccaggcgctgccgcctcaggcgtggtaggcggagtccggggcggaggtggcgtggggaggtggggaacggcccgggactcgcacgtggaggtggagcgcggacgcctccctcagccagggcaagactaaggagctgggtgagggaccggaagggctggaaggggtgggcacctgggggctgcggcgagtggcgatgggcgagccggacttgcacgtggagaaagcgtgagaatgtgcccctgggtttggggagggtggggagccaaggagtgggatga

SEQ ID NO: 8907 - protein, 11 aa, homo sapiens
MGEPDLHVEKA

SEQ ID NO: 8908 - DNA, 36 bp, homo sapiens; identical to SEQ ID NO: 1562

SEQ ID NO: 8909 - protein, 36 aa, homo sapiens; identical to SEQ ID NO: 1563

SEQ ID NO: 8910 - DNA, 111 bp, homo sapiens; identical to SEQ ID NO: 1564

SEQ ID NO: 8911 - protein, 26 aa, homo sapiens
MRGGHGMGGAAVLPGGCRPRPGEGRG

SEQ ID NO: 8912 - DNA, 81 bp, homo sapiens; identical to SEQ ID NO: 1566

SEQ ID NO: 8913 - protein, 10 aa, homo sapiens
MDSVGRRGAR

SEQ ID NO: 8914 - DNA, 33 bp, homo sapiens
atggactcggtgggccggcgcggggcccgttag

SEQ ID NO: 8915 - protein, 78 aa, homo sapiens
METAKPREVYLLPQRPQYPAWPQASGPDVLPRAQTYYRLGRRPPQPRVSATWPAPSEAPESDSQGACRSVASQERRVT

SEQ ID NO: 8916 - DNA, 237 bp, homo sapiens
atggagacggctaagccgcgagaagtttaccttctaccacagcgtccacagtacccggcttggcctcaggcctcgggtcccgacgtcctccccagagcacaaacctactacaggttaggccggaggccgccacagcccagggtctctgccacctggcccgccccctccgaggcgccggagagcgattcccaaggggcctgccggagcgtggcgtcacaggagcgtcgcgtcacgtga

SEQ ID NO: 8917 - protein, 160 aa, homo sapiens [sequence omitted]

SEQ ID NO: 8918 - DNA, 483 bp, homo sapiens; identical to SEQ ID NO: 6978

SEQ ID NO: 8919 - protein, 16 aa, homo sapiens
MTSLPHYQENWEFGIL

SEQ ID NO: 8920 - DNA, 51 bp, homo sapiens; identical to SEQ ID NO: 6980

SEQ ID NO: 8921 - protein, 14 aa, homo sapiens
MPPTRRVGVRRRAP

SEQ ID NO: 8922 - DNA, 45 bp, homo sapiens
atgccgccgacgcggcgggttggagtgcgacgaagagcgccgtga

SEQ ID NO: 8923 - protein, 84 aa, homo sapiens [sequence omitted]

SEQ ID NO: 8924 - DNA, 255 bp, homo sapiens
atggatcgttggtacccggaagcccgttcaaactgtataagggtgatcagctatcacggagaaggctttagcaagtcggggccagtggcgcaatggataacgcgtctgactacggatcagaagattctaggttcgactcctggctggctcgcgatgtctgttttgccacacttgacccatgtactactgggtcttgtaaagatgtatattcacaatgtgaaagtattacaagaccttggaaaggtgtatggttag

SEQ ID NO: 8925 - protein, 58 aa, homo sapiens
MDNASDYGSEDSRFDSWLARDVCFATLDPCTTGSCKDVYSQCESITRPWKGVWLECES

SEQ ID NO: 8926 - DNA, 177 bp, homo sapiens
atggataacgcgtctgactacggatcagaagattctaggttcgactcctggctggctcgcgatgtctgttttgccacacttgacccatgtactactgggtcttgtaaagatgtatattcacaatgtgaaagtattacaagaccttggaaaggtgtatggttagaatgtgaaagttaa

SEQ ID NO: 8927 - protein, 6 aa, homo sapiens
MYYWVL

SEQ ID NO: 8928 - DNA, 21 bp, homo sapiens
atgtactactgggtcttgtaa

SEQ ID NO: 8929 - protein, 6 aa, homo sapiens
MAPGGR

SEQ ID NO: 8930 - DNA, 21 bp, homo sapiens
atggccccggggggccgctag

SEQ ID NO: 8931 - protein, 101 aa, homo sapiens; identical to SEQ ID NO: 6989

SEQ ID NO: 8932 - DNA, 306 bp, homo sapiens; identical to SEQ ID NO: 6990

SEQ ID NO: 8933 - protein, 10 aa, homo sapiens
MRLPYLSVST

SEQ ID NO: 8934 - DNA, 33 bp, homo sapiens; identical to SEQ ID NO: 6992

SEQ ID NO: 8935 - protein, 29 aa, homo sapiens
MGQEGIKVGLGMRQCWRELAGAGAGGPTG

SEQ ID NO: 8936 - DNA, 90 bp, homo sapiens
atgggacaggagggtatcaaagttggcctaggaatgaggcagtgctggcgggagttggctggagctggggctgggggccccactggataa

SEQ ID NO: 8937 - protein, 26 aa, homo sapiens
MTIKFCTSFPEAPDRLAWSIYYWTYS

SEQ ID NO: 8938 - DNA, 81 bp, homo sapiens
atgactatcaaattctgtacctcatttccagaggctcctgacagacttgcttggtcaatatactactggacatattcatga

SEQ ID NO: 8939 - protein, 46 aa, homo sapiens
MRLSHTGISNPVCPTILFLSMPVPLPLPHMSVTVHLLSLSPSPFGS

SEQ ID NO: 8940 - DNA, 141 bp, homo sapiens
atgagactgtctcacacaggcatctcgaacccagtgtgtcccacaattctcttcctatccatgcctgttcctcttccactgcctcatatgtcggtgactgtccaccttctctctctctccccctctccgtttggctcatag

SEQ ID NO: 8941 - protein, 28 aa, homo sapiens
MAITLLQINIFNHWNDGNNLIGFILSSI

SEQ ID NO: 8942 - DNA, 87 bp, homo sapiens
atggccattaccctattacagatcaacatcttcaatcactggaatgatggcaataatctaattgggttcattttatcctctatctaa

SEQ ID NO: 8943 - protein, 5 aa, homo sapiens
MMAII

SEQ ID NO: 8944 - DNA, 18 bp, homo sapiens
atgatggcaataatctaa

SEQ ID NO: 8945 - protein, 4 aa, homo sapiens
MIGS

SEQ ID NO: 8946 - DNA, 15 bp, homo sapiens
atgattggtagctaa

SEQ ID NO: 8947 - protein, 11 aa, homo sapiens
MVSVRGRASQG

SEQ ID NO: 8948 - DNA, 36 bp, homo sapiens; identical to SEQ ID NO: 7028

SEQ ID NO: 8949 - protein, 61 aa, homo sapiens; identical to SEQ ID NO: 7029

SEQ ID NO: 8950 - DNA, 186 bp, homo sapiens; identical to SEQ ID NO: 7030

SEQ ID NO: 8951 - protein, 24 aa, homo sapiens
MPAWEELWEKLWSGDPVPALPCSE

SEQ ID NO: 8952 - DNA, 75 bp, homo sapiens; identical to SEQ ID NO: 7032

SEQ ID NO: 8953 - protein, 142 aa, homo sapiens; identical to SEQ ID NO: 7049

SEQ ID NO: 8954 - DNA, 429 bp, homo sapiens; identical to SEQ ID NO: 7050

SEQ ID NO: 8955 - protein, 43 aa, homo sapiens; identical to SEQ ID NO: 7051

SEQ ID NO: 8956 - DNA, 132 bp, homo sapiens; identical to SEQ ID NO: 7052

SEQ ID NO: 8957 - protein, 16 aa, homo sapiens
MRQALSSEPLFALSAA

SEQ ID NO: 8958 - DNA, 51 bp, homo sapiens; identical to SEQ ID NO: 7054

SEQ ID NO: 8959 - protein, 6 aa, homo sapiens
MDLRHK

SEQ ID NO: 8960 - DNA, 21 bp, homo sapiens
atggatttgaggcacaagtga

SEQ ID NO: 8961 - protein, 6 aa, homo sapiens
MSAAGL

SEQ ID NO: 8962 - DNA, 21 bp, homo sapiens
atgtcagccgctggactgtag

SEQ ID NO: 8963 - protein, 5 aa, homo sapiens
MPLQP

SEQ ID NO: 8964 - DNA, 18 bp, homo sapiens
atgcccttgcagccttga

SEQ ID NO: 8965 - protein, 41 aa, homo sapiens; identical to SEQ ID NO: 7101

SEQ ID NO: 8966 - DNA, 126 bp, homo sapiens; identical to SEQ ID NO: 7102

SEQ ID NO: 8967 - protein, 48 aa, homo sapiens; identical to SEQ ID NO: 7103

SEQ ID NO: 8968 - DNA, 147 bp, homo sapiens; identical to SEQ ID NO: 7104

SEQ ID NO: 8969 - protein, 96 aa, homo sapiens; identical to SEQ ID NO: 7179

SEQ ID NO: 8970 - DNA, 291 bp, homo sapiens; identical to SEQ ID NO: 7180

SEQ ID NO: 8971 - protein, 22 aa, homo sapiens
MLSFSPSPLLPGACLLNDVGGG

SEQ ID NO: 8972 - DNA, 69 bp, homo sapiens; identical to SEQ ID NO: 7182

SEQ ID NO: 8973 - protein, 41 aa, homo sapiens; identical to SEQ ID NO: 7183

SEQ ID NO: 8974 - DNA, 126 bp, homo sapiens; identical to SEQ ID NO: 7184

SEQ ID NO: 8975 - protein, 55 aa, homo sapiens
MEEKPFHLRDLRRTLEFFPNTPQIWVRWRSPPRPCNVVQSIVSAERGAAGTLDSD

SEQ ID NO: 8976 - DNA, 168 bp, homo sapiens
atggaggaaaagccatttcacctgagggacttacgacgtaccctggaattctttcccaacactccccaaatctgggtccgatggagaagcccgccgcgtccctgtaatgtggtgcaaagtattgtctctgcagaaaggggtgcagcggggactctagactctgactag

SEQ ID NO: 8977 - protein, 20 aa, homo sapiens
MADFDTYDDRAYSSFGGGRG

SEQ ID NO: 8978 - DNA, 63 bp, homo sapiens; identical to SEQ ID NO: 7186

SEQ ID NO: 8979 - protein, 64 aa, homo sapiens; identical to SEQ ID NO: 7187

SEQ ID NO: 8980 - DNA, 195 bp, homo sapiens; identical to SEQ ID NO: 7188

SEQ ID NO: 8981 - protein, 15 aa, homo sapiens
MPGDERPLPAPSPLR

SEQ ID NO: 8982 - DNA, 48 bp, homo sapiens; identical to SEQ ID NO: 7190

SEQ ID NO: 8983 - protein, 13 aa, homo sapiens
MVRLLAGGGRPRR

SEQ ID NO: 8984 - DNA, 42 bp, homo sapiens; identical to SEQ ID NO: 7192

SEQ ID NO: 8985 - protein, 6 aa, homo sapiens
MWTFVL

SEQ ID NO: 8986 - DNA, 21 bp, homo sapiens
atgtggacttttgttctctaa

SEQ ID NO: 8987 - protein, 7 aa, homo sapiens
MTYQRGK

SEQ ID NO: 8988 - DNA, 24 bp, homo sapiens
atgacgtaccaaagaggaaaatag

SEQ ID NO: 8989 - protein, 21 aa, homo sapiens
MLCERVVCRSPSGLMDKALAS

SEQ ID NO: 8990 - DNA, 66 bp, homo sapiens
atgttgtgtgagcgcgtcgtttgcagaagccccagtggcctaatggataaggcattggcctcctaa

SEQ ID NO: 8991 - protein, 35 aa, homo sapiens
MPTLLFFFLNGKCVCVFTSWWAAIFENLHTPMSFV

SEQ ID NO: 8992 - DNA, 108 bp, homo sapiens
atgccaactttactttttttttttttaaatgggaagtgtgtgtgtgtttttactagctggtgggctgcaattttcgagaatctgcacacacccatgtcctttgtctga

SEQ ID NO: 8993 - protein, 76 aa, homo sapiens
MRASDPASPHIGERGAGWPIFQQAAWLVTSCPFHPVVSEHEIFHRSELCGYNFFSTRFHSVTQAGMQEYDHSSLQP

SEQ ID NO: 8994 - DNA, 231 bp, homo sapiens
atgagagccagcgaccctgccagcccccacatcggtgagcgtggagctgggtggcccattttccagcaggctgcctggctggttacgagttgccctttccacccagtggtatcagaacatgagatattccacagaagtgaattgtgtggatataatttttttagcacaaggtttcactctgtcacacaggctggaatgcaggagtatgatcatagctcgctgcagccttaa

SEQ ID NO: 8995 - protein, 69 aa, homo sapiens
MRYSTEVNCVDIIFLAQGFTLSHRLECRSMIIARCSLNSWAQAQGFSRPSLLSCWDYRLTPPHQANFFF

SEQ ID NO: 8996 - DNA, 210 bp, homo sapiens
atgagatattccacagaagtgaattgtgtggatataatttttttagcacaaggtttcactctgtcacacaggctggaatgcaggagtatgatcatagctcgctgcagccttaactcctgggctcaagctcaagggttctcccgccccagcctcctgagttgctgggactacaggcttacaccaccacaccaggctaatttttttttttaa

SEQ ID NO: 8997 - protein, 13 aa, homo sapiens
MYLFFVYFYFYFF

SEQ ID NO: 8998 - DNA, 42 bp, homo sapiens
atgtatttgttttttgtttatttttatttttattttttttag

SEQ ID NO: 8999 - protein, 39 aa, homo sapiens
MSACHHAWLLNRFAKNSNNMYVISAPPHGSGLPCHSSMK

SEQ ID NO: 9000 - DNA, 120 bp, homo sapiens
atgagcgcgtgccaccatgcctggctattaaatagatttgctaaaaacagcaacaacatgtatgtcatctctgccccgcctcacggatctggccttccatgtcacagcagtatgaaatga

SEQ ID NO: 9001 - protein, 18 aa, homo sapiens
MNFSVETAPPQSLFKKQK

SEQ ID NO: 9002 - DNA, 57 bp, homo sapiens
atgaacttctccgtcgaaactgctcctccccagagcctgtttaagaagcagaaataa

SEQ ID NO: 9003 - protein, 19 aa, homo sapiens
MPVDALTSKIFKGEVDTRY

SEQ ID NO: 9004 - DNA, 60 bp, homo sapiens; identical to SEQ ID NO: 1620

SEQ ID NO: 9005 - protein, 11 aa, homo sapiens
MSKPLGIIESP

SEQ ID NO: 9006 - DNA, 36 bp, homo sapiens; identical to SEQ ID NO: 1622

SEQ ID NO: 9007 - protein, 29 aa, homo sapiens
MGNERRKGKEMGWKEKSRRDRPIPVGLVP

SEQ ID NO: 9008 - DNA, 90 bp, homo sapiens; identical to SEQ ID NO: 1624

SEQ ID NO: 9009 - protein, 51 aa, homo sapiens; identical to SEQ ID NO: 7339

SEQ ID NO: 9010 - DNA, 156 bp, homo sapiens; identical to SEQ ID NO: 7340

SEQ ID NO: 9011 - protein, 25 aa, homo sapiens
MSRGFSPNQCPSLAFSTIFKHTFNI

SEQ ID NO: 9012 - DNA, 78 bp, homo sapiens; identical to SEQ ID NO: 7342

SEQ ID NO: 9013 - protein, 38 aa, homo sapiens; identical to SEQ ID NO: 7343

SEQ ID NO: 9014 - DNA, 117 bp, homo sapiens; identical to SEQ ID NO: 7344

SEQ ID NO: 9015 - protein, 8 aa, homo sapiens
MATYSSSV

SEQ ID NO: 9016 - DNA, 27 bp, homo sapiens
atggccacatactcttcatctgtgtaa

SEQ ID NO: 9017 - protein, 34 aa, homo sapiens; identical to SEQ ID NO: 7347

SEQ ID NO: 9018 - DNA, 105 bp, homo sapiens; identical to SEQ ID NO: 7348

SEQ ID NO: 9019 - protein, 7 aa, homo sapiens
MRGPLGV

SEQ ID NO: 9020 - DNA, 24 bp, homo sapiens
atgcgaggacccctcggggtctga

SEQ ID NO: 9021 - protein, 11 aa, homo sapiens
MNSLGFSARDF

SEQ ID NO: 9022 - DNA, 36 bp, homo sapiens; identical to SEQ ID NO: 7352

SEQ ID NO: 9023 - protein, 8 aa, homo sapiens
MPWANVYW

SEQ ID NO: 9024 - DNA, 27 bp, homo sapiens
atgccctgggcaaatgtttattggtga

SEQ ID NO: 9025 - protein, 24 aa, homo sapiens
MRVKKGRGLVRDTVWVVGVVGNAG

SEQ ID NO: 9026 - DNA, 75 bp, homo sapiens
atgagggtgaagaaggggagagggttggttagagatacagtgtgggtggtgggggtggtaggaaatgcaggttga

SEQ ID NO: 9027 - protein, 13 aa, homo sapiens
MQVEGNSLGLWGI

SEQ ID NO: 9028 - DNA, 42 bp, homo sapiens
atgcaggttgaagggaattctctggggctttggggaatttag

SEQ ID NO: 9029 - protein, 39 aa, homo sapiens
MPSHRQGKCLYQLPPGGQDSLFQRVVLFGVWVLSSELVT

SEQ ID NO: 9030 - DNA, 120 bp, homo sapiens
atgccatctcacaggcaggggaaatgtctttaccagcttcctcctggtggccaagacagcctgtttcagagggttgttttgtttggggtgtgggtgttatcaagtgaattagtcacttga

SEQ ID NO: 9031 - protein, 27 aa, homo sapiens
MSLPASSWWPRQPVSEGCFVWGVGVIK

SEQ ID NO: 9032 - DNA, 84 bp, homo sapiens
atgtctttaccagcttcctcctggtggccaagacagcctgtttcagagggttgttttgtttggggtgtgggtgttatcaagtga

SEQ ID NO: 9033 - protein, 16 aa, homo sapiens
MMSELYNTMKKIKTSN

SEQ ID NO: 9034 - DNA, 51 bp, homo sapiens
atgatgtcggaactatacaacaccatgaaaaaaattaagacaagcaactga

SEQ ID NO: 9035 - protein, 4 aa, homo sapiens
MLYT

SEQ ID NO: 9036 - DNA, 15 bp, homo sapiens
atgttatatacataa

SEQ ID NO: 9037 - protein, 27 aa, homo sapiens
MPVIPALLEAKAGGSLEPRSSRPAWAT

SEQ ID NO: 9038 - DNA, 84 bp, homo sapiens
atgcctgtcatcccagcacttttggaagccaaggcaggcggatcacttgagcctaggagttcgagaccagcctgggcaacatga

SEQ ID NO: 9039 - protein, 8 aa, homo sapiens
MTKPPLYK

SEQ ID NO: 9040 - DNA, 27 bp, homo sapiens
atgacgaaaccccctctttacaaatga

SEQ ID NO: 9041 - protein, 154 aa, homo sapiens [sequence omitted]

SEQ ID NO: 9042 - DNA, 465 bp, homo sapiens; identical to SEQ ID NO: 7402

SEQ ID NO: 9043 - protein, 18 aa, homo sapiens
MDRPQRCRHPGTATADWT

SEQ ID NO: 9044 - DNA, 57 bp, homo sapiens; identical to SEQ ID NO: 7404

SEQ ID NO: 9045 - protein, 4 aa, homo sapiens
MRGK

SEQ ID NO: 9046 - DNA, 15 bp, homo sapiens
atgcggggcaaataa

SEQ ID NO: 9047 - protein, 7 aa, homo sapiens
MARKTVH

SEQ ID NO: 9048 - DNA, 24 bp, homo sapiens
atggctcgtaaaactgtccactaa

SEQ ID NO: 9049 - protein, 112 aa, homo sapiens [sequence omitted]

SEQ ID NO: 9050 - DNA, 339 bp, homo sapiens; identical to SEQ ID NO: 7414

SEQ ID NO: 9051 - protein, 60 aa, homo sapiens; identical to SEQ ID NO: 7415

SEQ ID NO: 9052 - DNA, 183 bp, homo sapiens; identical to SEQ ID NO: 7416

SEQ ID NO: 9053 - protein, 14 aa, homo sapiens
MATLVAGATGPCSG

SEQ ID NO: 9054 - DNA, 45 bp, homo sapiens
atggccaccttggtagctggggctactggaccctgcagcggatag

SEQ ID NO: 9055 - protein, 11 aa, homo sapiens
MDREWCVFLLP

SEQ ID NO: 9056 - DNA, 36 bp, homo sapiens
atggacagggagtggtgtgttttccttttgccgtag

SEQ ID NO: 9057 - protein, 63 aa, homo sapiens; identical to SEQ ID NO: 7433

SEQ ID NO: 9058 - DNA, 192 bp, homo sapiens; identical to SEQ ID NO: 7434

SEQ ID NO: 9059 - protein, 28 aa, homo sapiens
MQCDPSGSVCRILCVRCDPHQGVTPILG

SEQ ID NO: 9060 - DNA, 87 bp, homo sapiens; identical to SEQ ID NO: 7436

SEQ ID NO: 9061 - protein, 6 aa, homo sapiens
MCNWDP

SEQ ID NO: 9062 - DNA, 21 bp, homo sapiens
atgtgcaactgggacccttga

SEQ ID NO: 9063 - protein, 6 aa, homo sapiens
MPGCAM

SEQ ID NO: 9064 - DNA, 21 bp, homo sapiens
atgcctggctgtgcgatgtga

SEQ ID NO: 9065 - protein, 63 aa, homo sapiens
MAATSSRLLVPPTQGGGLRHVTLPFLAPPPTAVLDGRRSGERGRRPFCVCFLWDVVVAVGLGK

SEQ ID NO: 9066 - DNA, 192 bp, homo sapiens
atggctgccacctcttcgcgcctcttagtcccacccactcagggcggaggtctgcgtcatgtgaccctccccttcttggctccgcctcctaccgcagtgcttgacgggaggcggagcggggaacgaggccgtcggccattttgtgtctgcttcctgtgggacgtggtggtagccgttgggttgggaaagtga

SEQ ID NO: 9067 - protein, 19 aa, homo sapiens
MGRKKKKQLKPWCWYPLSV

SEQ ID NO: 9068 - DNA, 60 bp, homo sapiens; identical to SEQ ID NO: 7578

SEQ ID NO: 9069 - protein, 17 aa, homo sapiens
MGFRGRQAFAVVGRVTL

SEQ ID NO: 9070 - DNA, 54 bp, homo sapiens; identical to SEQ ID NO: 7580

SEQ ID NO: 9071 - protein, 58 aa, homo sapiens; identical to SEQ ID NO: 7581

SEQ ID NO: 9072 - DNA, 177 bp, homo sapiens; identical to SEQ ID NO: 7582

SEQ ID NO: 9073 - protein, 5 aa, homo sapiens
MEEGL

SEQ ID NO: 9074 - DNA, 18 bp, homo sapiens
atggaggagggattgtaa

SEQ ID NO: 9075 - protein, 9 aa, homo sapiens
MAAAGSSLL

SEQ ID NO: 9076 - DNA, 30 bp, homo sapiens; identical to SEQ ID NO: 7492

SEQ ID NO: 9077 - protein, 296 aa, homo sapiens [sequence omitted]

SEQ ID NO: 9078 - DNA, 891 bp, homo sapiens; identical to SEQ ID NO: 7494

SEQ ID NO: 9079 - protein, 23 aa, homo sapiens
MLPYSLGFSVVIPYLVTHQRFQH

SEQ ID NO: 9080 - DNA, 72 bp, homo sapiens; identical to SEQ ID NO: 7496

SEQ ID NO: 9081 - protein, 8 aa, homo sapiens
MAVLLKGL

SEQ ID NO: 9082 - DNA, 27 bp, homo sapiens
atggctgtgttgttgaagggcctgtag

SEQ ID NO: 9083 - protein, 96 aa, homo sapiens [sequence omitted]

SEQ ID NO: 9084 - DNA, 291 bp, homo sapiens; identical to SEQ ID NO: 7534

SEQ ID NO: 9085 - protein, 8 aa, homo sapiens
MLHERGLG

SEQ ID NO: 9086 - DNA, 27 bp, homo sapiens
atgctacacgagaggggcttaggatga

SEQ ID NO: 9087 - protein, 7 aa, homo sapiens
MSVGLLG

SEQ ID NO: 9088 - DNA, 24 bp, homo sapiens
atgtctgtggggctacttgggtga

SEQ ID NO: 9089 - protein, 60 aa, homo sapiens; identical to SEQ ID NO: 7551

SEQ ID NO: 9090 - DNA, 183 bp, homo sapiens; identical to SEQ ID NO: 7552

SEQ ID NO: 9091 - protein, 121 aa, homo sapiens
MVCVFVCVLSHKGGCGRGAPLREEVNSARVARGAACVPGGAVHAVPGPALKSPNSPGLSPAPALLGRGRPLVKGMGAPLPTGRDGAPPLRPVGELRNLLGRFWAEGGLFWLGAVGEGPGPL

SEQ ID NO: 9092 - DNA, 366 bp, homo sapiens
atggtgtgtgtgtttgtgtgtgtgctctcacacaaagggggatgcggccggggggcgccgttgagagaggaggttaattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgttggggaggggccggggccgctctga

SEQ ID NO: 9093 - protein, 11 aa, homo sapiens
MRPGGAVERGG

SEQ ID NO: 9094 - DNA, 36 bp, homo sapiens
atgcggccggggggcgccgttgagagaggaggttaa

SEQ ID NO: 9095 - protein, 11 aa, homo sapiens
MGRPPSAPSES

SEQ ID NO: 9096 - DNA, 36 bp, homo sapiens
atggggcgccccccctccgccccgtcggagagctga

SEQ ID NO: 9097 - protein, 143 aa, homo sapiens [sequence omitted]

SEQ ID NO: 9098 - DNA, 432 bp, homo sapiens; identical to SEQ ID NO: 1650

SEQ ID NO: 9099 - protein, 165 aa, homo sapiens [sequence omitted]

SEQ ID NO: 9100 - DNA, 498 bp, homo sapiens; identical to SEQ ID NO: 1652

SEQ ID NO: 9101 - protein, 13 aa, homo sapiens
MVFIPTWPPLDIP

SEQ ID NO: 9102 - DNA, 42 bp, homo sapiens; identical to SEQ ID NO: 1654

SEQ ID NO: 9103 - protein, 60 aa, homo sapiens; identical to SEQ ID NO: 1655

SEQ ID NO: 9104 - DNA, 183 bp, homo sapiens; identical to SEQ ID NO: 1656

SEQ ID NO: 9105 - protein, 26 aa, homo sapiens
MCSLYQPFQFLPGLSWKPDFRGDCAL

SEQ ID NO: 9106 - DNA, 81 bp, homo sapiens
atgtgctctctctatcaaccattccaattcttacctggcctatcctggaagcctgacttcaggggagattgtgctttatga

SEQ ID NO: 9107 - protein, 6 aa, homo sapiens
MMETPW

SEQ ID NO: 9108 - DNA, 21 bp, homo sapiens
atgatggaaactccctggtaa

SEQ ID NO: 9109 - protein, 5 aa, homo sapiens
MEGDR

SEQ ID NO: 9110 - DNA, 18 bp, homo sapiens
atggaaggagatagataa

SEQ ID NO: 9111 - protein, 23 aa, homo sapiens
MKTTCQQGASCLPECVTLSHATA

SEQ ID NO: 9112 - DNA, 72 bp, homo sapiens
atgaaaaccacttgccagcagggggccagttgtctccctgaatgtgtcaccctgtcccatgccacagcctga

SEQ ID NO: 9113 - protein, 121 aa, homo sapiens; identical to SEQ ID NO: 7609

SEQ ID NO: 9114 - DNA, 366 bp, homo sapiens; identical to SEQ ID NO: 7610

SEQ ID NO: 9115 - protein, 4 aa, homo sapiens
MWRV

SEQ ID NO: 9116 - DNA, 15 bp, homo sapiens
atgtggagggtatga

SEQ ID NO: 9117 - protein, 52 aa, homo sapiens; identical to SEQ ID NO: 7613

SEQ ID NO: 9118 - DNA, 159 bp, homo sapiens; identical to SEQ ID NO: 7614

SEQ ID NO: 9119 - protein, 157 aa, homo sapiens; identical to SEQ ID NO: 7615

SEQ ID NO: 9120 - DNA, 474 bp, homo sapiens; identical to SEQ ID NO: 7616

SEQ ID NO: 9121 - protein, 21 aa, homo sapiens
MSTFRQEDVEDHYEMGEELGR

SEQ ID NO: 9122 - DNA, 66 bp, homo sapiens
atgtccacgttcaggcaggaggacgtggaggaccattatgagatgggggaggagctgggcaggtga

SEQ ID NO: 9123 - protein, 20 aa, homo sapiens
MRWGRSWAGELSARTAGLQG

SEQ ID NO: 9124 - DNA, 63 bp, homo sapiens
atgagatgggggaggagctgggcaggtgagctgtctgcccgcacggctgggctccagggatag

SEQ ID NO: 9125 - protein, 25 aa, homo sapiens
MLRRNESVSCGGGTNLGRGVRQPRL

SEQ ID NO: 9126 - DNA, 78 bp, homo sapiens
atgctgagaaggaatgagtcagtatcatgcggtgggggaacgaatttgggccgtggagtcagacagccccggctgtga

SEQ ID NO: 9127 - protein, 38 aa, homo sapiens
MSQYHAVGERIWAVESDSPGCEFLLGNPLCVSCGEKSN

SEQ ID NO: 9128 - DNA, 117 bp, homo sapiens
atgagtcagtatcatgcggtgggggaacgaatttgggccgtggagtcagacagccccggctgtgaattcctgcttgggaatcctctgtgtgtttcctgtggggagaaaagtaattga

SEQ ID NO: 9129 - protein, 70 aa, homo sapiens
MVKPLLFSPSYRRSAPFDWSRKLIGQSPGASPSLGSDRPQGAGANVGASCPDWPTGRARPGGAGRTQSRV

SEQ ID NO: 9130 - DNA, 213 bp, homo sapiens
atggtcaagccccttctctttagcccctcctacaggcgttccgcccccttcgattggtctcgcaagttgattggtcaatcccctggtgctagtcctagtcttggttcggaccggccccaaggagcaggggcgaacgtgggcgcctcgtgccctgattggccgacggggcgcgcgcggcctggaggggcggggcggacgcagagccgcgtttag

SEQ ID NO: 9131 - protein, 17 aa, homo sapiens
MKHYEVRSEKQGPCGHC

SEQ ID NO: 9132 - DNA, 54 bp, homo sapiens; identical to SEQ ID NO: 7642

SEQ ID NO: 9133 - protein, 41 aa, homo sapiens; identical to SEQ ID NO: 7643

SEQ ID NO: 9134 - DNA, 126 bp, homo sapiens; identical to SEQ ID NO: 7644

SEQ ID NO: 9135 - protein, 28 aa, homo sapiens
MGATKVRDPCSQSEGVLHKSCATPPSPA

SEQ ID NO: 9136 - DNA, 87 bp, homo sapiens; identical to SEQ ID NO: 7646

SEQ ID NO: 9137 - protein, 15 aa, homo sapiens
MGGGRAPPERLGGCR

SEQ ID NO: 9138 - DNA, 48 bp, homo sapiens; identical to SEQ ID NO: 7666

SEQ ID NO: 9139 - protein, 56 aa, homo sapiens; identical to SEQ ID NO: 7667

SEQ ID NO: 9140 - DNA, 171 bp, homo sapiens; identical to SEQ ID NO: 7668

SEQ ID NO: 9141 - protein, 85 aa, homo sapiens; identical to SEQ ID NO: 7669

SEQ ID NO: 9142 - DNA, 258 bp, homo sapiens; identical to SEQ ID NO: 7670

SEQ ID NO: 9143 - protein, 29 aa, homo sapiens
MLPQLWLGYITTALGEPCLERRGTQIRGL

SEQ ID NO: 9144 - DNA, 90 bp, homo sapiens; identical to SEQ ID NO: 7672

SEQ ID NO: 9145 - protein, 14 aa, homo sapiens
MSLSACFHLWLAAR

SEQ ID NO: 9146 - DNA, 45 bp, homo sapiens; identical to SEQ ID NO: 7674

SEQ ID NO: 9147 - protein, 21 aa, homo sapiens
MLGKGCSTYSGLYLPPAGKVL

SEQ ID NO: 9148 - DNA, 66 bp, homo sapiens; identical to SEQ ID NO: 7676

SEQ ID NO: 9149 - protein, 164 aa, homo sapiens [sequence omitted]

SEQ ID NO: 9150 - DNA, 495 bp, homo sapiens; identical to SEQ ID NO: 7678

SEQ ID NO: 9151 - protein, 24 aa, homo sapiens
MGVSSSPPGCGNSDGRFKYPTRGY

SEQ ID NO: 9152 - DNA, 75 bp, homo sapiens; identical to SEQ ID NO: 7680

SEQ ID NO: 9153 - protein, 16 aa, homo sapiens
MAWRYGATAAREFSFV

SEQ ID NO: 9154 - DNA, 51 bp, homo sapiens; identical to SEQ ID NO: 7682

SEQ ID NO: 9155 - protein, 54 aa, homo sapiens; identical to SEQ ID NO: 7683

SEQ ID NO: 9156 - DNA, 165 bp, homo sapiens; identical to SEQ ID NO: 7684

SEQ ID NO: 9157 - protein, 18 aa, homo sapiens
MWGAVQTLKSPHRSLHPE

SEQ ID NO: 9158 - DNA, 57 bp, homo sapiens; identical to SEQ ID NO: 7686

SEQ ID NO: 9159 - protein, 10 aa, homo sapiens
MRPVRVLKSP

SEQ ID NO: 9160 - DNA, 33 bp, homo sapiens; identical to SEQ ID NO: 7688

SEQ ID NO: 9161 - protein, 6 aa, homo sapiens
MVRLTR

SEQ ID NO: 9162 - DNA, 21 bp, homo sapiens
atggtcaggctgacccggtag

SEQ ID NO: 9163 - protein, 12 aa, homo sapiens
MSRNICVTEAET

SEQ ID NO: 9164 - DNA, 39 bp, homo sapiens
atgagcagaaacatttgtgtaactgaggcagaaacttag

SEQ ID NO: 9165 - protein, 10 aa, homo sapiens
MSLNSSQFLS

SEQ ID NO: 9166 - DNA, 33 bp, homo sapiens
atgtcactaaattcgagtcagtttttgtcttag

SEQ ID NO: 9167 - protein, 21 aa, homo sapiens
MKPNFHKFSCFKEKFNELHLN

SEQ ID NO: 9168 - DNA, 66 bp, homo sapiens
atgaaaccaaattttcataaattttcttgttttaaagaaaaatttaatgagctacatttaaactga

SEQ ID NO: 9169 - protein, 38 aa, homo sapiens; identical to SEQ ID NO: 7715

SEQ ID NO: 9170 - DNA, 117 bp, homo sapiens; identical to SEQ ID NO: 7716

SEQ ID NO: 9171 - protein, 47 aa, homo sapiens
MLSARGVALPDPRGQGLGFGGAAAHGAFGLPRTRVAPSSLCGGFARA

SEQ ID NO: 9172 - DNA, 144 bp, homo sapiens
atgttgtcggctcggggtgtggccctgcccgacccgcgaggccagggcttaggatttggaggtgctgcggcgcacggtgccttcggattgcctcgcacgcgcgtggcaccttcgagcctctgcgggggctttgcaagagcatga

SEQ ID NO: 9173 - protein, 127 aa, homo sapiens; identical to SEQ ID NO: 7717

SEQ ID NO: 9174 - DNA, 384 bp, homo sapiens; identical to SEQ ID NO: 7718

SEQ ID NO: 9175 - protein, 45 aa, homo sapiens; identical to SEQ ID NO: 7719

SEQ ID NO: 9176 - DNA, 138 bp, homo sapiens; identical to SEQ ID NO: 7720

SEQ ID NO: 9177 - protein, 25 aa, homo sapiens
MPGWILQLRGFSGKQRPLLSRDPGS

SEQ ID NO: 9178 - DNA, 78 bp, homo sapiens; identical to SEQ ID NO: 8658

SEQ ID NO: 9179 - protein, 65 aa, homo sapiens; identical to SEQ ID NO: 8659

SEQ ID NO: 9180 - DNA, 198 bp, homo sapiens; identical to SEQ ID NO: 8660

SEQ ID NO: 9181 - protein, 4 aa, homo sapiens
MAFP

SEQ ID NO: 9182 - DNA, 15 bp, homo sapiens
atggccttcccctga

SEQ ID NO: 9183 - protein, 38 aa, homo sapiens; identical to SEQ ID NO: 8663

SEQ ID NO: 9184 - DNA, 117 bp, homo sapiens; identical to SEQ ID NO: 8664

SEQ ID NO: 9185 - protein, 31 aa, homo sapiens
MSGPRLRPEAGSSAPLGPAGKPEAFPRPLAI

SEQ ID NO: 9186 - DNA, 96 bp, homo sapiens
atgagcggcccgcgcctgcgtcctgaggccggaagttcagccccactcgggcctgccgggaaaccggaagcctttccgaggcctctggccatctga

SEQ ID NO: 9187 - protein, 7 aa, homo sapiens
MEKPRLY

SEQ ID NO: 9188 - DNA, 24 bp, homo sapiens
atggagaaaccccgtctctactaa

SEQ ID NO: 9189 - protein, 24 aa, homo sapiens
MPVIPATREAEAGESLEPGRRRLR

SEQ ID NO: 9190 - DNA, 75 bp, homo sapiens
atgcctgtaattccagctactcgggaggctgaggcaggagagtcgcttgaacccgggaggcggaggttgcggtga

SEQ ID NO: 9191 - protein, 19 aa, homo sapiens
MLHKRWPASRVKEDSDTGA

SEQ ID NO: 9192 - DNA, 60 bp, homo sapiens
atgctacacaaaagatggccggcttctcgcgtgaaggaagattcggatacgggggcctga

SEQ ID NO: 9193 - protein, 31 aa, homo sapiens; identical to SEQ ID NO: 9185

SEQ ID NO: 9194 - DNA, 96 bp, homo sapiens; identical to SEQ ID NO: 9186

SEQ ID NO: 9195 - protein, 7 aa, homo sapiens
MEKPRLY

SEQ ID NO: 9196 - DNA, 24 bp, homo sapiens
atggagaaaccccgtctctactaa

SEQ ID NO: 9197 - protein, 24 aa, homo sapiens
MPVIPATREAEAGESLEPGRRRLR

SEQ ID NO: 9198 - DNA, 75 bp, homo sapiens; identical to SEQ ID NO: 9190

SEQ ID NO: 9199 - protein, 19 aa, homo sapiens
MLHKRWPASRVKEDSDTGA

SEQ ID NO: 9200 - DNA, 60 bp, homo sapiens; identical to SEQ ID NO: 9192

SEQ ID NO: 9201 - protein, 183 aa, homo sapiens
MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASLQRVRRPVAMVMPARRTPHVQAVQGPLGSPPKRGPLPTEEQRVYRRKELEEVSPETPVVPATTQRTLARPGPEPAPATGQLHPDPKS

SEQ ID NO: 9202 - DNA, 552 bp, homo sapiens
atggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgcgtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggcccggagcctgccccagccacaggtcagctgcaccctgaccccaagtcatga

SEQ ID NO: 9203 - protein, 8 aa, homo sapiens
MRCSSARA

SEQ ID NO: 9204 - DNA, 27 bp, homo sapiens
atgaggtgctcttccgcgagggcgtga

SEQ ID NO: 9205 - protein, 68 aa, homo sapiens
MCPASPTCRSCVPWRPCGHGAWSARPLPGATFTGTSPMKASPTSASTCTCRQRSCPPLCSACAAPSPW

SEQ ID NO: 9206 - DNA, 207 bp, homo sapiens
atgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgcgtgcgccgccccgtcgccatggtga

SEQ ID NO: 9207 - protein, 5 aa, homo sapiens
MMGGK

SEQ ID NO: 9208 - DNA, 18 bp, homo sapiens
atgatgggtggcaagtag

SEQ ID NO: 9209 - protein, 31 aa, homo sapiens [sequence omitted]

SEQ ID NO: 9210 - DNA, 96 bp, homo sapiens; identical to SEQ ID NO: 7882

SEQ ID NO: 9211 - protein, 66 aa, homo sapiens; identical to SEQ ID NO: 7883

SEQ ID NO: 9212 - DNA, 201 bp, homo sapiens; identical to SEQ ID NO: 7884

SEQ ID NO: 9213 - protein, 39 aa, homo sapiens [sequence omitted]

SEQ ID NO: 9214 - DNA, 120 bp, homo sapiens; identical to SEQ ID NO: 7886

SEQ ID NO: 9215 - protein, 25 aa, homo sapiens
MRGMRPRDRVVGGGGGRRSAPPSST

SEQ ID NO: 9216 - DNA, 78 bp, homo sapiens; identical to SEQ ID NO: 7888

SEQ ID NO: 9217 - protein, 77 aa, homo sapiens [sequence omitted]

SEQ ID NO: 9218 - DNA, 234 bp, homo sapiens
atggacgtgacctcgcagctaaaccttgaacgtgaagccgggatgggggaaaacacggagcggcagccggcggagcccgagagcgcgggcggcggcggcagtagccgagcccaggccggggtgccaagggaccagtgccggccccgggggaggacaagccgccgccttctttctgcaccgcgcggctctcagactcgccagccttccggccgcacacgcagactcttgccctga

SEQ ID NO: 9219 - protein, 70 aa, homo sapiens
MRLGFINGRIMSARFNVMGVLCCVCVCMYVCVLGGACASEHRGRRSEQREISLSMATSGTHLRSHLGQGS

SEQ ID NO: 9220 - DNA, 213 bp, homo sapiens
atgcgcctcggcttcattaacggcaggatcatgagcgcgcgttttaatgtgatgggagtgctgtgttgtgtgtgtgtgtgtatgtatgtatgtgtgttgggaggtgcttgcgctagtgagcaccgaggcaggcgctctgagcagagagagatcagtctttccatggccacgtctgggactcatctgcggagccatctaggccagggctcctag

SEQ ID NO: 9221 - protein, 37 aa, homo sapiens
MYVCWEVLALVSTEAGALSRERSVFPWPRLGLICGAI

SEQ ID NO: 9222 - DNA, 114 bp, homo sapiens
atgtatgtgtgttgggaggtgcttgcgctagtgagcaccgaggcaggcgctctgagcagagagagatcagtctttccatggccacgtctgggactcatctgcggagccatctag

SEQ ID NO: 9223 - protein, 8 aa, homo sapiens
MCVGRCLR

SEQ ID NO: 9224 - DNA, 27 bp, homo sapiens
atgtgtgttgggaggtgcttgcgctag

SEQ ID NO: 9225 - protein, 24 aa, homo sapiens
MYLIAKDFSTLFSYVFFNCKLLGF

SEQ ID NO: 9226 - DNA, 75 bp, homo sapiens; identical to SEQ ID NO: 8402

SEQ ID NO: 9227 - protein, 7 aa, homo sapiens
MDGINCC

SEQ ID NO: 9228 - DNA, 24 bp, homo sapiens
atggatggaattaattgctgttag

SEQ ID NO: 9229 - protein, 19 aa, homo sapiens
MELIAVRRLENSKYRFGRW

SEQ ID NO: 9230 - DNA, 60 bp, homo sapiens; identical to SEQ ID NO: 8406

SEQ ID NO: 9231 - protein, 18 aa, homo sapiens
MFYLFFPYFSLFQSYTWT

SEQ ID NO: 9232 - DNA, 57 bp, homo sapiens; identical to SEQ ID NO: 8408

SEQ ID NO: 9233 - protein, 39 aa, homo sapiens; identical to SEQ ID NO: 8225

SEQ ID NO: 9234 - DNA, 120 bp, homo sapiens; identical to SEQ ID NO: 8226

SEQ ID NO: 9235 - protein, 26 aa, homo sapiens
MLNSILIVRLKLRHHFILQSAVGLWP

SEQ ID NO: 9236 - DNA, 81 bp, homo sapiens; identical to SEQ ID NO: 96

SEQ ID NO: 9237 - protein, 32 aa, homo sapiens; identical to SEQ ID NO: 8229

SEQ ID NO: 9238 - DNA, 99 bp, homo sapiens; identical to SEQ ID NO: 8230

SEQ ID NO: 9239 - protein, 4 aa, homo sapiens
MCRE

SEQ ID NO: 9240 - DNA, 15 bp, homo sapiens
atgtgcagagagtaa

SEQ ID NO: 9241 - protein, 39 aa, homo sapiens
MELSGWGPEVCGRGTEVCGRGRWNVGGGVGHVLCGPLCT

SEQ ID NO: 9242 - DNA, 120 bp, homo sapiens
atggagctaagcgggtggggtcctgaggtatgtggaaggggcaccgaggtatgtgggagaggacgttggaacgtgggcgggggagttggacacgttctgtgtgggccgttatgtacttaa

SEQ ID NO: 9243 - protein, 73 aa, homo sapiens
MWKGHRGMWERTLERGRGSWTRSVWAVMYLRGRSGVARWLTPVIPTLWKAEASGSQGQGFKTSLAKMVKPRLY

SEQ ID NO: 9244 - DNA, 222 bp, homo sapiens
atgtggaaggggcaccgaggtatgtgggagaggacgttggaacgtgggcgggggagttggacacgttctgtgtgggccgttatgtacttaagaggcagatcgggcgtggcacggtggctcacgcccgtaatcccaacactttggaaggccgaggcgagtggatcacaaggtcaggggttcaagaccagcctggccaagatggtgaaacctcgtctctactaa

SEQ ID NO: 9245 - protein, 19 aa, homo sapiens
MGFTDTELSFGEQSGIGDR

SEQ ID NO: 9246 - DNA, 60 bp, homo sapiens
atgggatttacggacacagaactatcctttggggagcagagtggtattggggacaggtag

SEQ ID NO: 9247 - protein, 36 aa, homo sapiens [sequence omitted]

SEQ ID NO: 9248 - DNA, 111 bp, homo sapiens
atgcgcgacagccaagaggtgtgtgcggcagcagtgcacgaggggaggaagctatcccaggccgcggcagcacgtggaacttgggtcccgcagtcgcaggctgcgctctag

SEQ ID NO: 9249 - protein, 17 aa, homo sapiens
MANGWTGSRPGRRNPEL

SEQ ID NO: 9250 - DNA, 54 bp, homo sapiens; identical to SEQ ID NO: 3920

SEQ ID NO: 9251 - protein, 51 aa, homo sapiens; identical to SEQ ID NO: 8235

SEQ ID NO: 9252 - DNA, 156 bp, homo sapiens; identical to SEQ ID NO: 8236

SEQ ID NO: 9253 - protein, 6 aa, homo sapiens
MCFFVY

SEQ ID NO: 9254 - DNA, 21 bp, homo sapiens
atgtgcttctttgtttactaa

SEQ ID NO: 9255 - protein, 21 aa, homo sapiens
MLDGPVHCHGLFILRWLETDL

SEQ ID NO: 9256 - DNA, 66 bp, homo sapiens; identical to SEQ ID NO: 8240

SEQ ID NO: 9257 - protein, 37 aa, homo sapiens; identical to SEQ ID NO: 8177

SEQ ID NO: 9258 - DNA, 114 bp, homo sapiens; identical to SEQ ID NO: 8178

SEQ ID NO: 9259 - protein, 45 aa, homo sapiens; identical to SEQ ID NO: 8179

SEQ ID NO: 9260 - DNA, 138 bp, homo sapiens; identical to SEQ ID NO: 8180

SEQ ID NO: 9261 - protein, 19 aa, homo sapiens
MSIVLRMYLAIIKCLMPST

SEQ ID NO: 9262 - DNA, 60 bp, homo sapiens; identical to SEQ ID NO: 8182

SEQ ID NO: 9263 - protein, 10 aa, homo sapiens
MVGVQTTERV

SEQ ID NO: 9264 - DNA, 33 bp, homo sapiens; identical to SEQ ID NO: 8184

SEQ ID NO: 9265 - protein, 13 aa, homo sapiens
MLPQLMVHQLSLA

SEQ ID NO: 9266 - DNA, 42 bp, homo sapiens; identical to SEQ ID NO: 8146

SEQ ID NO: 9267 - protein, 18 aa, homo sapiens
MFQDPFKNIILNVIFSSH

SEQ ID NO: 9268 - DNA, 57 bp, homo sapiens; identical to SEQ ID NO: 8148

SEQ ID NO: 9269 - protein, 52 aa, homo sapiens [sequence omitted]

SEQ ID NO: 9270 - DNA, 159 bp, homo sapiens; identical to SEQ ID NO: 8150

SEQ ID NO: 9271 - protein, 17 aa, homo sapiens
MPNPNLFSAFATSLCKT

SEQ ID NO: 9272 - DNA, 54 bp, homo sapiens; identical to SEQ ID NO: 8152

SEQ ID NO: 9273 - protein, 50 aa, homo sapiens [sequence omitted]

SEQ ID NO: 9274 - DNA, 153 bp, homo sapiens; identical to SEQ ID NO: 38

SEQ ID NO: 9275 - protein, 48 aa, homo sapiens; identical to SEQ ID NO: 8163

SEQ ID NO: 9276 - DNA, 147 bp, homo sapiens; identical to SEQ ID NO: 8164

SEQ ID NO: 9277 - protein, 13 aa, homo sapiens
MGAGAGRIVAGRD

SEQ ID NO: 9278 - DNA, 42 bp, homo sapiens; identical to SEQ ID NO: 40

SEQ ID NO: 9279 - protein, 109 aa, homo sapiens; identical to SEQ ID NO: 8167

SEQ ID NO: 9280 - DNA, 330 bp, homo sapiens; identical to SEQ ID NO: 8168

SEQ ID NO: 9281 - protein, 5 aa, homo sapiens
MNQGF

SEQ ID NO: 9282 - DNA, 18 bp, homo sapiens
atgaaccaaggtttctga

SEQ ID NO: 9283 - protein, 93 aa, homo sapiens [sequence omitted]

SEQ ID NO: 9284 - DNA, 282 bp, homo sapiens; identical to SEQ ID NO: 6900

SEQ ID NO: 9285 - protein, 7 aa, homo sapiens
MAASWKG

SEQ ID NO: 9286 - DNA, 24 bp, homo sapiens
atggcagcatcatggaaggggtga

SEQ ID NO: 9287 - protein, 16 aa, homo sapiens
MGDPGRGTLPGRWPGL

SEQ ID NO: 9288 - DNA, 51 bp, homo sapiens; identical to SEQ ID NO: 6904

SEQ ID NO: 9289 - protein, 15 aa, homo sapiens
MSLASNALRSFNFLQ

SEQ ID NO: 9290 - DNA, 48 bp, homo sapiens; identical to SEQ ID NO: 8134

SEQ ID NO: 9291 - protein, 29 aa, homo sapiens
MPFGLSTFYSRFCVRGNGMYSSTYRFLKN

SEQ ID NO: 9292 - DNA, 90 bp, homo sapiens; identical to SEQ ID NO: 8136

SEQ ID NO: 9293 - protein, 10 aa, homo sapiens
MVCILQLTGF

SEQ ID NO: 9294 - DNA, 33 bp, homo sapiens
atggtatgtattcttcaacttaccggtttttaa

SEQ ID NO: 9295 - protein, 4 aa, homo sapiens
MLKF

SEQ ID NO: 9296 - DNA, 15 bp, homo sapiens
atgttaaaattttga

SEQ ID NO: 9297 - protein, 15 aa, homo sapiens
MSLASNALRSFNFLQ

SEQ ID NO: 9298 - DNA, 48 bp, homo sapiens; identical to SEQ ID NO: 8134

SEQ ID NO: 9299 - protein, 29 aa, homo sapiens
MPFGLSTFYSRFCVRGNGMYSSTYRFLKN

SEQ ID NO: 9300 - DNA, 90 bp, homo sapiens; identical to SEQ ID NO: 8136

SEQ ID NO: 9301 - protein, 10 aa, homo sapiens
MVCILQLTGF

SEQ ID NO: 9302 - DNA, 33 bp, homo sapiens; identical to SEQ ID NO: 9294

SEQ ID NO: 9303 - protein, 4 aa, homo sapiens
MLKF

SEQ ID NO: 9304 - DNA, 15 bp, homo sapiens
atgttaaaattttga

SEQ ID NO: 9305 - protein, 50 aa, homo sapiens [sequence omitted]

SEQ ID NO: 9306 - DNA, 153 bp, homo sapiens; identical to SEQ ID NO: 38

SEQ ID NO: 9307 - protein, 48 aa, homo sapiens; identical to SEQ ID NO: 8163

SEQ ID NO: 9308 - DNA, 147 bp, homo sapiens; identical to SEQ ID NO: 8164

SEQ ID NO: 9309 - protein, 13 aa, homo sapiens
MGAGAGRIVAGRD

SEQ ID NO: 9310 - DNA, 42 bp, homo sapiens; identical to SEQ ID NO: 40

SEQ ID NO: 9311 - protein, 109 aa, homo sapiens; identical to SEQ ID NO: 8167

SEQ ID NO: 9312 - DNA, 330 bp, homo sapiens; identical to SEQ ID NO: 8168

SEQ ID NO: 9313 - protein, 15 aa, homo sapiens
MSLASNALRSFNFLQ

SEQ ID NO: 9314 - DNA, 48 bp, homo sapiens; identical to SEQ ID NO: 8134

SEQ ID NO: 9315 - protein, 29 aa, homo sapiens
MPFGLSTFYSRFCVRGNGMYSSTYRFLKN

SEQ ID NO: 9316 - DNA, 90 bp, homo sapiens; identical to SEQ ID NO: 8136

SEQ ID NO: 9317 - protein, 10 aa, homo sapiens
MVCILQLTGF

SEQ ID NO: 9318 - DNA, 33 bp, homo sapiens; identical to SEQ ID NO: 9294

SEQ ID NO: 9319 - protein, 4 aa, homo sapiens
MLKF

SEQ ID NO: 9320 - DNA, 15 bp, homo sapiens
atgttaaaattttga

SEQ ID NO: 9321 - protein, 54 aa, homo sapiens; identical to SEQ ID NO: 3817

SEQ ID NO: 9322 - DNA, 165 bp, homo sapiens; identical to SEQ ID NO: 3818

SEQ ID NO: 9323 - protein, 69 aa, homo sapiens; identical to SEQ ID NO: 3819

SEQ ID NO: 9324 - DNA, 210 bp, homo sapiens; identical to SEQ ID NO: 3820

SEQ ID NO: 9325 - protein, 21 aa, homo sapiens
MSSVSFERYASLAKPHLDLDL

SEQ ID NO: 9326 - DNA, 66 bp, homo sapiens; identical to SEQ ID NO: 3822

SEQ ID NO: 9327 - protein, 106 aa, homo sapiens; identical to SEQ ID NO: 3823

SEQ ID NO: 9328 - DNA, 321 bp, homo sapiens; identical to SEQ ID NO: 3824

SEQ ID NO: 9329 - protein, 25 aa, homo sapiens
MAARGAAWRGGHVVRSSARASLSDL

SEQ ID NO: 9330 - DNA, 78 bp, homo sapiens; identical to SEQ ID NO: 3826

SEQ ID NO: 9331 - protein, 70 aa, homo sapiens [sequence omitted]

SEQ ID NO: 9332 - DNA, 213 bp, homo sapiens; identical to SEQ ID NO: 3828

SEQ ID NO: 9333 - protein, 80 aa, homo sapiens [sequence omitted]

SEQ ID NO: 9334 - DNA, 243 bp, homo sapiens; identical to SEQ ID NO: 3830

SEQ ID NO: 9335 - protein, 31 aa, homo sapiens; identical to SEQ ID NO: 3831

SEQ ID NO: 9336 - DNA, 96 bp, homo sapiens; identical to SEQ ID NO: 3832

SEQ ID NO: 9337 - protein, 13 aa, homo sapiens
MATVTLWRALLRH

SEQ ID NO: 9338 - DNA, 42 bp, homo sapiens; identical to SEQ ID NO: 3854

SEQ ID NO: 9339 - protein, 140 aa, homo sapiens; identical to SEQ ID NO: 3855

SEQ ID NO: 9340 - DNA, 423 bp, homo sapiens; identical to SEQ ID NO: 3856

SEQ ID NO: 9341 - protein, 67 aa, homo sapiens; identical to SEQ ID NO: 8209

SEQ ID NO: 9342 - DNA, 204 bp, homo sapiens; identical to SEQ ID NO: 8210

SEQ ID NO: 9343 - protein, 28 aa, homo sapiens
MLRTRFSPAPARVQGAGVGPLPSGGDCK

SEQ ID NO: 9344 - DNA, 87 bp, homo sapiens; identical to SEQ ID NO: 8212

SEQ ID NO: 9345 - protein, 27 aa, homo sapiens
MKIKDAKKPCKTGAGARQVGRAPLGPV

SEQ ID NO: 9346 - DNA, 84 bp, homo sapiens; identical to SEQ ID NO: 8218

SEQ ID NO: 9347 - protein, 51 aa, homo sapiens; identical to SEQ ID NO: 8219

SEQ ID NO: 9348 - DNA, 156 bp, homo sapiens; identical to SEQ ID NO: 8220

SEQ ID NO: 9349 - protein, 24 aa, homo sapiens
MGAEGPFEPRVRGFRPPHPPIHAW

SEQ ID NO: 9350 - DNA, 75 bp, homo sapiens; identical to SEQ ID NO: 8222

SEQ ID NO: 9351 - protein, 43 aa, homo sapiens; identical to SEQ ID NO: 8223

SEQ ID NO: 9352 - DNA, 132 bp, homo sapiens; identical to SEQ ID NO: 8224

SEQ ID NO: 9353 - protein, 74 aa, homo sapiens [sequence omitted]

SEQ ID NO: 9354 - DNA, 225 bp, homo sapiens
atgggacaaggtggtagtgagtgcgccatcctggcccggatgccggtggcacccgcaccggctccggccacggcctctgcctgggccgctgtcccaggcgcgcctttaattaaggactccagcttgggggaagagagaagggaaaatgccgactgcggtccgcccgtgggtaactggggctcggtggggttttcgctttggcggggtgggggttccgtttcctaa

SEQ ID NO: 9355 - protein, 43 aa, homo sapiens
MPTAVRPWVTGARWGFRFGGVGVPFPNSCAGRVGGGGLFSLGY

SEQ ID NO: 9356 - DNA, 132 bp, homo sapiens
atgccgactgcggtccgcccgtgggtaactggggctcggtggggttttcgctttggcggggtgggggttccgtttcctaattcctgtgcgggccgggtgggcgggggcgggcttttttccttgggctattaa

SEQ ID NO: 9357 - protein, 109 aa, homo sapiens
MCARGLDPFSGRFFSLLFPFWLRGRLRSHPAPERSSCALGHWVYVWRGHPERAARAGSPRSPPARGGPELGPARGFPSGWLGKKGALRWGSCDPVELTGWVGGDGAGGT

SEQ ID NO: 9358 - DNA, 330 bp, homo sapiens
atgtgcgctcgcggccttgatccatttagtggacgctttttctcacttctcttccccttctggctccgcgggagactgcgctcgcacccggccccggagcgctcgagctgcgcgctgggacactgggtatacgtgtggaggggacacccggagagggcggcccgtgcgggatccccgcgctctccacctgcgaggggcgggccggagctgggtcccgcgcgcggtttcccgagcgggtggctgggcaagaagggagcccttcgttggggcagctgtgatccggtagagttgactggttgggtgggaggggacggagcgggcgggacttga

SEQ ID NO: 9359 - protein, 38 aa, homo sapiens
MRGCTWREKRDSPPSWLLSHQPGNGGGGRRGLGAFLVL

SEQ ID NO: 9360 - DNA, 117 bp, homo sapiens
atgagggggtgcacgtggagggaaaaaagggactcccctccctcttggcttctatcccaccaacccgggaatggagggggagggaggcgtgggcttggcgcgtttttggtgctttga

SEQ ID NO: 9361 - protein, 17 aa, homo sapiens
MANGWTGSRPGRRNPEL

SEQ ID NO: 9362 - DNA, 54 bp, homo sapiens; identical to SEQ ID NO: 3920

SEQ ID NO: 9363 - protein, 51 aa, homo sapiens; identical to SEQ ID NO: 8235

SEQ ID NO: 9364 - DNA, 156 bp, homo sapiens; identical to SEQ ID NO: 8236

SEQ ID NO: 9365 - protein, 6 aa, homo sapiens
MCFFVY

SEQ ID NO: 9366 - DNA, 21 bp, homo sapiens
atgtgcttctttgtttactaa

SEQ ID NO: 9367 - protein, 21 aa, homo sapiens
MLDGPVHCHGLFILRWLETDL

SEQ ID NO: 9368 - DNA, 66 bp, homo sapiens; identical to SEQ ID NO: 8240

SEQ ID NO: 9369 - protein, 33 aa, homo sapiens; identical to SEQ ID NO: 2553

SEQ ID NO: 9370 - DNA, 102 bp, homo sapiens; identical to SEQ ID NO: 2554

SEQ ID NO: 9371 - protein, 36 aa, homo sapiens; identical to SEQ ID NO: 2555

SEQ ID NO: 9372 - DNA, 111 bp, homo sapiens; identical to SEQ ID NO: 2556

SEQ ID NO: 9373 - protein, 33 aa, homo sapiens; identical to SEQ ID NO: 2557

SEQ ID NO: 9374 - DNA, 102 bp, homo sapiens; identical to SEQ ID NO: 2558

SEQ ID NO: 9375 - protein, 84 aa, homo sapiens; identical to SEQ ID NO: 2559

SEQ ID NO: 9376 - DNA, 255 bp, homo sapiens; identical to SEQ ID NO: 2560

SEQ ID NO: 9377 - protein, 9 aa, homo sapiens
MDSLEKHIL

SEQ ID NO: 9378 - DNA, 30 bp, homo sapiens
atggacagccttgaaaagcacatcctttag

SEQ ID NO: 9379 - protein, 34 aa, homo sapiens
MGLALAHLEQDLGPGTPWRLRAWVNPICSAAQEN

SEQ ID NO: 9380 - DNA, 105 bp, homo sapiens
atgggccttgcccttgctcacttagaacaggacctgggtcctgggactccctggagactcagagcttgggtaaatcccatttgctctgcagctcaagagaactag

SEQ ID NO: 9381 - protein, 42 aa, homo sapiens
MRMSTPHHPTTLLSPLRSFQAFCGLHWALLAPGSRASDTLLK

SEQ ID NO: 9382 - DNA, 129 bp, homo sapiens
atgcgcatgtctactccacaccacccaaccactcttctatcaccacttcgctcatttcaggccttttgtgggctccactgggcactcctcgcaccaggttcaagagccagcgacaccttacttaaataa

SEQ ID NO: 9383 - protein, 14 aa, homo sapiens
MQSFVPLSPPPSLG

SEQ ID NO: 9384 - DNA, 45 bp, homo sapiens
atgcagtcttttgtccccctctccccaccgccttctctagggtaa

SEQ ID NO: 9385 - protein, 50 aa, homo sapiens [sequence omitted]

SEQ ID NO: 9386 - DNA, 153 bp, homo sapiens; identical to SEQ ID NO: 38

SEQ ID NO: 9387 - protein, 48 aa, homo sapiens; identical to SEQ ID NO: 8163

SEQ ID NO: 9388 - DNA, 147 bp, homo sapiens; identical to SEQ ID NO: 8164

SEQ ID NO: 9389 - protein, 13 aa, homo sapiens
MGAGAGRIVAGRD

SEQ ID NO: 9390 - DNA, 42 bp, homo sapiens; identical to SEQ ID NO: 40

SEQ ID NO: 9391 - protein, 109 aa, homo sapiens; identical to SEQ ID NO: 8167

SEQ ID NO: 9392 - DNA, 330 bp, homo sapiens; identical to SEQ ID NO: 8168

SEQ ID NO: 9393 - protein, 81 aa, homo sapiens [sequence omitted]

SEQ ID NO: 9394 - DNA, 246 bp, homo sapiens; identical to SEQ ID NO: 4046

SEQ ID NO: 9395 - protein, 4 aa, homo sapiens
MGVV

SEQ ID NO: 9396 - DNA, 15 bp, homo sapiens
atgggggtggtataa

SEQ ID NO: 9397 - protein, 30 aa, homo sapiens; identical to SEQ ID NO: 8269

SEQ ID NO: 9398 - DNA, 93 bp, homo sapiens; identical to SEQ ID NO: 8270

SEQ ID NO: 9399 - protein, 23 aa, homo sapiens
MGNQMINRKRSYIMMHYIMEQNI

SEQ ID NO: 9400 - DNA, 72 bp, homo sapiens; identical to SEQ ID NO: 8272

SEQ ID NO: 9401 - protein, 30 aa, homo sapiens
MEPAGEGPPRGAGSSGRGPGGRRWPGSSSV

SEQ ID NO: 9402 - DNA, 93 bp, homo sapiens
atggagccggcaggcgaggggccgccacgaggtgcagggtcgtctggacggggacccgggggcagacgatggccgggatcctcttccgtctaa

SEQ ID NO: 9403 - protein, 23 aa, homo sapiens
MAGILFRLTLRVLTGPWAEGMSA

SEQ ID NO: 9404 - DNA, 72 bp, homo sapiens; identical to SEQ ID NO: 8290

SEQ ID NO: 9405 - protein, 9 aa, homo sapiens
MLEKNPECI

SEQ ID NO: 9406 - DNA, 30 bp, homo sapiens; identical to SEQ ID NO: 8292

SEQ ID NO: 9407 - protein, 40 aa, homo sapiens; identical to SEQ ID NO: 8293

SEQ ID NO: 9408 - DNA, 123 bp, homo sapiens; identical to SEQ ID NO: 8294

SEQ ID NO: 9409 - protein, 15 aa, homo sapiens
MFWIHLTHSLSHVSP

SEQ ID NO: 9410 - DNA, 48 bp, homo sapiens
atgttctggatccatcttacccactccctctcccatgtctccccatag

SEQ ID NO: 9411 - protein, 58 aa, homo sapiens
MSPHSILTLEAVRSQRGKRRPPELPVSREGGPRHLARGTCCGLRWKLRSVEGRWRGSS

SEQ ID NO: 9412 - DNA, 177 bp, homo sapiens
atgtctccccatagcatcctcactttagaagcagtgaggtcccaaagaggaaaacggaggcctccggagctgccggtctctagggaaggcggaccccgacatctcgcccgagggacgtgctgcggcctgaggtggaagttacggagtgttgaggggaggtggagaggctcctcataa

SEQ ID NO: 9413 - protein, 14 aa, homo sapiens
MNRSSSTEQEGICE

SEQ ID NO: 9414 - DNA, 45 bp, homo sapiens
atgaataggagttcttctaccgagcaggaaggcatttgtgaataa

SEQ ID NO: 9415 - protein, 42 aa, homo sapiens
MQGLSDPISFIFSLFDRVRSPTPDFQRAPPPHVSCAVESVHC

SEQ ID NO: 9416 - DNA, 129 bp, homo sapiens
atgcagggcctctctgaccccatctcttttatcttttctctttttgatagagtcagatcccccacccccgacttccaaagagcccctccgccccatgtatcttgtgcagtggagtctgtgcattgctaa

SEQ ID NO: 9417 - protein, 41 aa, homo sapiens
MHLIFLPPSQVLAKGSHCGIYNHDNFPLTAPLKNKILAQED

SEQ ID NO: 9418 - DNA, 126 bp, homo sapiens
atgcatctaatctttcttcccccttctcaggttcttgctaaaggatcacactgtggaatctacaaccatgacaactttccacttactgctcccttgaaaaacaaaatattagcacaagaagattag

SEQ ID NO: 9419 - protein, 9 aa, homo sapiens
MTTFHLLLP

SEQ ID NO: 9420 - DNA, 30 bp, homo sapiens
atgacaactttccacttactgctcccttga

SEQ ID NO: 9421 - protein, 8 aa, homo sapiens
MLSLRSPG

SEQ ID NO: 9422 - DNA, 27 bp, homo sapiens
atgttgtctttgagaagccctggttga

SEQ ID NO: 9423 - protein, 18 aa, homo sapiens
MGILSNIKAAKIREFLLC

SEQ ID NO: 9424 - DNA, 57 bp, homo sapiens
atgggcattctctcgaatattaaagcggcaaaaatacgtgaatttcttttatgttaa

SEQ ID NO: 9425 - protein, 18 aa, homo sapiens
MGARDLQLFRRDPGPEAA

SEQ ID NO: 9426 - DNA, 57 bp, homo sapiens; identical to SEQ ID NO: 4230

SEQ ID NO: 9427 - protein, 39 aa, homo sapiens; identical to SEQ ID NO: 4231

SEQ ID NO: 9428 - DNA, 120 bp, homo sapiens; identical to SEQ ID NO: 4232

SEQ ID NO: 9429 - protein, 48 aa, homo sapiens; identical to SEQ ID NO: 8309

SEQ ID NO: 9430 - DNA, 147 bp, homo sapiens; identical to SEQ ID NO: 8310

SEQ ID NO: 9431 - protein, 15 aa, homo sapiens
MAPGWVLSAVTFREP

SEQ ID NO: 9432 - DNA, 48 bp, homo sapiens; identical to SEQ ID NO: 8312

SEQ ID NO: 9433 - protein, 77 aa, homo sapiens [sequence omitted]

SEQ ID NO: 9434 - DNA, 234 bp, homo sapiens; identical to SEQ ID NO: 298

SEQ ID NO: 9435 - protein, 7 aa, homo sapiens
MWGEGVC

SEQ ID NO: 9436 - DNA, 24 bp, homo sapiens
atgtggggggagggggtctgctag

SEQ ID NO: 9437 - protein, 130 aa, homo sapiens; identical to SEQ ID NO: 301

SEQ ID NO: 9438 - DNA, 393 bp, homo sapiens; identical to SEQ ID NO: 302

SEQ ID NO: 9439 - protein, 35 aa, homo sapiens; identical to SEQ ID NO: 303

SEQ ID NO: 9440 - DNA, 108 bp, homo sapiens; identical to SEQ ID NO: 304

SEQ ID NO: 9441 - protein, 38 aa, homo sapiens; identical to SEQ ID NO: 4343

SEQ ID NO: 9442 - DNA, 117 bp, homo sapiens; identical to SEQ ID NO: 4344

SEQ ID NO: 9443 - protein, 9 aa, homo sapiens
MDSLGYTDL

SEQ ID NO: 9444 - DNA, 30 bp, homo sapiens
atggactccttaggatacacagacctgtag

SEQ ID NO: 9445 - protein, 14 aa, homo sapiens
MFCRYRLLLMVSQV

SEQ ID NO: 9446 - DNA, 45 bp, homo sapiens
atgttttgtcgttacagactcctcctgatggtttcccaagtttga

SEQ ID NO: 9447 - protein, 22 aa, homo sapiens
MDCGIFFLDSLFCSPFLYPFRP

SEQ ID NO: 9448 - DNA, 69 bp, homo sapiens
atggattgtggaatattttttctagactccttattctgttctccttttctctacccatttagaccttag

SEQ ID NO: 9449 - protein, 68 aa, homo sapiens; identical to SEQ ID NO: 4353

SEQ ID NO: 9450 - DNA, 207 bp, homo sapiens; identical to SEQ ID NO: 4354

SEQ ID NO: 9451 - protein, 6 aa, homo sapiens
MPLTRS

SEQ ID NO: 9452 - DNA, 21 bp, homo sapiens
atgccgttgacgaggagctga

SEQ ID NO: 9453 - protein, 124 aa, homo sapiens [sequence omitted]

SEQ ID NO: 9454 - DNA, 375 bp, homo sapiens; identical to SEQ ID NO: 4358

SEQ ID NO: 9455 - protein, 4 aa, homo sapiens
MGQK

SEQ ID NO: 9456 - DNA, 15 bp, homo sapiens
atggggcaaaagtga

SEQ ID NO: 9457 - protein, 140 aa, homo sapiens [sequence omitted]

SEQ ID NO: 9458 - DNA, 423 bp, homo sapiens; identical to SEQ ID NO: 4386

SEQ ID NO: 9459 - protein, 55 aa, homo sapiens; identical to SEQ ID NO: 4387

SEQ ID NO: 9460 - DNA, 168 bp, homo sapiens; identical to SEQ ID NO: 4388

SEQ ID NO: 9461 - protein, 57 aa, homo sapiens; identical to SEQ ID NO: 4389

SEQ ID NO: 9462 - DNA, 174 bp, homo sapiens; identical to SEQ ID NO: 4390

SEQ ID NO: 9463 - protein, 43 aa, homo sapiens; identical to SEQ ID NO: 4391

SEQ ID NO: 9464 - DNA, 132 bp, homo sapiens; identical to SEQ ID NO: 4392

SEQ ID NO: 9465 - protein, 259 aa, homo sapiens [sequence omitted]

SEQ ID NO: 9466 - DNA, 780 bp, homo sapiens; identical to SEQ ID NO: 4394

SEQ ID NO: 9467 - protein, 58 aa, homo sapiens [sequence omitted]

SEQ ID NO: 9468 - DNA, 177 bp, homo sapiens; identical to SEQ ID NO: 4396

SEQ ID NO: 9469 - protein, 27 aa, homo sapiens
MSLGTGQRSRAGGGDMGIVSEPQDSSF

SEQ ID NO: 9470 - DNA, 84 bp, homo sapiens; identical to SEQ ID NO: 4398

SEQ ID NO: 9471 - protein, 4 aa, homo sapiens
MDLF

SEQ ID NO: 9472 - DNA, 15 bp, homo sapiens
atggatctgttttaa

SEQ ID NO: 9473 - protein, 10 aa, homo sapiens
MAPFPKSRCL

SEQ ID NO: 9474 - DNA, 33 bp, homo sapiens; identical to SEQ ID NO: 8386

SEQ ID NO: 9475 - protein, 48 aa, homo sapiens; identical to SEQ ID NO: 8387

SEQ ID NO: 9476 - DNA, 147 bp, homo sapiens; identical to SEQ ID NO: 8388

SEQ ID NO: 9477 - protein, 9 aa, homo sapiens
MGASKRVQL

SEQ ID NO: 9478 - DNA, 30 bp, homo sapiens; identical to SEQ ID NO: 8390

SEQ ID NO: 9479 - protein, 16 aa, homo sapiens
MVQVTNKNSISLLYSR

SEQ ID NO: 9480 - DNA, 51 bp, homo sapiens; identical to SEQ ID NO: 8392

SEQ ID NO: 9481 - protein, 10 aa, homo sapiens
MAPFPKSRCL

SEQ ID NO: 9482 - DNA, 33 bp, homo sapiens; identical to SEQ ID NO: 8386

SEQ ID NO: 9483 - protein, 48 aa, homo sapiens; identical to SEQ ID NO: 8387

SEQ ID NO: 9484 - DNA, 147 bp, homo sapiens; identical to SEQ ID NO: 8388

SEQ ID NO: 9485 - protein, 9 aa, homo sapiens
MGASKRVQL

SEQ ID NO: 9486 - DNA, 30 bp, homo sapiens; identical to SEQ ID NO: 8390

SEQ ID NO: 9487 - protein, 16 aa, homo sapiens
MVQVTNKNSISLLYSR

SEQ ID NO: 9488 - DNA, 51 bp, homo sapiens; identical to SEQ ID NO: 8392

SEQ ID NO: 9489 - protein, 24 aa, homo sapiens
MYLIAKDFSTLFSYVFFNCKLLGF

SEQ ID NO: 9490 - DNA, 75 bp, homo sapiens; identical to SEQ ID NO: 8402

SEQ ID NO: 9491 - protein, 7 aa, homo sapiens
MDGINCC

SEQ ID NO: 9492 - DNA, 24 bp, homo sapiens
atggatggaattaattgctgttag

SEQ ID NO: 9493 - protein, 19 aa, homo sapiens
MELIAVRRLENSKYRFGRW

SEQ ID NO: 9494 - DNA, 60 bp, homo sapiens; identical to SEQ ID NO: 8406

SEQ ID NO: 9495 - protein, 18 aa, homo sapiens
MFYLFFPYFSLFQSYTWT

SEQ ID NO: 9496 - DNA, 57 bp, homo sapiens; identical to SEQ ID NO: 8408

SEQ ID NO: 9497 - protein, 54 aa, homo sapiens; identical to SEQ ID NO: 8409

SEQ ID NO: 9498 - DNA, 165 bp, homo sapiens; identical to SEQ ID NO: 8410

SEQ ID NO: 9499 - protein, 10 aa, homo sapiens
MEPPTKAATT

SEQ ID NO: 9500 - DNA, 33 bp, homo sapiens; identical to SEQ ID NO: 8412

SEQ ID NO: 9501 - protein, 12 aa, homo sapiens
MSLRVAMTNADP

SEQ ID NO: 9502 - DNA, 39 bp, homo sapiens; identical to SEQ ID NO: 8414

SEQ ID NO: 9503 - protein, 85 aa, homo sapiens; identical to SEQ ID NO: 8415

SEQ ID NO: 9504 - DNA, 258 bp, homo sapiens; identical to SEQ ID NO: 8416

SEQ ID NO: 9505 - protein, 54 aa, homo sapiens; identical to SEQ ID NO: 8409

SEQ ID NO: 9506 - DNA, 165 bp, homo sapiens; identical to SEQ ID NO: 8410

SEQ ID NO: 9507 - protein, 10 aa, homo sapiens
MEPPTKAATT

SEQ ID NO: 9508 - DNA, 33 bp, homo sapiens; identical to SEQ ID NO: 8412

SEQ ID NO: 9509 - protein, 12 aa, homo sapiens
MSLRVAMTNADP

SEQ ID NO: 9510 - DNA, 39 bp, homo sapiens; identical to SEQ ID NO: 8414

SEQ ID NO: 9511 - protein, 85 aa, homo sapiens; identical to SEQ ID NO: 8415

SEQ ID NO: 9512 - DNA, 258 bp, homo sapiens; identical to SEQ ID NO: 8416

SEQ ID NO: 9513 - protein, 54 aa, homo sapiens; identical to SEQ ID NO: 337

SEQ ID NO: 9514 - DNA, 165 bp, homo sapiens; identical to SEQ ID NO: 338

SEQ ID NO: 9515 - protein, 146 aa, homo sapiens; identical to SEQ ID NO: 339

SEQ ID NO: 9516 - DNA, 441 bp, homo sapiens; identical to SEQ ID NO: 340

SEQ ID NO: 9517 - protein, 83 aa, homo sapiens; identical to SEQ ID NO: 341

SEQ ID NO: 9518 - DNA, 252 bp, homo sapiens; identical to SEQ ID NO: 342

SEQ ID NO: 9519 - protein, 8 aa, homo sapiens
MGTESADL

SEQ ID NO: 9520 - DNA, 27 bp, homo sapiens
atgggcaccgagtcggcggatctctga

SEQ ID NO: 9521 - protein, 54 aa, homo sapiens; identical to SEQ ID NO: 337

SEQ ID NO: 9522 - DNA, 165 bp, homo sapiens; identical to SEQ ID NO: 338

SEQ ID NO: 9523 - protein, 146 aa, homo sapiens; identical to SEQ ID NO: 339

SEQ ID NO: 9524 - DNA, 441 bp, homo sapiens; identical to SEQ ID NO: 340

SEQ ID NO: 9525 - protein, 83 aa, homo sapiens; identical to SEQ ID NO: 341

SEQ ID NO: 9526 - DNA, 252 bp, homo sapiens; identical to SEQ ID NO: 342

SEQ ID NO: 9527 - protein, 8 aa, homo sapiens
MGTESADL

SEQ ID NO: 9528 - DNA, 27 bp, homo sapiens
atgggcaccgagtcggcggatctctga

SEQ ID NO: 9529 - protein, 79 aa, homo sapiens [sequence omitted]

SEQ ID NO: 9530 - DNA, 240 bp, homo sapiens; identical to SEQ ID NO: 4596

SEQ ID NO: 9531 - protein, 10 aa, homo sapiens
MRPSWGGLGS

SEQ ID NO: 9532 - DNA, 33 bp, homo sapiens; identical to SEQ ID NO: 4598

SEQ ID NO: 9533 - protein, 38 aa, homo sapiens; identical to SEQ ID NO: 4599

SEQ ID NO: 9534 - DNA, 117 bp, homo sapiens; identical to SEQ ID NO: 4600

SEQ ID NO: 9535 - protein, 32 aa, homo sapiens; identical to SEQ ID NO: 8431

SEQ ID NO: 9536 - DNA, 99 bp, homo sapiens; identical to SEQ ID NO: 8432

SEQ ID NO: 9537 - protein, 19 aa, homo sapiens
MSTKNFRVSDGDWICPDKK

SEQ ID NO: 9538 - DNA, 60 bp, homo sapiens; identical to SEQ ID NO: 4602

SEQ ID NO: 9539 - protein, 166 aa, homo sapiens [sequence omitted]

SEQ ID NO: 9540 - DNA, 501 bp, homo sapiens; identical to SEQ ID NO: 4604

SEQ ID NO: 9541 - protein, 59 aa, homo sapiens; identical to SEQ ID NO: 4605

SEQ ID NO: 9542 - DNA, 180 bp, homo sapiens; identical to SEQ ID NO: 4606

SEQ ID NO: 9543 - protein, 9 aa, homo sapiens
MPAAEKHVC

SEQ ID NO: 9544 - DNA, 30 bp, homo sapiens; identical to SEQ ID NO: 4608

SEQ ID NO: 9545 - protein, 24 aa, homo sapiens
MYLIAKDFSTLFSYVFFNCKLLGF

SEQ ID NO: 9546 - DNA, 75 bp, homo sapiens; identical to SEQ ID NO: 8402

SEQ ID NO: 9547 - protein, 7 aa, homo sapiens
MDGINCC

SEQ ID NO: 9548 - DNA, 24 bp, homo sapiens
atggatggaattaattgctgttag

SEQ ID NO: 9549 - protein, 19 aa, homo sapiens
MELIAVRRLENSKYRFGRW

SEQ ID NO: 9550 - DNA, 60 bp, homo sapiens; identical to SEQ ID NO: 8406

SEQ ID NO: 9551 - protein, 18 aa, homo sapiens
MFYLFFPYFSLFQSYTWT

SEQ ID NO: 9552 - DNA, 57 bp, homo sapiens; identical to SEQ ID NO: 8408

SEQ ID NO: 9553 - protein, 74 aa, homo sapiens [sequence omitted]

SEQ ID NO: 9554 - DNA, 225 bp, homo sapiens; identical to SEQ ID NO: 9354

SEQ ID NO: 9555 - protein, 43 aa, homo sapiens; identical to SEQ ID NO: 9355

SEQ ID NO: 9556 - DNA, 132 bp, homo sapiens; identical to SEQ ID NO: 9356

SEQ ID NO: 9557 - protein, 109 aa, homo sapiens; identical to SEQ ID NO: 9357

SEQ ID NO: 9558 - DNA, 330 bp, homo sapiens; identical to SEQ ID NO: 9358

SEQ ID NO: 9559 - protein, 38 aa, homo sapiens; identical to SEQ ID NO: 9359

SEQ ID NO: 9560 - DNA, 117 bp, homo sapiens; identical to SEQ ID NO: 9360

SEQ ID NO: 9561 - protein, 4 aa, homo sapiens
MGGF

SEQ ID NO: 9562 - DNA, 15 bp, homo sapiens
atgggcgggttctga

SEQ ID NO: 9563 - protein, 6 aa, homo sapiens
MWPQGE

SEQ ID NO: 9564 - DNA, 21 bp, homo sapiens
atgtggccccagggcgagtga

SEQ ID NO: 9565 - protein, 4 aa, homo sapiens
MGCP

SEQ ID NO: 9566 - DNA, 15 bp, homo sapiens
atggggtgcccctga

SEQ ID NO: 9567 - protein, 35 aa, homo sapiens [sequence omitted]

SEQ ID NO: 9568 - DNA, 108 bp, homo sapiens; identical to SEQ ID NO: 8464

SEQ ID NO: 9569 - protein, 72 aa, homo sapiens; identical to SEQ ID NO: 4687

SEQ ID NO: 9570 - DNA, 219 bp, homo sapiens; identical to SEQ ID NO: 4688

SEQ ID NO: 9571 - protein, 32 aa, homo sapiens; identical to SEQ ID NO: 4695

SEQ ID NO: 9572 - DNA, 99 bp, homo sapiens; identical to SEQ ID NO: 4696

SEQ ID NO: 9573 - protein, 15 aa, homo sapiens
MDLCGCVPNGRSFVP

SEQ ID NO: 9574 - DNA, 48 bp, homo sapiens; identical to SEQ ID NO: 8470

SEQ ID NO: 9575 - protein, 15 aa, homo sapiens
MCSQWPVFCSLTDAT

SEQ ID NO: 9576 - DNA, 48 bp, homo sapiens; identical to SEQ ID NO: 8472

SEQ ID NO: 9577 - protein, 14 aa, homo sapiens
MRRKGAWGSGLSRT

SEQ ID NO: 9578 - DNA, 45 bp, homo sapiens
atgaggagaaaaggtgcgtgggggagtggcctttccagaacctag

SEQ ID NO: 9579 - protein, 13 aa, homo sapiens
MEIISPNLGAQQI

SEQ ID NO: 9580 - DNA, 42 bp, homo sapiens
atggaaatcatttcccccaacttgggcgcgcagcaaatttga

SEQ ID NO: 9581 - protein, 4 aa, homo sapiens
MRDD

SEQ ID NO: 9582 - DNA, 15 bp, homo sapiens
atgagagacgattaa

SEQ ID NO: 9583 - protein, 32 aa, homo sapiens
MGWGELYEAPRTPDLSAAKGRLGHPSCCPGSF

SEQ ID NO: 9584 - DNA, 99 bp, homo sapiens
atggggtggggggaactgtacgaggcacctcggacacccgatttatccgctgctaagggacgtttggggcacccctcgtgttgtccgggaagcttttag

SEQ ID NO: 9585 - protein, 94 aa, homo sapiens
MSKPPHRPEFPSSRFLSCSFMHSNKDTLRSEGEGPGPDIQPRGPWSAIPGQLYTLPSPNPGSFCLAAGFSSSTPSPNELCLACPQCLPKQNMRV

SEQ ID NO: 9586 - DNA, 285 bp, homo sapiens
atgtcaaagccacctcatcgtcctgaatttcccagttcccggtttctcagctgttctttcatgcattcaaataaagacacactccggtctgaaggggagggccccgggcctgatatccagccccgtggaccatggtcggccattcctggccaactgtacactctccccagcccaaatccggggagcttctgccttgcagctggattcagctctagcaccccttctccaaatgagctttgccttgcctgcccgcaatgtctcccgaaacaaaatatgagggtgtga

SEQ ID NO: 9587 - protein, 27 aa, homo sapiens
MVGHSWPTVHSPQPKSGELLPCSWIQL

SEQ ID NO: 9588 - DNA, 84 bp, homo sapiens
atggtcggccattcctggccaactgtacactctccccagcccaaatccggggagcttctgccttgcagctggattcagctctag

SEQ ID NO: 9589 - protein, 15 aa, homo sapiens
MSFALPARNVSRNKI

SEQ ID NO: 9590 - DNA, 48 bp, homo sapiens
atgagctttgccttgcctgcccgcaatgtctcccgaaacaaaatatga

SEQ ID NO: 9591 - protein, 46 aa, homo sapiens [sequence omitted]

SEQ ID NO: 9592 - DNA, 141 bp, homo sapiens
atgtctcccgaaacaaaatatgagggtgtgatccatgcccatctctcagatcagggacttcaaattagggtggttaagccccctcctgccctctctccctcctccttgttttcccttctcgtttaccccacccaattttaa

SEQ ID NO: 9593 - protein, 36 aa, homo sapiens; identical to SEQ ID NO: 8489

SEQ ID NO: 9594 - DNA, 111 bp, homo sapiens; identical to SEQ ID NO: 8490

SEQ ID NO: 9595 - protein, 27 aa, homo sapiens
MSLPPSRSKNLLEVSYLYCFLLFSHPS

SEQ ID NO: 9596 - DNA, 84 bp, homo sapiens; identical to SEQ ID NO: 8492

SEQ ID NO: 9597 - protein, 17 aa, homo sapiens
MPPPPNIVLSLSGSCVI

SEQ ID NO: 9598 - DNA, 54 bp, homo sapiens; identical to SEQ ID NO: 8494

SEQ ID NO: 9599 - protein, 22 aa, homo sapiens
MLYLLHVASLMEKKKPNKFPES

SEQ ID NO: 9600 - DNA, 69 bp, homo sapiens; identical to SEQ ID NO: 8496

SEQ ID NO: 9601 - protein, 24 aa, homo sapiens
MYLIAKDFSTLFSYVFFNCKLLGF

SEQ ID NO: 9602 - DNA, 75 bp, homo sapiens; identical to SEQ ID NO: 8402

SEQ ID NO: 9603 - protein, 7 aa, homo sapiens
MDGINCC

SEQ ID NO: 9604 - DNA, 24 bp, homo sapiens
atggatggaattaattgctgttag

SEQ ID NO: 9605 - protein, 19 aa, homo sapiens
MELIAVRRLENSKYRFGRW

SEQ ID NO: 9606 - DNA, 60 bp, homo sapiens; identical to SEQ ID NO: 8406

SEQ ID NO: 9607 - protein, 18 aa, homo sapiens
MFYLFFPYFSLFQSYTWT

SEQ ID NO: 9608 - DNA, 57 bp, homo sapiens; identical to SEQ ID NO: 8408

SEQ ID NO: 9609 - protein, 24 aa, homo sapiens
MYLIAKDFSTLFSYVFFNCKLLGF

SEQ ID NO: 9610 - DNA, 75 bp, homo sapiens; identical to SEQ ID NO: 8402

SEQ ID NO: 9611 - protein, 7 aa, homo sapiens
MDGINCC

SEQ ID NO: 9612 - DNA, 24 bp, homo sapiens
atggatggaattaattgctgttag

SEQ ID NO: 9613 - protein, 19 aa, homo sapiens
MELIAVRRLENSKYRFGRW

SEQ ID NO: 9614 - DNA, 60 bp, homo sapiens; identical to SEQ ID NO: 8406

SEQ ID NO: 9615 - protein, 18 aa, homo sapiens
MFYLFFPYFSLFQSYTWT

SEQ ID NO: 9616 - DNA, 57 bp, homo sapiens; identical to SEQ ID NO: 8408

SEQ ID NO: 9617 - protein, 74 aa, homo sapiens [sequence omitted]

SEQ ID NO: 9618 - DNA, 225 bp, homo sapiens; identical to SEQ ID NO: 9354

SEQ ID NO: 9619 - protein, 43 aa, homo sapiens; identical to SEQ ID NO: 9355

SEQ ID NO: 9620 - DNA, 132 bp, homo sapiens; identical to SEQ ID NO: 9356

SEQ ID NO: 9621 - protein, 109 aa, homo sapiens; identical to SEQ ID NO: 9357

SEQ ID NO: 9622 - DNA, 330 bp, homo sapiens; identical to SEQ ID NO: 9358

SEQ ID NO: 9623 - protein, 38 aa, homo sapiens; identical to SEQ ID NO: 9359

SEQ ID NO: 9624 - DNA, 117 bp, homo sapiens; identical to SEQ ID NO: 9360

SEQ ID NO: 9625 - protein, 87 aa, homo sapiens; identical to SEQ ID NO: 441

SEQ ID NO: 9626 - DNA, 264 bp, homo sapiens; identical to SEQ ID NO: 442

SEQ ID NO: 9627 - protein, 85 aa, homo sapiens [sequence omitted]

SEQ ID NO: 9628 - DNA, 258 bp, homo sapiens; identical to SEQ ID NO: 444

SEQ ID NO: 9629 - protein, 96 aa, homo sapiens; identical to SEQ ID NO: 445

SEQ ID NO: 9630 - DNA, 291 bp, homo sapiens; identical to SEQ ID NO: 446

SEQ ID NO: 9631 - protein, 14 aa, homo sapiens
MTGVGATSLVRFFT

SEQ ID NO: 9632 - DNA, 45 bp, homo sapiens; identical to SEQ ID NO: 448

SEQ ID NO: 9633 - protein, 87 aa, homo sapiens; identical to SEQ ID NO: 441

SEQ ID NO: 9634 - DNA, 264 bp, homo sapiens; identical to SEQ ID NO: 442

SEQ ID NO: 9635 - protein, 85 aa, homo sapiens [sequence omitted]

SEQ ID NO: 9636 - DNA, 258 bp, homo sapiens; identical to SEQ ID NO: 444

SEQ ID NO: 9637 - protein, 96 aa, homo sapiens; identical to SEQ ID NO: 445

SEQ ID NO: 9638 - DNA, 291 bp, homo sapiens; identical to SEQ ID NO: 446

SEQ ID NO: 9639 - protein, 14 aa, homo sapiens
MTGVGATSLVRFFT

SEQ ID NO: 9640 - DNA, 45 bp, homo sapiens; identical to SEQ ID NO: 448

SEQ ID NO: 9641 - protein, 18 aa, homo sapiens
MGARDLQLFRRDPGPEAA

SEQ ID NO: 9642 - DNA, 57 bp, homo sapiens; identical to SEQ ID NO: 4230

SEQ ID NO: 9643 - protein, 39 aa, homo sapiens; identical to SEQ ID NO: 4231

SEQ ID NO: 9644 - DNA, 120 bp, homo sapiens; identical to SEQ ID NO: 4232

SEQ ID NO: 9645 - protein, 48 aa, homo sapiens; identical to SEQ ID NO: 8309

SEQ ID NO: 9646 - DNA, 147 bp, homo sapiens; identical to SEQ ID NO: 8310

SEQ ID NO: 9647 - protein, 15 aa, homo sapiens
MAPGWVLSAVTFREP

SEQ ID NO: 9648 - DNA, 48 bp, homo sapiens; identical to SEQ ID NO: 8312

SEQ ID NO: 9649 - protein, 13 aa, homo sapiens
MGQRRCRRRIWSR

SEQ ID NO: 9650 - DNA, 42 bp, homo sapiens
atgggtcaaaggcggtgcaggaggaggatctggtccagataa

SEQ ID NO: 9651 - protein, 39 aa, homo sapiens
MNQSSSPHYPDLCLPTSPVFTLAKSLYIQTKESVTPSQH

SEQ ID NO: 9652 - DNA, 120 bp, homo sapiens
atgaaccagtcttcttcccctcactacccagatctctgcctgccaacaagccccgtgttcaccctggcaaagagtctttacattcagaccaaggagagtgtgactccttctcagcactag

SEQ ID NO: 9653 - protein, 78 aa, homo sapiens
MPRRLDAWGGATYEKLPPCFGSEQAPGRKYFKQQGASAPTHPACMLVLRTAFYGACTEPWACLNTTRKRPEQQQHAKG

SEQ ID NO: 9654 - DNA, 237 bp, homo sapiens
atgcccagaaggctagatgcgtggggaggagccacatacgagaaactgcctccctgcttcgggtcagaacaagccccaggaagaaagtatttcaaacaacaaggtgcatctgccccaacccatccagcctgcatgttggtgctgagaacagccttttatggggcttgcactgagccatgggcatgtctgaacacaacaaggaagaggccagagcagcaacagcacgcaaagggttga

SEQ ID NO: 9655 - protein, 42 aa, homo sapiens
MRGEEPHTRNCLPASGQNKPQEESISNNKVHLPQPIQPACWC

SEQ ID NO: 9656 - DNA, 129 bp, homo sapiens
atgcgtggggaggagccacatacgagaaactgcctccctgcttcgggtcagaacaagccccaggaagaaagtatttcaaacaacaaggtgcatctgccccaacccatccagcctgcatgttggtgctga

SEQ ID NO: 9657 - protein, 24 aa, homo sapiens
MYLIAKDFSTLFSYVFFNCKLLGF

SEQ ID NO: 9658 - DNA, 75 bp, homo sapiens; identical to SEQ ID NO: 8402

SEQ ID NO: 9659 - protein, 7 aa, homo sapiens
MDGINCC

SEQ ID NO: 9660 - DNA, 24 bp, homo sapiens
atggatggaattaattgctgttag

SEQ ID NO: 9661 - protein, 19 aa, homo sapiens
MELIAVRRLENSKYRFGRW

SEQ ID NO: 9662 - DNA, 60 bp, homo sapiens; identical to SEQ ID NO: 8406

SEQ ID NO: 9663 - protein, 18 aa, homo sapiens
MFYLFFPYFSLFQSYTWT

SEQ ID NO: 9664 - DNA, 57 bp, homo sapiens; identical to SEQ ID NO: 8408

SEQ ID NO: 9665 - protein, 74 aa, homo sapiens [sequence omitted]

SEQ ID NO: 9666 - DNA, 225 bp, homo sapiens; identical to SEQ ID NO: 9354

SEQ ID NO: 9667 - protein, 43 aa, homo sapiens; identical to SEQ ID NO: 9355

SEQ ID NO: 9668 - DNA, 132 bp, homo sapiens; identical to SEQ ID NO: 9356

SEQ ID NO: 9669 - protein, 109 aa, homo sapiens; identical to SEQ ID NO: 9357

SEQ ID NO: 9670 - DNA, 330 bp, homo sapiens; identical to SEQ ID NO: 9358

SEQ ID NO: 9671 - protein, 38 aa, homo sapiens; identical to SEQ ID NO: 9359

SEQ ID NO: 9672 - DNA, 117 bp, homo sapiens; identical to SEQ ID NO: 9360

SEQ ID NO: 9673 - protein, 192 aa, homo sapiens [sequence omitted]

SEQ ID NO: 9674 - DNA, 579 bp, homo sapiens; identical to SEQ ID NO: 4946

SEQ ID NO: 9675 - protein, 29 aa, homo sapiens
MDSDWPLEAPCPDGVACHHCEVRLGRTCT

SEQ ID NO: 9676 - DNA, 90 bp, homo sapiens; identical to SEQ ID NO: 4948

SEQ ID NO: 9677 - protein, 77 aa, homo sapiens; identical to SEQ ID NO: 4949

SEQ ID NO: 9678 - DNA, 234 bp, homo sapiens; identical to SEQ ID NO: 4950

SEQ ID NO: 9679 - protein, 7 aa, homo sapiens
MSTQFTI

SEQ ID NO: 9680 - DNA, 24 bp, homo sapiens
atgtcaacacagttcacaatatag

SEQ ID NO: 9681 - protein, 15 aa, homo sapiens
MFWIHLTHSLSHVSP

SEQ ID NO: 9682 - DNA, 48 bp, homo sapiens; identical to SEQ ID NO: 9410

SEQ ID NO: 9683 - protein, 58 aa, homo sapiens; identical to SEQ ID NO: 9411

SEQ ID NO: 9684 - DNA, 177 bp, homo sapiens; identical to SEQ ID NO: 9412

SEQ ID NO: 9685 - protein, 14 aa, homo sapiens
MNRSSSTEQEGICE

SEQ ID NO: 9686 - DNA, 45 bp, homo sapiens; identical to SEQ ID NO: 9414

SEQ ID NO: 9687 - protein, 42 aa, homo sapiens; identical to SEQ ID NO: 9415

SEQ ID NO: 9688 - DNA, 129 bp, homo sapiens; identical to SEQ ID NO: 9416

SEQ ID NO: 9689 - protein, 10 aa, homo sapiens
MGGIRGGGQD

SEQ ID NO: 9690 - DNA, 33 bp, homo sapiens; identical to SEQ ID NO: 8554

SEQ ID NO: 9691 - protein, 127 aa, homo sapiens; identical to SEQ ID NO: 5033

SEQ ID NO: 9692 - DNA, 384 bp, homo sapiens; identical to SEQ ID NO: 5034

SEQ ID NO: 9693 - protein, 105 aa, homo sapiens; identical to SEQ ID NO: 5035

SEQ ID NO: 9694 - DNA, 318 bp, homo sapiens; identical to SEQ ID NO: 5036

SEQ ID NO: 9695 - protein, 94 aa, homo sapiens; identical to SEQ ID NO: 5037

SEQ ID NO: 9696 - DNA, 285 bp, homo sapiens; identical to SEQ ID NO: 5038

SEQ ID NO: 9697 - protein, 139 aa, homo sapiens; identical to SEQ ID NO: 5049

SEQ ID NO: 9698 - DNA, 420 bp, homo sapiens; identical to SEQ ID NO: 5050

SEQ ID NO: 9699 - protein, 23 aa, homo sapiens
MLCKGGGERSRGRRCRGLMQPKG

SEQ ID NO: 9700 - DNA, 72 bp, homo sapiens; identical to SEQ ID NO: 5052

SEQ ID NO: 9701 - protein, 40 aa, homo sapiens; identical to SEQ ID NO: 5053

SEQ ID NO: 9702 - DNA, 123 bp, homo sapiens; identical to SEQ ID NO: 5054

SEQ ID NO: 9703 - protein, 82 aa, homo sapiens [sequence omitted]

SEQ ID NO: 9704 - DNA, 249 bp, homo sapiens; identical to SEQ ID NO: 5056

SEQ ID NO: 9705 - protein, 17 aa, homo sapiens
MANGWTGSRPGRRNPEL

SEQ ID NO: 9706 - DNA, 54 bp, homo sapiens; identical to SEQ ID NO: 3920

SEQ ID NO: 9707 - protein, 51 aa, homo sapiens; identical to SEQ ID NO: 8235

SEQ ID NO: 9708 - DNA, 156 bp, homo sapiens; identical to SEQ ID NO: 8236

SEQ ID NO: 9709 - protein, 6 aa, homo sapiens
MCFFVY

SEQ ID NO: 9710 - DNA, 21 bp, homo sapiens
atgtgcttctttgtttactaa

SEQ ID NO: 9711 - protein, 21 aa, homo sapiens
MLDGPVHCHGLFILRWLETDL

SEQ ID NO: 9712 - DNA, 66 bp, homo sapiens; identical to SEQ ID NO: 8240

SEQ ID NO: 9713 - protein, 161 aa, homo sapiens; identical to SEQ ID NO: 5211

SEQ ID NO: 9714 - DNA, 486 bp, homo sapiens; identical to SEQ ID NO: 5212

SEQ ID NO: 9715 - protein, 156 aa, homo sapiens; identical to SEQ ID NO: 5213

SEQ ID NO: 9716 - DNA, 471 bp, homo sapiens; identical to SEQ ID NO: 5214

SEQ ID NO: 9717 - protein, 21 aa, homo sapiens
MATGHWPQAAGLHPCLWAQPQ

SEQ ID NO: 9718 - DNA, 66 bp, homo sapiens; identical to SEQ ID NO: 5216

SEQ ID NO: 9719 - protein, 17 aa, homo sapiens
MEGGQGWTALGPRPWLS

SEQ ID NO: 9720 - DNA, 54 bp, homo sapiens; identical to SEQ ID NO: 8600

SEQ ID NO: 9721 - protein, 15 aa, homo sapiens
MEAEVDKLELMVSAK

SEQ ID NO: 9722 - DNA, 48 bp, homo sapiens; identical to SEQ ID NO: 5326

SEQ ID NO: 9723 - protein, 43 aa, homo sapiens; identical to SEQ ID NO: 5327

SEQ ID NO: 9724 - DNA, 132 bp, homo sapiens; identical to SEQ ID NO: 5328

SEQ ID NO: 9725 - protein, 46 aa, homo sapiens; identical to SEQ ID NO: 8605

SEQ ID NO: 9726 - DNA, 141 bp, homo sapiens; identical to SEQ ID NO: 8606

SEQ ID NO: 9727 - protein, 65 aa, homo sapiens; identical to SEQ ID NO: 8607

SEQ ID NO: 9728 - DNA, 198 bp, homo sapiens; identical to SEQ ID NO: 8608

SEQ ID NO: 9729 - protein, 27 aa, homo sapiens
MGFQSDVCSCLLPRTSRGYFRSNYLVY

SEQ ID NO: 9730 - DNA, 84 bp, homo sapiens; identical to SEQ ID NO: 8610

SEQ ID NO: 9731 - protein, 54 aa, homo sapiens [sequence omitted]

SEQ ID NO: 9732 - DNA, 165 bp, homo sapiens; identical to SEQ ID NO: 8612

SEQ ID NO: 9733 - protein, 29 aa, homo sapiens
MHRICNIKKKVFVREMRKCVTVFLFFLKA

SEQ ID NO: 9734 - DNA, 90 bp, homo sapiens; identical to SEQ ID NO: 8614

SEQ ID NO: 9735 - protein, 23 aa, homo sapiens
MCYSIFIFFKSVVGQYFPEKSMK

SEQ ID NO: 9736 - DNA, 72 bp, homo sapiens; identical to SEQ ID NO: 8616

SEQ ID NO: 9737 - protein, 12 aa, homo sapiens
MEKLDVLVYILS

SEQ ID NO: 9738 - DNA, 39 bp, homo sapiens
atggaaaaattagatgtcttggtgtacattttatcctaa

SEQ ID NO: 9739 - protein, 37 aa, homo sapiens
MSWCTFYPNRFSSFYNHKIGSGKTVDVFPKYLFLTYI

SEQ ID NO: 9740 - DNA, 114 bp, homo sapiens
atgtcttggtgtacattttatcctaatagattctcttctttctataatcataaaataggttctgggaagactgttgatgtttttccaaaatacctttttttgacatatatttga

SEQ ID NO: 9741 - protein, 8 aa, homo sapiens
MFFQNTFF

SEQ ID NO: 9742 - DNA, 27 bp, homo sapiens
atgtttttccaaaatacctttttttga

SEQ ID NO: 9743 - protein, 17 aa, homo sapiens
MLVNYIKSEIIYAPSIM

SEQ ID NO: 9744 - DNA, 54 bp, homo sapiens
atgcttgttaattacatcaaatctgaaataatatatgctccttccataatgtga

SEQ ID NO: 9745 - protein, 12 aa, homo sapiens
MEKLDVLVYILS

SEQ ID NO: 9746 - DNA, 39 bp, homo sapiens; identical to SEQ ID NO: 9738

SEQ ID NO: 9747 - protein, 37 aa, homo sapiens; identical to SEQ ID NO: 9739

SEQ ID NO: 9748 - DNA, 114 bp, homo sapiens; identical to SEQ ID NO: 9740

SEQ ID NO: 9749 - protein, 8 aa, homo sapiens
MFFQNTFF

SEQ ID NO: 9750 - DNA, 27 bp, homo sapiens
atgtttttccaaaatacctttttttga

SEQ ID NO: 9751 - protein, 17 aa, homo sapiens
MLVNYIKSEIIYAPSIM

SEQ ID NO: 9752 - DNA, 54 bp, homo sapiens; identical to SEQ ID NO: 9744

SEQ ID NO: 9753 - protein, 31 aa, homo sapiens; identical to SEQ ID NO: 699

SEQ ID NO: 9754 - DNA, 96 bp, homo sapiens; identical to SEQ ID NO: 700

SEQ ID NO: 9755 - protein, 15 aa, homo sapiens
MGRGARRGAESETWT

SEQ ID NO: 9756 - DNA, 48 bp, homo sapiens; identical to SEQ ID NO: 702

SEQ ID NO: 9757 - protein, 30 aa, homo sapiens; identical to SEQ ID NO: 703

SEQ ID NO: 9758 - DNA, 93 bp, homo sapiens; identical to SEQ ID NO: 704

SEQ ID NO: 9759 - protein, 9 aa, homo sapiens
MLSPIPQTV

SEQ ID NO: 9760 - DNA, 30 bp, homo sapiens; identical to SEQ ID NO: 8640

SEQ ID NO: 9761 - protein, 7 aa, homo sapiens
MSSFGAG

SEQ ID NO: 9762 - DNA, 24 bp, homo sapiens
atgagtagctttggagctgggtga

SEQ ID NO: 9763 - protein, 6 aa, homo sapiens
MVSPLF

SEQ ID NO: 9764 - DNA, 21 bp, homo sapiens
atggtttctccccttttctga

SEQ ID NO: 9765 - protein, 12 aa, homo sapiens
MGKGSVEACLLG

SEQ ID NO: 9766 - DNA, 39 bp, homo sapiens; identical to SEQ ID NO: 5518

SEQ ID NO: 9767 - protein, 124 aa, homo sapiens [sequence omitted]

SEQ ID NO: 9768 - DNA, 375 bp, homo sapiens; identical to SEQ ID NO: 5520

SEQ ID NO: 9769 - protein, 134 aa, homo sapiens; identical to SEQ ID NO: 5579

SEQ ID NO: 9770 - DNA, 405 bp, homo sapiens; identical to SEQ ID NO: 5580

SEQ ID NO: 9771 - protein, 123 aa, homo sapiens [sequence omitted]

SEQ ID NO: 9772 - DNA, 372 bp, homo sapiens; identical to SEQ ID NO: 5582

SEQ ID NO: 9773 - protein, 6 aa, homo sapiens
MSNSPN

SEQ ID NO: 9774 - DNA, 21 bp, homo sapiens
atgagtaactcaccgaattga

SEQ ID NO: 9775 - protein, 45 aa, homo sapiens; identical to SEQ ID NO: 8671

SEQ ID NO: 9776 - DNA, 138 bp, homo sapiens; identical to SEQ ID NO: 8672

SEQ ID NO: 9777 - protein, 171 aa, homo sapiens; identical to SEQ ID NO: 5609

SEQ ID NO: 9778 - DNA, 516 bp, homo sapiens; identical to SEQ ID NO: 5610

SEQ ID NO: 9779 - protein, 19 aa, homo sapiens
MPPSPAGSPGVGGHAGYAT

SEQ ID NO: 9780 - DNA, 60 bp, homo sapiens; identical to SEQ ID NO: 5612

SEQ ID NO: 9781 - protein, 34 aa, homo sapiens; identical to SEQ ID NO: 5613

SEQ ID NO: 9782 - DNA, 105 bp, homo sapiens; identical to SEQ ID NO: 5614

SEQ ID NO: 9783 - protein, 10 aa, homo sapiens
MGNPAVESPL

SEQ ID NO: 9784 - DNA, 33 bp, homo sapiens; identical to SEQ ID NO: 5616

SEQ ID NO: 9785 - protein, 4 aa, homo sapiens
MAMT

SEQ ID NO: 9786 - DNA, 15 bp, homo sapiens
atggctatgacgtga

SEQ ID NO: 9787 - protein, 8 aa, homo sapiens
MDFGIGWQ

SEQ ID NO: 9788 - DNA, 27 bp, homo sapiens
atggacttcgggattggatggcagtga

SEQ ID NO: 9789 - protein, 7 aa, homo sapiens
MAVTHQC

SEQ ID NO: 9790 - DNA, 24 bp, homo sapiens
atggcagtgacacatcagtgttaa

SEQ ID NO: 9791 - protein, 15 aa, homo sapiens
MFINFVCRKIPHIRG

SEQ ID NO: 9792 - DNA, 48 bp, homo sapiens
atgtttataaattttgtttgtaggaaaataccacatattcgggggtga

SEQ ID NO: 9793 - protein, 6 aa, homo sapiens
MGCGDE

SEQ ID NO: 9794 - DNA, 21 bp, homo sapiens
atgggctgcggggatgaatga

SEQ ID NO: 9795 - protein, 6 aa, homo sapiens
MNESRV

SEQ ID NO: 9796 - DNA, 21 bp, homo sapiens
atgaatgagagccgagtctga

SEQ ID NO: 9797 - protein, 121 aa, homo sapiens; identical to SEQ ID NO: 8685

SEQ ID NO: 9798 - DNA, 366 bp, homo sapiens; identical to SEQ ID NO: 8686

SEQ ID NO: 9799 - protein, 34 aa, homo sapiens; identical to SEQ ID NO: 8687

SEQ ID NO: 9800 - DNA, 105 bp, homo sapiens; identical to SEQ ID NO: 8688

SEQ ID NO: 9801 - protein, 74 aa, homo sapiens [sequence omitted]

SEQ ID NO: 9802 - DNA, 225 bp, homo sapiens; identical to SEQ ID NO: 9354

SEQ ID NO: 9803 - protein, 43 aa, homo sapiens; identical to SEQ ID NO: 9355

SEQ ID NO: 9804 - DNA, 132 bp, homo sapiens; identical to SEQ ID NO: 9356

SEQ ID NO: 9805 - protein, 109 aa, homo sapiens; identical to SEQ ID NO: 9357

SEQ ID NO: 9806 - DNA, 330 bp, homo sapiens; identical to SEQ ID NO: 9358

SEQ ID NO: 9807 - protein, 38 aa, homo sapiens; identical to SEQ ID NO: 9359

SEQ ID NO: 9808 - DNA, 117 bp, homo sapiens; identical to SEQ ID NO: 9360

SEQ ID NO: 9809 - protein, 14 aa, homo sapiens
MRRKGAWGSGLSRT

SEQ ID NO: 9810 - DNA, 45 bp, homo sapiens; identical to SEQ ID NO: 9578

SEQ ID NO: 9811 - protein, 13 aa, homo sapiens
MEIISPNLGAQQI

SEQ ID NO: 9812 - DNA, 42 bp, homo sapiens; identical to SEQ ID NO: 9580

SEQ ID NO: 9813 - protein, 4 aa, homo sapiens
MRDD

SEQ ID NO: 9814 - DNA, 15 bp, homo sapiens
atgagagacgattaa

SEQ ID NO: 9815 - protein, 32 aa, homo sapiens; identical to SEQ ID NO: 9583

SEQ ID NO: 9816 - DNA, 99 bp, homo sapiens; identical to SEQ ID NO: 9584

SEQ ID NO: 9817 - protein, 72 aa, homo sapiens; identical to SEQ ID NO: 4687

SEQ ID NO: 9818 - DNA, 219 bp, homo sapiens; identical to SEQ ID NO: 4688

SEQ ID NO: 9819 - protein, 32 aa, homo sapiens; identical to SEQ ID NO: 4695

SEQ ID NO: 9820 - DNA, 99 bp, homo sapiens; identical to SEQ ID NO: 4696

SEQ ID NO: 9821 - protein, 15 aa, homo sapiens
MDLCGCVPNGRSFVP

SEQ ID NO: 9822 - DNA, 48 bp, homo sapiens; identical to SEQ ID NO: 8470

SEQ ID NO: 9823 - protein, 15 aa, homo sapiens
MCSQWPVFCSLTDAT

SEQ ID NO: 9824 - DNA, 48 bp, homo sapiens; identical to SEQ ID NO: 8472

SEQ ID NO: 9825 - protein, 21 aa, homo sapiens
MMTCALVFFTEPLFIKCSIKS

SEQ ID NO: 9826 - DNA, 66 bp, homo sapiens; identical to SEQ ID NO: 8714

SEQ ID NO: 9827 - protein, 7 aa, homo sapiens
MRFGLFH

SEQ ID NO: 9828 - DNA, 24 bp, homo sapiens
atgcgctttggtctttttcactga

SEQ ID NO: 9829 - protein, 7 aa, homo sapiens
MYSLHLA

SEQ ID NO: 9830 - DNA, 24 bp, homo sapiens
atgtattctttgcatctggcatag

SEQ ID NO: 9831 - protein, 60 aa, homo sapiens; identical to SEQ ID NO: 8719

SEQ ID NO: 9832 - DNA, 183 bp, homo sapiens; identical to SEQ ID NO: 8720

SEQ ID NO: 9833 - protein, 21 aa, homo sapiens
MMTCALVFFTEPLFIKCSIKS

SEQ ID NO: 9834 - DNA, 66 bp, homo sapiens; identical to SEQ ID NO: 8714

SEQ ID NO: 9835 - protein, 7 aa, homo sapiens
MRFGLFH

SEQ ID NO: 9836 - DNA, 24 bp, homo sapiens
atgcgctttggtctttttcactga

SEQ ID NO: 9837 - protein, 7 aa, homo sapiens
MYSLHLA

SEQ ID NO: 9838 - DNA, 24 bp, homo sapiens
atgtattctttgcatctggcatag

SEQ ID NO: 9839 - protein, 60 aa, homo sapiens; identical to SEQ ID NO: 8719

SEQ ID NO: 9840 - DNA, 183 bp, homo sapiens; identical to SEQ ID NO: 8720

SEQ ID NO: 9841 - protein, 21 aa, homo sapiens
MMTCALVFFTEPLFIKCSIKS

SEQ ID NO: 9842 - DNA, 66 bp, homo sapiens; identical to SEQ ID NO: 8714

SEQ ID NO: 9843 - protein, 7 aa, homo sapiens
MRFGLFH

SEQ ID NO: 9844 - DNA, 24 bp, homo sapiens
atgcgctttggtctttttcactga

SEQ ID NO: 9845 - protein, 7 aa, homo sapiens
MYSLHLA

SEQ ID NO: 9846 - DNA, 24 bp, homo sapiens
atgtattctttgcatctggcatag

SEQ ID NO: 9847 - protein, 60 aa, homo sapiens; identical to SEQ ID NO: 8719

SEQ ID NO: 9848 - DNA, 183 bp, homo sapiens; identical to SEQ ID NO: 8720

SEQ ID NO: 9849 - protein, 13 aa, homo sapiens
MLWPDPLEINPES

SEQ ID NO: 9850 - DNA, 42 bp, homo sapiens; identical to SEQ ID NO: 8740

SEQ ID NO: 9851 - protein, 4 aa, homo sapiens
MRRR

SEQ ID NO: 9852 - DNA, 15 bp, homo sapiens
atgaggaggcgatga

SEQ ID NO: 9853 - protein, 13 aa, homo sapiens
MMTLQKVAAAGGA

SEQ ID NO: 9854 - DNA, 42 bp, homo sapiens; identical to SEQ ID NO: 8744

SEQ ID NO: 9855 - protein, 53 aa, homo sapiens
MRKKGALGDRPHLGSTHSEGSLAFRSWVAVLGSEYSHPIRVAKHCGCSVRIQC

SEQ ID NO: 9856 - DNA, 162 bp, homo sapiens
atgcgtaaaaagggagcacttggagacaggccacatttgggcagtacgcattcggagggctctctggctttccgatcttgggtcgctgtacttggctctgaatacagtcaccccatcagagtagcaaaacactgtggttgtagtgtgagaatccaatgttaa

SEQ ID NO: 9857 - protein, 13 aa, homo sapiens
MLWPDPLEINPES

SEQ ID NO: 9858 - DNA, 42 bp, homo sapiens; identical to SEQ ID NO: 8740

SEQ ID NO: 9859 - protein, 4 aa, homo sapiens
MRRR

SEQ ID NO: 9860 - DNA, 15 bp, homo sapiens
atgaggaggcgatga

SEQ ID NO: 9861 - protein, 13 aa, homo sapiens
MMTLQKVAAAGGA

SEQ ID NO: 9862 - DNA, 42 bp, homo sapiens; identical to SEQ ID NO: 8744

SEQ ID NO: 9863 - protein, 53 aa, homo sapiens; identical to SEQ ID NO: 9855

SEQ ID NO: 9864 - DNA, 162 bp, homo sapiens; identical to SEQ ID NO: 9856

SEQ ID NO: 9865 - protein, 60 aa, homo sapiens [sequence omitted]

SEQ ID NO: 9866 - DNA, 183 bp, homo sapiens; identical to SEQ ID NO: 5906

SEQ ID NO: 9867 - protein, 133 aa, homo sapiens; identical to SEQ ID NO: 5907

SEQ ID NO: 9868 - DNA, 402 bp, homo sapiens; identical to SEQ ID NO: 5908

SEQ ID NO: 9869 - protein, 130 aa, homo sapiens; identical to SEQ ID NO: 5909

SEQ ID NO: 9870 - DNA, 393 bp, homo sapiens; identical to SEQ ID NO: 5910

SEQ ID NO: 9871 - protein, 38 aa, homo sapiens; identical to SEQ ID NO: 5911

SEQ ID NO: 9872 - DNA, 117 bp, homo sapiens; identical to SEQ ID NO: 5912

SEQ ID NO: 9873 - protein, 7 aa, homo sapiens
MAIPGRQ

SEQ ID NO: 9874 - DNA, 24 bp, homo sapiens
atggcgattccgggcaggcagtga

SEQ ID NO: 9875 - protein, 26 aa, homo sapiens
MRNYGDCIFGRGVLNALEVKGLCRQG

SEQ ID NO: 9876 - DNA, 81 bp, homo sapiens; identical to SEQ ID NO: 6004

SEQ ID NO: 9877 - protein, 4 aa, homo sapiens
MRWK

SEQ ID NO: 9878 - DNA, 15 bp, homo sapiens
atgcgctggaagtga

SEQ ID NO: 9879 - protein, 13 aa, homo sapiens
MEARSLREKLVRK

SEQ ID NO: 9880 - DNA, 42 bp, homo sapiens; identical to SEQ ID NO: 6008

SEQ ID NO: 9881 - protein, 12 aa, homo sapiens
MGANLTFKVFNK

SEQ ID NO: 9882 - DNA, 39 bp, homo sapiens; identical to SEQ ID NO: 8770

SEQ ID NO: 9883 - protein, 32 aa, homo sapiens; identical to SEQ ID NO: 8771

SEQ ID NO: 9884 - DNA, 99 bp, homo sapiens; identical to SEQ ID NO: 8772

SEQ ID NO: 9885 - protein, 9 aa, homo sapiens
MEGRGEKTE

SEQ ID NO: 9886 - DNA, 30 bp, homo sapiens; identical to SEQ ID NO: 8774

SEQ ID NO: 9887 - protein, 18 aa, homo sapiens
MNFSSYLQEVSYVLERNV

SEQ ID NO: 9888 - DNA, 57 bp, homo sapiens; identical to SEQ ID NO: 8776

SEQ ID NO: 9889 - protein, 4 aa, homo sapiens
MGGF

SEQ ID NO: 9890 - DNA, 15 bp, homo sapiens
atgggcgggttctga

SEQ ID NO: 9891 - protein, 6 aa, homo sapiens
MWPQGE

SEQ ID NO: 9892 - DNA, 21 bp, homo sapiens
atgtggccccagggcgagtga

SEQ ID NO: 9893 - protein, 4 aa, homo sapiens
MGCP

SEQ ID NO: 9894 - DNA, 15 bp, homo sapiens
atggggtgcccctga

SEQ ID NO: 9895 - protein, 35 aa, homo sapiens [sequence omitted]

SEQ ID NO: 9896 - DNA, 108 bp, homo sapiens; identical to SEQ ID NO: 8464

SEQ ID NO: 9897 - protein, 87 aa, homo sapiens; identical to SEQ ID NO: 441

SEQ ID NO: 9898 - DNA, 264 bp, homo sapiens; identical to SEQ ID NO: 442

SEQ ID NO: 9899 - protein, 85 aa, homo sapiens [sequence omitted]

SEQ ID NO: 9900 - DNA, 258 bp, homo sapiens; identical to SEQ ID NO: 444

SEQ ID NO: 9901 - protein, 96 aa, homo sapiens; identical to SEQ ID NO: 445

SEQ ID NO: 9902 - DNA, 291 bp, homo sapiens; identical to SEQ ID NO: 446

SEQ ID NO: 9903 - protein, 14 aa, homo sapiens
MTGVGATSLVRFFT

SEQ ID NO: 9904 - DNA, 45 bp, homo sapiens; identical to SEQ ID NO: 448

SEQ ID NO: 9905 - protein, 10 aa, homo sapiens
MVLGDGTPGV

SEQ ID NO: 9906 - DNA, 33 bp, homo sapiens; identical to SEQ ID NO: 6076

SEQ ID NO: 9907 - protein, 42 aa, homo sapiens; identical to SEQ ID NO: 6077

SEQ ID NO: 9908 - DNA, 129 bp, homo sapiens; identical to SEQ ID NO: 6078

SEQ ID NO: 9909 - protein, 59 aa, homo sapiens [sequence omitted]

SEQ ID NO: 9910 - DNA, 180 bp, homo sapiens; identical to SEQ ID NO: 6080

SEQ ID NO: 9911 - protein, 15 aa, homo sapiens
MRILVSYYILKKISL

SEQ ID NO: 9912 - DNA, 48 bp, homo sapiens; identical to SEQ ID NO: 8792

SEQ ID NO: 9913 - protein, 10 aa, homo sapiens
MVLGDGTPGV

SEQ ID NO: 9914 - DNA, 33 bp, homo sapiens; identical to SEQ ID NO: 6076

SEQ ID NO: 9915 - protein, 42 aa, homo sapiens; identical to SEQ ID NO: 6077

SEQ ID NO: 9916 - DNA, 129 bp, homo sapiens; identical to SEQ ID NO: 6078

SEQ ID NO: 9917 - protein, 59 aa, homo sapiens [sequence omitted]

SEQ ID NO: 9918 - DNA, 180 bp, homo sapiens; identical to SEQ ID NO: 6080

SEQ ID NO: 9919 - protein, 15 aa, homo sapiens
MRILVSYYILKKISL

SEQ ID NO: 9920 - DNA, 48 bp, homo sapiens; identical to SEQ ID NO: 8792

SEQ ID NO: 9921 - protein, 12 aa, homo sapiens
MGANLTFKVFNK

SEQ ID NO: 9922 - DNA, 39 bp, homo sapiens; identical to SEQ ID NO: 8770

SEQ ID NO: 9923 - protein, 32 aa, homo sapiens; identical to SEQ ID NO: 8771

SEQ ID NO: 9924 - DNA, 99 bp, homo sapiens; identical to SEQ ID NO: 8772

SEQ ID NO: 9925 - protein, 9 aa, homo sapiens
MEGRGEKTE

SEQ ID NO: 9926 - DNA, 30 bp, homo sapiens; identical to SEQ ID NO: 8774

SEQ ID NO: 9927 - protein, 18 aa, homo sapiens
MNFSSYLQEVSYVLERNV

SEQ ID NO: 9928 - DNA, 57 bp, homo sapiens; identical to SEQ ID NO: 8776

SEQ ID NO: 9929 - protein, 12 aa, homo sapiens
MGANLTFKVFNK

SEQ ID NO: 9930 - DNA, 39 bp, homo sapiens; identical to SEQ ID NO: 8770

SEQ ID NO: 9931 - protein, 32 aa, homo sapiens; identical to SEQ ID NO: 8771

SEQ ID NO: 9932 - DNA, 99 bp, homo sapiens; identical to SEQ ID NO: 8772

SEQ ID NO: 9933 - protein, 9 aa, homo sapiens
MEGRGEKTE

SEQ ID NO: 9934 - DNA, 30 bp, homo sapiens; identical to SEQ ID NO: 8774

SEQ ID NO: 9935 - protein, 18 aa, homo sapiens
MNFSSYLQEVSYVLERNV

SEQ ID NO: 9936 - DNA, 57 bp, homo sapiens; identical to SEQ ID NO: 8776

SEQ ID NO: 9937 - protein, 23 aa, homo sapiens
MLGTPGGAGPRGPAASSGSVPSR

SEQ ID NO: 9938 - DNA, 72 bp, homo sapiens; identical to SEQ ID NO: 8810

SEQ ID NO: 9939 - protein, 25 aa, homo sapiens
MKNPVPSAFFFSSLGSRHVMVLLYF

SEQ ID NO: 9940 - DNA, 78 bp, homo sapiens; identical to SEQ ID NO: 8812

SEQ ID NO: 9941 - protein, 13 aa, homo sapiens
MAHIPQHPKSSAT

SEQ ID NO: 9942 - DNA, 42 bp, homo sapiens; identical to SEQ ID NO: 8814

SEQ ID NO: 9943 - protein, 36 aa, homo sapiens; identical to SEQ ID NO: 8815

SEQ ID NO: 9944 - DNA, 111 bp, homo sapiens; identical to SEQ ID NO: 8816

SEQ ID NO: 9945 - protein, 94 aa, homo sapiens; identical to SEQ ID NO: 9585

SEQ ID NO: 9946 - DNA, 285 bp, homo sapiens; identical to SEQ ID NO: 9586

SEQ ID NO: 9947 - protein, 27 aa, homo sapiens
MVGHSWPTVHSPQPKSGELLPCSWIQL

SEQ ID NO: 9948 - DNA, 84 bp, homo sapiens; identical to SEQ ID NO: 9588

SEQ ID NO: 9949 - protein, 15 aa, homo sapiens
MSFALPARNVSRNKI

SEQ ID NO: 9950 - DNA, 48 bp, homo sapiens; identical to SEQ ID NO: 9590

SEQ ID NO: 9951 - protein, 46 aa, homo sapiens [sequence omitted]

SEQ ID NO: 9952 - DNA, 141 bp, homo sapiens; identical to SEQ ID NO: 9592

SEQ ID NO: 9953 - protein, 12 aa, homo sapiens
MGANLTFKVFNK

SEQ ID NO: 9954 - DNA, 39 bp, homo sapiens; identical to SEQ ID NO: 8770

SEQ ID NO: 9955 - protein, 32 aa, homo sapiens; identical to SEQ ID NO: 8771

SEQ ID NO: 9956 - DNA, 99 bp, homo sapiens; identical to SEQ ID NO: 8772

SEQ ID NO: 9957 - protein, 9 aa, homo sapiens
MEGRGEKTE

SEQ ID NO: 9958 - DNA, 30 bp, homo sapiens; identical to SEQ ID NO: 8774

SEQ ID NO: 9959 - protein, 18 aa, homo sapiens
MNFSSYLQEVSYVLERNV

SEQ ID NO: 9960 - DNA, 57 bp, homo sapiens; identical to SEQ ID NO: 8776

SEQ ID NO: 9961 - protein, 36 aa, homo sapiens; identical to SEQ ID NO: 8833

SEQ ID NO: 9962 - DNA, 111 bp, homo sapiens; identical to SEQ ID NO: 8834

SEQ ID NO: 9963 - protein, 48 aa, homo sapiens; identical to SEQ ID NO: 8835

SEQ ID NO: 9964 - DNA, 147 bp, homo sapiens; identical to SEQ ID NO: 8836

SEQ ID NO: 9965 - protein, 17 aa, homo sapiens
MEVNLDLSRWPKRRAGG

SEQ ID NO: 9966 - DNA, 54 bp, homo sapiens; identical to SEQ ID NO: 8838

SEQ ID NO: 9967 - protein, 38 aa, homo sapiens [sequence omitted]

SEQ ID NO: 9968 - DNA, 117 bp, homo sapiens; identical to SEQ ID NO: 8840

SEQ ID NO: 9969 - protein, 12 aa, homo sapiens
MGANLTFKVFNK

SEQ ID NO: 9970 - DNA, 39 bp, homo sapiens; identical to SEQ ID NO: 8770

SEQ ID NO: 9971 - protein, 32 aa, homo sapiens; identical to SEQ ID NO: 8771

SEQ ID NO: 9972 - DNA, 99 bp, homo sapiens; identical to SEQ ID NO: 8772

SEQ ID NO: 9973 - protein, 9 aa, homo sapiens
MEGRGEKTE

SEQ ID NO: 9974 - DNA, 30 bp, homo sapiens; identical to SEQ ID NO: 8774

SEQ ID NO: 9975 - protein, 18 aa, homo sapiens
MNFSSYLQEVSYVLERNV

SEQ ID NO: 9976 - DNA, 57 bp, homo sapiens; identical to SEQ ID NO: 8776

SEQ ID NO: 9977 - protein, 13 aa, homo sapiens
MLWPDPLEINPES

SEQ ID NO: 9978 - DNA, 42 bp, homo sapiens; identical to SEQ ID NO: 8740

SEQ ID NO: 9979 - protein, 4 aa, homo sapiens
MRRR

SEQ ID NO: 9980 - DNA, 15 bp, homo sapiens
atgaggaggcgatga

SEQ ID NO: 9981 - protein, 13 aa, homo sapiens
MMTLQKVAAAGGA

SEQ ID NO: 9982 - DNA, 42 bp, homo sapiens; identical to SEQ ID NO: 8744

SEQ ID NO: 9983 - protein, 53 aa, homo sapiens; identical to SEQ ID NO: 9855

SEQ ID NO: 9984 - DNA, 162 bp, homo sapiens; identical to SEQ ID NO: 9856

SEQ ID NO: 9985 - protein, 127 aa, homo sapiens; identical to SEQ ID NO: 8857

SEQ ID NO: 9986 - DNA, 384 bp, homo sapiens; identical to SEQ ID NO: 8858

SEQ ID NO: 9987 - protein, 12 aa, homo sapiens
MWKGSVNRHPFC

SEQ ID NO: 9988 - DNA, 39 bp, homo sapiens; identical to SEQ ID NO: 8860

SEQ ID NO: 9989 - protein, 144 aa, homo sapiens; identical to SEQ ID NO: 8861

SEQ ID NO: 9990 - DNA, 435 bp, homo sapiens; identical to SEQ ID NO: 8862

SEQ ID NO: 9991 - protein, 112 aa, homo sapiens [sequence omitted]

SEQ ID NO: 9992 - DNA, 339 bp, homo sapiens; identical to SEQ ID NO: 6802

SEQ ID NO: 9993 - protein, 5 aa, homo sapiens
MVKRQ

SEQ ID NO: 9994 - DNA, 18 bp, homo sapiens
atggtgaaaagacagtag

SEQ ID NO: 9995 - protein, 18 aa, homo sapiens
MINACKGASLLYDKSWLT

SEQ ID NO: 9996 - DNA, 57 bp, homo sapiens; identical to SEQ ID NO: 8868

SEQ ID NO: 9997 - protein, 14 aa, homo sapiens
MHAKELLFYMTSLG

SEQ ID NO: 9998 - DNA, 45 bp, homo sapiens; identical to SEQ ID NO: 8870

SEQ ID NO: 9999 - protein, 8 aa, homo sapiens
MQRSFSSI

SEQ ID NO: 10000 - DNA, 27 bp, homo sapiens
atgcaaaggagcttctcttctatatga

SEQ ID NO: 10001 - protein, 67 aa, homo sapiens; identical to SEQ ID NO: 8881

SEQ ID NO: 10002 - DNA, 204 bp, homo sapiens; identical to SEQ ID NO: 8882

SEQ ID NO: 10003 - protein, 57 aa, homo sapiens [sequence omitted]

SEQ ID NO: 10004 - DNA, 174 bp, homo sapiens; identical to SEQ ID NO: 6856

SEQ ID NO: 10005 - protein, 27 aa, homo sapiens
MLFYNKPTKQPLWLWFLVPGSQEETSC

SEQ ID NO: 10006 - DNA, 84 bp, homo sapiens; identical to SEQ ID NO: 8886

SEQ ID NO: 10007 - protein, 13 aa, homo sapiens
MNTELPCLDRLLV

SEQ ID NO: 10008 - DNA, 42 bp, homo sapiens; identical to SEQ ID NO: 8888

SEQ ID NO: 10009 - protein, 42 aa, homo sapiens
MAAVTAAAGEEAVGRPGAPSATAESGSGPSWRTETSGSRTAT

SEQ ID NO: 10010 - DNA, 129 bp, homo sapiens
atggcggcggtaacagcggccgccggagaggaggcggtggggaggcccggggcgccaagcgcgacggcagaaagcggcagcggcccgtcatggcgcaccgaaaccagcggcagtcgcacggccacctga

SEQ ID NO: 10011 - protein, 135 aa, homo sapiens
MAHRNQRQSHGHLSRPFLLEPARGACSRDTFLSASPRLPRPRQAASLAHRPEKSAPGADCPSGRRAAALDVRGPLWAGRGASALPSSSRVRSYPLGSRGTARGPVRSRADRSARQSGLAAANGARARTRLGSTFQ

SEQ ID NO: 10012 - DNA, 408 bp, homo sapiens
atggcgcaccgaaaccagcggcagtcgcacggccacctgagtcgccccttcctgctggagccagcgaggggtgcctgcagccgggacaccttcctctccgcgtctcctcgtctcccgcgcccgcgtcaggccgccagccttgcccaccgccccgagaagagcgcgccgggcgccgactgcccctcggggcgccgagcggcggccctggacgtgcgggggcctctctgggccggccgcggcgcctcggccctgccctctagctcccgcgttcgctcctaccctcttggctctcggggcacagcgcgcggcccggtccggagcagggcggacaggagcgccaggcagagcggcctggccgccgctaacggcgcacgcgcgcgtactcggctcggatctaccttccagtag

SEQ ID NO: 10013 - protein, 101 aa, homo sapiens
MGPGPGLGAGGPPPRGGSRLRCPALTSPAPRAAPRWPRQPRAAVSWGAWRRGPARRSPPSASRTAAAVRRTRRTRCTAALRMAAAAASTGRWAGAPAGRAW

SEQ ID NO: 10014 - DNA, 306 bp, homo sapiens
atgggaccgggaccagggctgggggccggggggccgccgccgcggggaggttcccggctcaggtgcccagcgctcaccagcccagcgcctcgggcggcgccgcggtggccccggcagccccgcgcagctgtttcctggggggcgtggcgtcgggggcccgcgcggcgcagtcctccttcagcatcccgaacagcagcagcggtccgcaggactcgcaggactcggtgcacagcagccctgaggatggcggcggcggcggccagcaccggccggtgggcgggagccccggcgggccgcgcctggtga

SEQ ID NO: 10015 - protein, 68 aa, homo sapiens; identical to SEQ ID NO: 6867

SEQ ID NO: 10016 - DNA, 207 bp, homo sapiens; identical to SEQ ID NO: 6868

SEQ ID NO: 10017 - protein, 5 aa, homo sapiens
MNQGF

SEQ ID NO: 10018 - DNA, 18 bp, homo sapiens
atgaaccaaggtttctga

SEQ ID NO: 10019 - protein, 93 aa, homo sapiens [sequence omitted]

SEQ ID NO: 10020 - DNA, 282 bp, homo sapiens; identical to SEQ ID NO: 6900

SEQ ID NO: 10021 - protein, 7 aa, homo sapiens
MAASWKG

SEQ ID NO: 10022 - DNA, 24 bp, homo sapiens
atggcagcatcatggaaggggtga

SEQ ID NO: 10023 - protein, 16 aa, homo sapiens
MGDPGRGTLPGRWPGL

SEQ ID NO: 10024 - DNA, 51 bp, homo sapiens; identical to SEQ ID NO: 6904

SEQ ID NO: 10025 - protein, 80 aa, homo sapiens; identical to SEQ ID NO: 6907

SEQ ID NO: 10026 - DNA, 243 bp, homo sapiens; identical to SEQ ID NO: 6908

SEQ ID NO: 10027 - protein, 20 aa, homo sapiens
MSSSDWVPERLWTLCPAEEA

SEQ ID NO: 10028 - DNA, 63 bp, homo sapiens; identical to SEQ ID NO: 6910

SEQ ID NO: 10029 - protein, 29 aa, homo sapiens
MVLWMISNKKNGRVNYRAWTGGRGASRGR

SEQ ID NO: 10030 - DNA, 90 bp, homo sapiens; identical to SEQ ID NO: 6912

SEQ ID NO: 10031 - protein, 51 aa, homo sapiens [sequence omitted]

SEQ ID NO: 10032 - DNA, 156 bp, homo sapiens; identical to SEQ ID NO: 8896

SEQ ID NO: 10033 - protein, 235 aa, homo sapiens [sequence omitted]

SEQ ID NO: 10034 - DNA, 708 bp, homo sapiens
atggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttggtagggaaatggccttgggcggaggcgggggacaggcagggaacggagtggccacgtccaggtttcctgcggccaccgaaccggtgcctcgcgccctggcgcacccacgtcctcggttcggggtggacttggggttccaaaacagccccagccggtggcggagtctttacgacagggaccagcgggctcgcccttgtccttgcagcgggccccggatgtgggcctcaggcggggacaggcgcccgcagggaggcctccagggccgctatgcacctgcgcgcggcaggcggcccggaccacacagggcgtgtgggtgttttcccttttctaaggatcatatgagtaatgccaggcttattgtagggaacgcagaaataataaccgtaaagagtaaaaacatataa

SEQ ID NO: 10035 - protein, 24 aa, homo sapiens
MHLRAAGGPDHTGRVGVFPFLRII

SEQ ID NO: 10036 - DNA, 75 bp, homo sapiens
atgcacctgcgcgcggcaggcggcccggaccacacagggcgtgtgggtgttttcccttttctaaggatcatatga

SEQ ID NO: 10037 - protein, 5 aa, homo sapiens
MPGLL

SEQ ID NO: 10038 - DNA, 18 bp, homo sapiens
atgccaggcttattgtag

SEQ ID NO: 10039 - protein, 24 aa, homo sapiens
MARSRLTATFASRVQVILLPQPPE

SEQ ID NO: 10040 - DNA, 75 bp, homo sapiens
atggcgcgatctcggctcactgcaactttcgcctcccgggttcaagtgattctcctgcctcagcctcctgagtag

SEQ ID NO: 10041 - protein, 43 aa, homo sapiens; identical to SEQ ID NO: 8897

SEQ ID NO: 10042 - DNA, 132 bp, homo sapiens; identical to SEQ ID NO: 8898

SEQ ID NO: 10043 - protein, 52 aa, homo sapiens; identical to SEQ ID NO: 8899

SEQ ID NO: 10044 - DNA, 159 bp, homo sapiens; identical to SEQ ID NO: 8900

SEQ ID NO: 10045 - protein, 67 aa, homo sapiens [sequence omitted]

SEQ ID NO: 10046 - DNA, 204 bp, homo sapiens; identical to SEQ ID NO: 8902

SEQ ID NO: 10047 - protein, 5 aa, homo sapiens
MCLRC

SEQ ID NO: 10048 - DNA, 18 bp, homo sapiens
atgtgtttacgatgttga

SEQ ID NO: 10049 - protein, 126 aa, homo sapiens; identical to SEQ ID NO: 8905

SEQ ID NO: 10050 - DNA, 381 bp, homo sapiens; identical to SEQ ID NO: 8906

SEQ ID NO: 10051 - protein, 11 aa, homo sapiens
MGEPDLHVEKA

SEQ ID NO: 10052 - DNA, 36 bp, homo sapiens; identical to SEQ ID NO: 1562

SEQ ID NO: 10053 - protein, 36 aa, homo sapiens; identical to SEQ ID NO: 1563

SEQ ID NO: 10054 - DNA, 111 bp, homo sapiens; identical to SEQ ID NO: 1564

SEQ ID NO: 10055 - protein, 26 aa, homo sapiens
MRGGHGMGGAAVLPGGCRPRPGEGRG

SEQ ID NO: 10056 - DNA, 81 bp, homo sapiens; identical to SEQ ID NO: 1566

SEQ ID NO: 10057 - protein, 10 aa, homo sapiens
MDSVGRRGAR

SEQ ID NO: 10058 - DNA, 33 bp, homo sapiens; identical to SEQ ID NO: 8914

SEQ ID NO: 10059 - protein, 78 aa, homo sapiens; identical to SEQ ID NO: 8915

SEQ ID NO: 10060 - DNA, 237 bp, homo sapiens; identical to SEQ ID NO: 8916

SEQ ID NO: 10061 - protein, 160 aa, homo sapiens [sequence omitted]

SEQ ID NO: 10062 - DNA, 483 bp, homo sapiens; identical to SEQ ID NO: 6978

SEQ ID NO: 10063 - protein, 16 aa, homo sapiens
MTSLPHYQENWEFGIL

SEQ ID NO: 10064 - DNA, 51 bp, homo sapiens; identical to SEQ ID NO: 6980

SEQ ID NO: 10065 - protein, 14 aa, homo sapiens
MPPTRRVGVRRRAP

SEQ ID NO: 10066 - DNA, 45 bp, homo sapiens; identical to SEQ ID NO: 8922

SEQ ID NO: 10067 - protein, 84 aa, homo sapiens [sequence omitted]

SEQ ID NO: 10068 - DNA, 255 bp, homo sapiens; identical to SEQ ID NO: 8924

SEQ ID NO: 10069 - protein, 58 aa, homo sapiens; identical to SEQ ID NO: 8925

SEQ ID NO: 10070 - DNA, 177 bp, homo sapiens; identical to SEQ ID NO: 8926

SEQ ID NO: 10071 - protein, 6 aa, homo sapiens
MYYWVL

SEQ ID NO: 10072 - DNA, 21 bp, homo sapiens
atgtactactgggtcttgtaa

SEQ ID NO: 10073 - protein, 6 aa, homo sapiens
MAPGGR

SEQ ID NO: 10074 - DNA, 21 bp, homo sapiens
atggccccggggggccgctag

SEQ ID NO: 10075 - protein, 101 aa, homo sapiens; identical to SEQ ID NO: 6989

SEQ ID NO: 10076 - DNA, 306 bp, homo sapiens; identical to SEQ ID NO: 6990

SEQ ID NO: 10077 - protein, 10 aa, homo sapiens
MRLPYLSVST

SEQ ID NO: 10078 - DNA, 33 bp, homo sapiens; identical to SEQ ID NO: 6992

SEQ ID NO: 10079 - protein, 29 aa, homo sapiens
MGQEGIKVGLGMRQCWRELAGAGAGGPTG

SEQ ID NO: 10080 - DNA, 90 bp, homo sapiens; identical to SEQ ID NO: 8936

SEQ ID NO: 10081 - protein, 26 aa, homo sapiens
MTIKFCTSFPEAPDRLAWSIYYWTYS

SEQ ID NO: 10082 - DNA, 81 bp, homo sapiens; identical to SEQ ID NO: 8938

SEQ ID NO: 10083 - protein, 46 aa, homo sapiens; identical to SEQ ID NO: 8939

SEQ ID NO: 10084 - DNA, 141 bp, homo sapiens; identical to SEQ ID NO: 8940

SEQ ID NO: 10085 - protein, 28 aa, homo sapiens
MAITLLQINIFNHWNDGNNLIGFILSSI

SEQ ID NO: 10086 - DNA, 87 bp, homo sapiens; identical to SEQ ID NO: 8942

SEQ ID NO: 10087 - protein, 5 aa, homo sapiens
MMAII

SEQ ID NO: 10088 - DNA, 18 bp, homo sapiens
atgatggcaataatctaa

SEQ ID NO: 10089 - protein, 4 aa, homo sapiens
MIGS

SEQ ID NO: 10090 - DNA, 15 bp, homo sapiens
atgattggtagctaa

SEQ ID NO: 10091 - protein, 11 aa, homo sapiens
MVSVRGRASQG

SEQ ID NO: 10092 - DNA, 36 bp, homo sapiens; identical to SEQ ID NO: 7028

SEQ ID NO: 10093 - protein, 61 aa, homo sapiens; identical to SEQ ID NO: 7029

SEQ ID NO: 10094 - DNA, 186 bp, homo sapiens; identical to SEQ ID NO: 7030

SEQ ID NO: 10095 - protein, 24 aa, homo sapiens
MPAWEELWEKLWSGDPVPALPCSE

SEQ ID NO: 10096 - DNA, 75 bp, homo sapiens; identical to SEQ ID NO: 7032

SEQ ID NO: 10097 - protein, 142 aa, homo sapiens; identical to SEQ ID NO: 7049

SEQ ID NO: 10098 - DNA, 429 bp, homo sapiens; identical to SEQ ID NO: 7050

SEQ ID NO: 10099 - protein, 43 aa, homo sapiens; identical to SEQ ID NO: 7051

SEQ ID NO: 10100 - DNA, 132 bp, homo sapiens; identical to SEQ ID NO: 7052

SEQ ID NO: 10101 - protein, 16 aa, homo sapiens
MRQALSSEPLFALSAA

SEQ ID NO: 10102 - DNA, 51 bp, homo sapiens; identical to SEQ ID NO: 7054

SEQ ID NO: 10103 - protein, 6 aa, homo sapiens
MDLRHK

SEQ ID NO: 10104 - DNA, 21 bp, homo sapiens
atggatttgaggcacaagtga

SEQ ID NO: 10105 - protein, 6 aa, homo sapiens
MSAAGL

SEQ ID NO: 10106 - DNA, 21 bp, homo sapiens
atgtcagccgctggactgtag

SEQ ID NO: 10107 - protein, 5 aa, homo sapiens
MPLQP

SEQ ID NO: 10108 - DNA, 18 bp, homo sapiens
atgcccttgcagccttga

SEQ ID NO: 10109 - protein, 41 aa, homo sapiens; identical to SEQ ID NO: 7101

SEQ ID NO: 10110 - DNA, 126 bp, homo sapiens; identical to SEQ ID NO: 7102

SEQ ID NO: 10111 - protein, 48 aa, homo sapiens; identical to SEQ ID NO: 7103

SEQ ID NO: 10112 - DNA, 147 bp, homo sapiens; identical to SEQ ID NO: 7104

SEQ ID NO: 10113 - protein, 4 aa, homo sapiens
MFQL

SEQ ID NO: 10114 - DNA, 15 bp, homo sapiens
atgttccagctttga

SEQ ID NO: 10115 - protein, 12 aa, homo sapiens
MNFARVWQTQPQ

SEQ ID NO: 10116 - DNA, 39 bp, homo sapiens
atgaactttgccagggtctggcagactcaaccccagtag

SEQ ID NO: 10117 - protein, 84 aa, homo sapiens
MGTVCYVRIPLRWSSVPASQQPAPRGMSSAPPPCILQNLVYVPFFSVKSLLPKPKVISSSSDLASLGPRTAGRNADSQAPPQTS

SEQ ID NO: 10118 - DNA, 255 bp, homo sapiens
atgggcacagtttgctacgtacggatccctctccgctggtccagtgtgcctgcctcccagcagcctgcacctcgtgggatgtcatcagctccacctccatgtattcttcaaaaccttgtttatgttcccttcttttctgtgaagtctttgctacctaaacccaaggtcatttcttcttcctctgatctcgccagcctgggtccaagaacagctggtagaaatgcagattctcaggctccaccccagacatcctaa

SEQ ID NO: 10119 - protein, 19 aa, homo sapiens
MYSSKPCLCSLLFCEVFAT

SEQ ID NO: 10120 - DNA, 60 bp, homo sapiens
atgtattcttcaaaaccttgtttatgttcccttcttttctgtgaagtctttgctacctaa

SEQ ID NO: 10121 - protein, 96 aa, homo sapiens; identical to SEQ ID NO: 7179

SEQ ID NO: 10122 - DNA, 291 bp, homo sapiens; identical to SEQ ID NO: 7180

SEQ ID NO: 10123 - protein, 22 aa, homo sapiens
MLSFSPSPLLPGACLLNDVGGG

SEQ ID NO: 10124 - DNA, 69 bp, homo sapiens; identical to SEQ ID NO: 7182

SEQ ID NO: 10125 - protein, 41 aa, homo sapiens; identical to SEQ ID NO: 7183

SEQ ID NO: 10126 - DNA, 126 bp, homo sapiens; identical to SEQ ID NO: 7184

SEQ ID NO: 10127 - protein, 55 aa, homo sapiens; identical to SEQ ID NO: 8975

SEQ ID NO: 10128 - DNA, 168 bp, homo sapiens; identical to SEQ ID NO: 8976

SEQ ID NO: 10129 - protein, 20 aa, homo sapiens
MADFDTYDDRAYSSFGGGRG

SEQ ID NO: 10130 - DNA, 63 bp, homo sapiens; identical to SEQ ID NO: 7186

SEQ ID NO: 10131 - protein, 64 aa, homo sapiens; identical to SEQ ID NO: 7187

SEQ ID NO: 10132 - DNA, 195 bp, homo sapiens; identical to SEQ ID NO: 7188

SEQ ID NO: 10133 - protein, 15 aa, homo sapiens
MPGDERPLPAPSPLR

SEQ ID NO: 10134 - DNA, 48 bp, homo sapiens; identical to SEQ ID NO: 7190

SEQ ID NO: 10135 - protein, 13 aa, homo sapiens
MVRLLAGGGRPRR

SEQ ID NO: 10136 - DNA, 42 bp, homo sapiens; identical to SEQ ID NO: 7192

SEQ ID NO: 10137 - protein, 6 aa, homo sapiens
MWTFVL

SEQ ID NO: 10138 - DNA, 21 bp, homo sapiens
atgtggacttttgttctctaa

SEQ ID NO: 10139 - protein, 7 aa, homo sapiens
MTYQRGK

SEQ ID NO: 10140 - DNA, 24 bp, homo sapiens
atgacgtaccaaagaggaaaatag

SEQ ID NO: 10141 - protein, 21 aa, homo sapiens
MLCERVVCRSPSGLMDKALAS

SEQ ID NO: 10142 - DNA, 66 bp, homo sapiens; identical to SEQ ID NO: 8990

SEQ ID NO: 10143 - protein, 35 aa, homo sapiens; identical to SEQ ID NO: 8991

SEQ ID NO: 10144 - DNA, 108 bp, homo sapiens; identical to SEQ ID NO: 8992

SEQ ID NO: 10145 - protein, 18 aa, homo sapiens
MNFSVETAPPQSLFKKQK

SEQ ID NO: 10146 - DNA, 57 bp, homo sapiens; identical to SEQ ID NO: 9002

SEQ ID NO: 10147 - protein, 19 aa, homo sapiens
MPVDALTSKIFKGEVDTRY

SEQ ID NO: 10148 - DNA, 60 bp, homo sapiens; identical to SEQ ID NO: 1620

SEQ ID NO: 10149 - protein, 11 aa, homo sapiens
MSKPLGIIESP

SEQ ID NO: 10150 - DNA, 36 bp, homo sapiens; identical to SEQ ID NO: 1622

SEQ ID NO: 10151 - protein, 29 aa, homo sapiens
MGNERRKGKEMGWKEKSRRDRPIPVGLVP

SEQ ID NO: 10152 - DNA, 90 bp, homo sapiens; identical to SEQ ID NO: 1624

SEQ ID NO: 10153 - protein, 51 aa, homo sapiens; identical to SEQ ID NO: 7339

SEQ ID NO: 10154 - DNA, 156 bp, homo sapiens; identical to SEQ ID NO: 7340

SEQ ID NO: 10155 - protein, 25 aa, homo sapiens
MSRGFSPNQCPSLAFSTIFKHTFNI

SEQ ID NO: 10156 - DNA, 78 bp, homo sapiens; identical to SEQ ID NO: 7342

SEQ ID NO: 10157 - protein, 38 aa, homo sapiens; identical to SEQ ID NO: 7343

SEQ ID NO: 10158 - DNA, 117 bp, homo sapiens; identical to SEQ ID NO: 7344

SEQ ID NO: 10159 - protein, 8 aa, homo sapiens
MATYSSSV

SEQ ID NO: 10160 - DNA, 27 bp, homo sapiens
atggccacatactcttcatctgtgtaa

SEQ ID NO: 10161 - protein, 34 aa, homo sapiens; identical to SEQ ID NO: 7347

SEQ ID NO: 10162 - DNA, 105 bp, homo sapiens; identical to SEQ ID NO: 7348

SEQ ID NO: 10163 - protein, 7 aa, homo sapiens
MRGPLGV

SEQ ID NO: 10164 - DNA, 24 bp, homo sapiens
atgcgaggacccctcggggtctga

SEQ ID NO: 10165 - protein, 11 aa, homo sapiens
MNSLGFSARDF

SEQ ID NO: 10166 - DNA, 36 bp, homo sapiens; identical to SEQ ID NO: 7352

SEQ ID NO: 10167 - protein, 8 aa, homo sapiens
MPWANVYW

SEQ ID NO: 10168 - DNA, 27 bp, homo sapiens
atgccctgggcaaatgtttattggtga

SEQ ID NO: 10169 - protein, 24 aa, homo sapiens
MRVKKGRGLVRDTVWVVGVVGNAG

SEQ ID NO: 10170 - DNA, 75 bp, homo sapiens; identical to SEQ ID NO: 9026

SEQ ID NO: 10171 - protein, 13 aa, homo sapiens
MQVEGNSLGLWGI

SEQ ID NO: 10172 - DNA, 42 bp, homo sapiens; identical to SEQ ID NO: 9028

SEQ ID NO: 10173 - protein, 39 aa, homo sapiens; identical to SEQ ID NO: 9029

SEQ ID NO: 10174 - DNA, 120 bp, homo sapiens; identical to SEQ ID NO: 9030

SEQ ID NO: 10175 - protein, 27 aa, homo sapiens
MSLPASSWWPRQPVSEGCFVWGVGVIK

SEQ ID NO: 10176 - DNA, 84 bp, homo sapiens; identical to SEQ ID NO: 9032

SEQ ID NO: 10177 - protein, 154 aa, homo sapiens [sequence omitted]

SEQ ID NO: 10178 - DNA, 465 bp, homo sapiens; identical to SEQ ID NO: 7402

SEQ ID NO: 10179 - protein, 18 aa, homo sapiens
MDRPQRCRHPGTATADWT

SEQ ID NO: 10180 - DNA, 57 bp, homo sapiens; identical to SEQ ID NO: 7404

SEQ ID NO: 10181 - protein, 4 aa, homo sapiens
MRGK

SEQ ID NO: 10182 - DNA, 15 bp, homo sapiens
atgcggggcaaataa

SEQ ID NO: 10183 - protein, 7 aa, homo sapiens
MARKTVH

SEQ ID NO: 10184 - DNA, 24 bp, homo sapiens
atggctcgtaaaactgtccactaa

SEQ ID NO: 10185 - protein, 112 aa, homo sapiens [sequence omitted]

SEQ ID NO: 10186 - DNA, 339 bp, homo sapiens; identical to SEQ ID NO: 7414

SEQ ID NO: 10187 - protein, 60 aa, homo sapiens; identical to SEQ ID NO: 7415

SEQ ID NO: 10188 - DNA, 183 bp, homo sapiens; identical to SEQ ID NO: 7416

SEQ ID NO: 10189 - protein, 14 aa, homo sapiens
MATLVAGATGPCSG

SEQ ID NO: 10190 - DNA, 45 bp, homo sapiens; identical to SEQ ID NO: 9054

SEQ ID NO: 10191 - protein, 11 aa, homo sapiens
MDREWCVFLLP

SEQ ID NO: 10192 - DNA, 36 bp, homo sapiens; identical to SEQ ID NO: 9056

SEQ ID NO: 10193 - protein, 263 aa, homo sapiens [sequence omitted]

SEQ ID NO: 10194 - DNA, 792 bp, homo sapiens; identical to SEQ ID NO: 7420

SEQ ID NO: 10195 - protein, 33 aa, homo sapiens; identical to SEQ ID NO: 7421

SEQ ID NO: 10196 - DNA, 102 bp, homo sapiens; identical to SEQ ID NO: 7422

SEQ ID NO: 10197 - protein, 15 aa, homo sapiens
MKALESYGSAEEDTL

SEQ ID NO: 10198 - DNA, 48 bp, homo sapiens; identical to SEQ ID NO: 7424

SEQ ID NO: 10199 - protein, 23 aa, homo sapiens
MVYSEENDLVRCTSKNFLSRGLN

SEQ ID NO: 10200 - DNA, 72 bp, homo sapiens
atggtgtactcagaagaaaatgatttagtccgatgtacctctaaaaattttctttctagaggattaaactga

SEQ ID NO: 10201 - protein, 63 aa, homo sapiens; identical to SEQ ID NO: 7433

SEQ ID NO: 10202 - DNA, 192 bp, homo sapiens; identical to SEQ ID NO: 7434

SEQ ID NO: 10203 - protein, 28 aa, homo sapiens
MQCDPSGSVCRILCVRCDPHQGVTPILG

SEQ ID NO: 10204 - DNA, 87 bp, homo sapiens; identical to SEQ ID NO: 7436

SEQ ID NO: 10205 - protein, 6 aa, homo sapiens
MCNWDP

SEQ ID NO: 10206 - DNA, 21 bp, homo sapiens
atgtgcaactgggacccttga

SEQ ID NO: 10207 - protein, 6 aa, homo sapiens
MPGCAM

SEQ ID NO: 10208 - DNA, 21 bp, homo sapiens
atgcctggctgtgcgatgtga

SEQ ID NO: 10209 - protein, 61 aa, homo sapiens
MPVLLLMTLESSMRQSWPCVSLWRVTSMGSARSLMTLMSLSCSRETEIEALKEELLFMKKN

SEQ ID NO: 10210 - DNA, 186 bp, homo sapiens
atgcccgtcttactgctgatgaccttagagtcaagtatgagacagagctggccatgcgtcagtctgtggagagtgacatccatgggctctgcaaggtcattgatgacactaatgtcactcagctgtagcagggagacagagatcgaggctctcaaagaggagctgctcttcatgaagaagaactag

SEQ ID NO: 10211 - protein, 24 aa, homo sapiens
MRQSVESDIHGLCKVIDDTNVTQL

SEQ ID NO: 10212 - DNA, 75 bp, homo sapiens
atgcgtcagtctgtggagagtgacatccatgggctctgcaaggtcattgatgacactaatgtcactcagctgtag

SEQ ID NO: 10213 - protein, 59 aa, homo sapiens
MEIEAPKSQDLTKIMADIRPNTMSWLGRTERSWTSTGLSRLRRAPQWSSHSLLRLELLR

SEQ ID NO: 10214 - DNA, 180 bp, homo sapiens
atggagatagaagcccccaaatcgcaggacctcaccaagatcatggcagacattcggcccaatacgatgagctggctgggaagaaccgagagaagctggacaagtactggtctcagcagattgaggagagcaccacagtggtcatcacacagtctgctgaggttggagctgctgagatga

SEQ ID NO: 10215 - protein, 10 aa, homo sapiens
MTLTELRHTV

SEQ ID NO: 10216 - DNA, 33 bp, homo sapiens
atgacactcacggagctgagacatacagtctag

SEQ ID NO: 10217 - protein, 5 aa, homo sapiens
MEEGL

SEQ ID NO: 10218 - DNA, 18 bp, homo sapiens
atggaggagggattgtaa

SEQ ID NO: 10219 - protein, 9 aa, homo sapiens
MAAAGSSLL

SEQ ID NO: 10220 - DNA, 30 bp, homo sapiens; identical to SEQ ID NO: 7492

SEQ ID NO: 10221 - protein, 296 aa, homo sapiens [sequence omitted]

SEQ ID NO: 10222 - DNA, 891 bp, homo sapiens; identical to SEQ ID NO: 7494

SEQ ID NO: 10223 - protein, 23 aa, homo sapiens
MLPYSLGFSVVIPYLVTHQRFQH

SEQ ID NO: 10224 - DNA, 72 bp, homo sapiens; identical to SEQ ID NO: 7496

SEQ ID NO: 10225 - protein, 8 aa, homo sapiens
MAVLLKGL

SEQ ID NO: 10226 - DNA, 27 bp, homo sapiens
atggctgtgttgttgaagggcctgtag

SEQ ID NO: 10227 - protein, 96 aa, homo sapiens [sequence omitted]

SEQ ID NO: 10228 - DNA, 291 bp, homo sapiens; identical to SEQ ID NO: 7534

SEQ ID NO: 10229 - protein, 8 aa, homo sapiens
MLHERGLG

SEQ ID NO: 10230 - DNA, 27 bp, homo sapiens
atgctacacgagaggggcttaggatga

SEQ ID NO: 10231 - protein, 7 aa, homo sapiens
MSVGLLG

SEQ ID NO: 10232 - DNA, 24 bp, homo sapiens
atgtctgtggggctacttgggtga

SEQ ID NO: 10233 - protein, 60 aa, homo sapiens; identical to SEQ ID NO: 7551

SEQ ID NO: 10234 - DNA, 183 bp, homo sapiens; identical to SEQ ID NO: 7552

SEQ ID NO: 10235 - protein, 121 aa, homo sapiens; identical to SEQ ID NO: 9091

SEQ ID NO: 10236 - DNA, 366 bp, homo sapiens; identical to SEQ ID NO: 9092

SEQ ID NO: 10237 - protein, 11 aa, homo sapiens
MRPGGAVERGG

SEQ ID NO: 10238 - DNA, 36 bp, homo sapiens; identical to SEQ ID NO: 9094

SEQ ID NO: 10239 - protein, 11 aa, homo sapiens
MGRPPSAPSES

SEQ ID NO: 10240 - DNA, 36 bp, homo sapiens; identical to SEQ ID NO: 9096

SEQ ID NO: 10241 - protein, 143 aa, homo sapiens [sequence omitted]

SEQ ID NO: 10242 - DNA, 432 bp, homo sapiens; identical to SEQ ID NO: 1650

SEQ ID NO: 10243 - protein, 165 aa, homo sapiens [sequence omitted]

SEQ ID NO: 10244 - DNA, 498 bp, homo sapiens; identical to SEQ ID NO: 1652

SEQ ID NO: 10245 - protein, 13 aa, homo sapiens
MVFIPTWPPLDIP

SEQ ID NO: 10246 - DNA, 42 bp, homo sapiens; identical to SEQ ID NO: 1654

SEQ ID NO: 10247 - protein, 60 aa, homo sapiens; identical to SEQ ID NO: 1655

SEQ ID NO: 10248 - DNA, 183 bp, homo sapiens; identical to SEQ ID NO: 1656

SEQ ID NO: 10249 - protein, 19 aa, homo sapiens
MGRKKKKQLKPWCWYPLSV

SEQ ID NO: 10250 - DNA, 60 bp, homo sapiens; identical to SEQ ID NO: 7578

SEQ ID NO: 10251 - protein, 17 aa, homo sapiens
MGFRGRQAFAVVGRVTL

SEQ ID NO: 10252 - DNA, 54 bp, homo sapiens; identical to SEQ ID NO: 7580

SEQ ID NO: 10253 - protein, 58 aa, homo sapiens; identical to SEQ ID NO: 7581

SEQ ID NO: 10254 - DNA, 177 bp, homo sapiens; identical to SEQ ID NO: 7582

SEQ ID NO: 10255 - protein, 32 aa, homo sapiens; identical to SEQ ID NO: 7583

SEQ ID NO: 10256 - DNA, 99 bp, homo sapiens; identical to SEQ ID NO: 7584

SEQ ID NO: 10257 - protein, 121 aa, homo sapiens; identical to SEQ ID NO: 7609

SEQ ID NO: 10258 - DNA, 366 bp, homo sapiens; identical to SEQ ID NO: 7610

SEQ ID NO: 10259 - protein, 4 aa, homo sapiens
MWRV

SEQ ID NO: 10260 - DNA, 15 bp, homo sapiens
atgtggagggtatga

SEQ ID NO: 10261 - protein, 52 aa, homo sapiens; identical to SEQ ID NO: 7613

SEQ ID NO: 10262 - DNA, 159 bp, homo sapiens; identical to SEQ ID NO: 7614

SEQ ID NO: 10263 - protein, 157 aa, homo sapiens; identical to SEQ ID NO: 7615

SEQ ID NO: 10264 - DNA, 474 bp, homo sapiens; identical to SEQ ID NO: 7616

SEQ ID NO: 10265 - protein, 21 aa, homo sapiens
MSTFRQEDVEDHYEMGEELGR

SEQ ID NO: 10266 - DNA, 66 bp, homo sapiens; identical to SEQ ID NO: 9122

SEQ ID NO: 10267 - protein, 20 aa, homo sapiens
MRWGRSWAGELSARTAGLQG

SEQ ID NO: 10268 - DNA, 63 bp, homo sapiens; identical to SEQ ID NO: 9124

SEQ ID NO: 10269 - protein, 25 aa, homo sapiens
MLRRNESVSCGGGTNLGRGVRQPRL

SEQ ID NO: 10270 - DNA, 78 bp, homo sapiens; identical to SEQ ID NO: 9126

SEQ ID NO: 10271 - protein, 38 aa, homo sapiens; identical to SEQ ID NO: 9127

SEQ ID NO: 10272 - DNA, 117 bp, homo sapiens; identical to SEQ ID NO: 9128

SEQ ID NO: 10273 - protein, 70 aa, homo sapiens; identical to SEQ ID NO: 9129

SEQ ID NO: 10274 - DNA, 213 bp, homo sapiens; identical to SEQ ID NO: 9130

SEQ ID NO: 10275 - protein, 17 aa, homo sapiens
MKHYEVRSEKQGPCGHC

SEQ ID NO: 10276 - DNA, 54 bp, homo sapiens; identical to SEQ ID NO: 7642

SEQ ID NO: 10277 - protein, 41 aa, homo sapiens; identical to SEQ ID NO: 7643

SEQ ID NO: 10278 - DNA, 126 bp, homo sapiens; identical to SEQ ID NO: 7644

SEQ ID NO: 10279 - protein, 28 aa, homo sapiens
MGATKVRDPCSQSEGVLHKSCATPPSPA

SEQ ID NO: 10280 - DNA, 87 bp, homo sapiens; identical to SEQ ID NO: 7646

SEQ ID NO: 10281 - protein, 15 aa, homo sapiens
MGGGRAPPERLGGCR

SEQ ID NO: 10282 - DNA, 48 bp, homo sapiens; identical to SEQ ID NO: 7666

SEQ ID NO: 10283 - protein, 56 aa, homo sapiens; identical to SEQ ID NO: 7667

SEQ ID NO: 10284 - DNA, 171 bp, homo sapiens; identical to SEQ ID NO: 7668

SEQ ID NO: 10285 - protein, 85 aa, homo sapiens; identical to SEQ ID NO: 7669

SEQ ID NO: 10286 - DNA, 258 bp, homo sapiens; identical to SEQ ID NO: 7670

SEQ ID NO: 10287 - protein, 29 aa, homo sapiens
MLPQLWLGYITTALGEPCLERRGTQIRGL

SEQ ID NO: 10288 - DNA, 90 bp, homo sapiens; identical to SEQ ID NO: 7672

SEQ ID NO: 10289 - protein, 14 aa, homo sapiens
MSLSACFHLWLAAR

SEQ ID NO: 10290 - DNA, 45 bp, homo sapiens; identical to SEQ ID NO: 7674

SEQ ID NO: 10291 - protein, 21 aa, homo sapiens
MLGKGCSTYSGLYLPPAGKVL

SEQ ID NO: 10292 - DNA, 66 bp, homo sapiens; identical to SEQ ID NO: 7676

SEQ ID NO: 10293 - protein, 164 aa, homo sapiens [sequence omitted]

SEQ ID NO: 10294 - DNA, 495 bp, homo sapiens; identical to SEQ ID NO: 7678

SEQ ID NO: 10295 - protein, 24 aa, homo sapiens
MGVSSSPPGCGNSDGRFKYPTRGY

SEQ ID NO: 10296 - DNA, 75 bp, homo sapiens; identical to SEQ ID NO: 7680

SEQ ID NO: 10297 - protein, 16 aa, homo sapiens
MAWRYGATAAREFSFV

SEQ ID NO: 10298 - DNA, 51 bp, homo sapiens; identical to SEQ ID NO: 7682

SEQ ID NO: 10299 - protein, 54 aa, homo sapiens; identical to SEQ ID NO: 7683

SEQ ID NO: 10300 - DNA, 165 bp, homo sapiens; identical to SEQ ID NO: 7684

SEQ ID NO: 10301 - protein, 18 aa, homo sapiens
MWGAVQTLKSPHRSLHPE

SEQ ID NO: 10302 - DNA, 57 bp, homo sapiens; identical to SEQ ID NO: 7686

SEQ ID NO: 10303 - protein, 10 aa, homo sapiens
MRPVRVLKSP

SEQ ID NO: 10304 - DNA, 33 bp, homo sapiens; identical to SEQ ID NO: 7688

SEQ ID NO: 10305 - protein, 38 aa, homo sapiens; identical to SEQ ID NO: 7715

SEQ ID NO: 10306 - DNA, 117 bp, homo sapiens; identical to SEQ ID NO: 7716

SEQ ID NO: 10307 - protein, 47 aa, homo sapiens; identical to SEQ ID NO: 9171

SEQ ID NO: 10308 - DNA, 144 bp, homo sapiens; identical to SEQ ID NO: 9172

SEQ ID NO: 10309 - protein, 127 aa, homo sapiens; identical to SEQ ID NO: 7717

SEQ ID NO: 10310 - DNA, 384 bp, homo sapiens; identical to SEQ ID NO: 7718

SEQ ID NO: 10311 - protein, 45 aa, homo sapiens; identical to SEQ ID NO: 7719

SEQ ID NO: 10312 - DNA, 138 bp, homo sapiens; identical to SEQ ID NO: 7720

SEQ ID NO: 10313 - protein, 8 aa, homo sapiens
MRMNWVLS

SEQ ID NO: 10314 - DNA, 27 bp, homo sapiens
atgaggatgaactgggttttaagctga

SEQ ID NO: 10315 - protein, 49 aa, homo sapiens
MPFIPYLIARCTSQVRNPAPDCSSLIVSFSCAPGLEVLNLFYSVFNSLS

SEQ ID NO: 10316 - DNA, 150 bp, homo sapiens
atgccgttcattccatatttgattgccagatgtacttctcaggtcagaaatccagccccagattgttcaagtcttatagtgagtttttcttgtgctccaggtttagaagttttaaatctcttttatagtgtattcaacagcttgagttaa

SEQ ID NO: 10317 - protein, 32 aa, homo sapiens
MYFSGQKSSPRLFKSYSEFFLCSRFRSFKSLL

SEQ ID NO: 10318 - DNA, 99 bp, homo sapiens
atgtacttctcaggtcagaaatccagccccagattgttcaagtcttatagtgagtttttcttgtgctccaggtttagaagttttaaatctcttttatag

SEQ ID NO: 10319 - protein, 7 aa, homo sapiens
MVCVFLL

SEQ ID NO: 10320 - DNA, 24 bp, homo sapiens
atggtttgtgtgttcctcctgtaa

SEQ ID NO: 10321 - protein, 7 aa, homo sapiens
MEKPRLY

SEQ ID NO: 10322 - DNA, 24 bp, homo sapiens
atggagaaaccccgtctctactaa

SEQ ID NO: 10323 - protein, 24 aa, homo sapiens
MPVIPATREAEAGESLEPGRRRLR

SEQ ID NO: 10324 - DNA, 75 bp, homo sapiens; identical to SEQ ID NO: 9190

SEQ ID NO: 10325 - protein, 19 aa, homo sapiens
MLHKRWPASRVKEDSDTGA

SEQ ID NO: 10326 - DNA, 60 bp, homo sapiens; identical to SEQ ID NO: 9192

SEQ ID NO: 10327 - protein, 69 aa, homo sapiens
MAGFSREGRFGYGGLMDLVVGGLPAASKLFKRSDFTRLNLLGIKIEIWPGAMAHACNPYTLGGRGGWMI

SEQ ID NO: 10328 - DNA, 210 bp, homo sapiens
atggccggcttctcgcgtgaaggaagattcggatacgggggcctgatggatttagttgtaggcggtttgcctgcagcgagtaaattattcaaacgttcggacttcacaagactaaacttactggggataaaaattgagatttggccgggcgcgatggctcacgcctgtaatccctacactttgggaggccgaggcgggtggatgatctga

SEQ ID NO: 10329 - protein, 7 aa, homo sapiens
MEKPRLY

SEQ ID NO: 10330 - DNA, 24 bp, homo sapiens
atggagaaaccccgtctctactaa

SEQ ID NO: 10331 - protein, 24 aa, homo sapiens
MPVIPATREAEAGESLEPGRRRLR

SEQ ID NO: 10332 - DNA, 75 bp, homo sapiens; identical to SEQ ID NO: 9190

SEQ ID NO: 10333 - protein, 19 aa, homo sapiens
MLHKRWPASRVKEDSDTGA

SEQ ID NO: 10334 - DNA, 60 bp, homo sapiens; identical to SEQ ID NO: 9192

SEQ ID NO: 10335 - protein, 69 aa, homo sapiens; identical to SEQ ID NO: 10327

SEQ ID NO: 10336 - DNA, 210 bp, homo sapiens; identical to SEQ ID NO: 10328

SEQ ID NO: 10337 - protein, 70 aa, homo sapiens; identical to SEQ ID NO: 9219

SEQ ID NO: 10338 - DNA, 213 bp, homo sapiens; identical to SEQ ID NO: 9220

SEQ ID NO: 10339 - protein, 37 aa, homo sapiens; identical to SEQ ID NO: 9221

SEQ ID NO: 10340 - DNA, 114 bp, homo sapiens; identical to SEQ ID NO: 9222

SEQ ID NO: 10341 - protein, 8 aa, homo sapiens
MCVGRCLR

SEQ ID NO: 10342 - DNA, 27 bp, homo sapiens
atgtgtgttgggaggtgcttgcgctag

SEQ ID NO: 10343 - protein, 128 aa, homo sapiens
MVLGLFWAGGQIYEQARKGRRWLWWRLLRSALGRQVCRFIVPPRSPSFVFLTCSWPLGPTPARGVCACARGSGARGGWGLSRQGHAWLSVLRLHLAGKLGAAGGAERQRLSLPPPCSPRAAFTYGPLV

SEQ ID NO: 10344 - DNA, 387 bp, homo sapiens
atggtcctcggcctcttctgggccggagggcagatctacgagcaggcaagaaaggggcgccggtggctgtggtggcgacttctccgctctgccctcggccgccaagtgtgccgtttcatcgttccacctcgcagccccagctttgttttcctgacatgttcgtggccattgggccccacgcctgcgaggggagtgtgtgcgtgtgcgcgggggtcgggcgcgcgcggcgggtgggggctctcccgccaaggacacgcatggctgtctgtcctccggctgcacttggcgggaaagctaggggccgccggcggggctgagcgccagcggctgtcattaccgcctccctgctccccgcgggctgcatttacatacgggccactcgtctga

SEQ ID NO: 10345 - protein, 24 aa, homo sapiens
MYLIAKDFSTLFSYVFFNCKLLGF

SEQ ID NO: 10346 - DNA, 75 bp, homo sapiens; identical to SEQ ID NO: 8402

SEQ ID NO: 10347 - protein, 7 aa, homo sapiens
MDGINCC

SEQ ID NO: 10348 - DNA, 24 bp, homo sapiens
atggatggaattaattgctgttag

SEQ ID NO: 10349 - protein, 19 aa, homo sapiens
MELIAVRRLENSKYRFGRW

SEQ ID NO: 10350 - DNA, 60 bp, homo sapiens; identical to SEQ ID NO: 8406

SEQ ID NO: 10351 - protein, 18 aa, homo sapiens
MFYLFFPYFSLFQSYTWT

SEQ ID NO: 10352 - DNA, 57 bp, homo sapiens; identical to SEQ ID NO: 8408

SEQ ID NO: 10353 - protein, 74 aa, homo sapiens [sequence omitted]

SEQ ID NO: 10354 - DNA, 225 bp, homo sapiens; identical to SEQ ID NO: 9354

SEQ ID NO: 10355 - protein, 43 aa, homo sapiens; identical to SEQ ID NO: 9355

SEQ ID NO: 10356 - DNA, 132 bp, homo sapiens; identical to SEQ ID NO: 9356

SEQ ID NO: 10357 - protein, 109 aa, homo sapiens; identical to SEQ ID NO: 9357

SEQ ID NO: 10358 - DNA, 330 bp, homo sapiens; identical to SEQ ID NO: 9358

SEQ ID NO: 10359 - protein, 38 aa, homo sapiens; identical to SEQ ID NO: 9359

SEQ ID NO: 10360 - DNA, 117 bp, homo sapiens; identical to SEQ ID NO: 9360

SEQ ID NO: 10361 - protein, 39 aa, homo sapiens; identical to SEQ ID NO: 9241

SEQ ID NO: 10362 - DNA, 120 bp, homo sapiens; identical to SEQ ID NO: 9242

SEQ ID NO: 10363 - protein, 73 aa, homo sapiens; identical to SEQ ID NO: 9243

SEQ ID NO: 10364 - DNA, 222 bp, homo sapiens; identical to SEQ ID NO: 9244

SEQ ID NO: 10365 - protein, 19 aa, homo sapiens
MGFTDTELSFGEQSGIGDR

SEQ ID NO: 10366 - DNA, 60 bp, homo sapiens; identical to SEQ ID NO: 9246

SEQ ID NO: 10367 - protein, 36 aa, homo sapiens [sequence omitted]

SEQ ID NO: 10368 - DNA, 111 bp, homo sapiens; identical to SEQ ID NO: 9248

SEQ ID NO: 10369 - protein, 17 aa, homo sapiens
MANGWTGSRPGRRNPEL

SEQ ID NO: 10370 - DNA, 54 bp, homo sapiens; identical to SEQ ID NO: 3920

SEQ ID NO: 10371 - protein, 51 aa, homo sapiens; identical to SEQ ID NO: 8235

SEQ ID NO: 10372 - DNA, 156 bp, homo sapiens; identical to SEQ ID NO: 8236

SEQ ID NO: 10373 - protein, 6 aa, homo sapiens
MCFFVY

SEQ ID NO: 10374 - DNA, 21 bp, homo sapiens
atgtgcttctttgtttactaa

SEQ ID NO: 10375 - protein, 21 aa, homo sapiens
MLDGPVHCHGLFILRWLETDL

SEQ ID NO: 10376 - DNA, 66 bp, homo sapiens; identical to SEQ ID NO: 8240

SEQ ID NO: 10377 - protein, 54 aa, homo sapiens; identical to SEQ ID NO: 337

SEQ ID NO: 10378 - DNA, 165 bp, homo sapiens; identical to SEQ ID NO: 338

SEQ ID NO: 10379 - protein, 146 aa, homo sapiens; identical to SEQ ID NO: 339

SEQ ID NO: 10380 - DNA, 441 bp, homo sapiens; identical to SEQ ID NO: 340

SEQ ID NO: 10381 - protein, 83 aa, homo sapiens; identical to SEQ ID NO: 341

SEQ ID NO: 10382 - DNA, 252 bp, homo sapiens; identical to SEQ ID NO: 342

SEQ ID NO: 10383 - protein, 8 aa, homo sapiens
MGTESADL

SEQ ID NO: 10384 - DNA, 27 bp, homo sapiens
atgggcaccgagtcggcggatctctga

SEQ ID NO: 10385 - protein, 50 aa, homo sapiens [sequence omitted]

SEQ ID NO: 10386 - DNA, 153 bp, homo sapiens; identical to SEQ ID NO: 38

SEQ ID NO: 10387 - protein, 48 aa, homo sapiens; identical to SEQ ID NO: 8163

SEQ ID NO: 10388 - DNA, 147 bp, homo sapiens; identical to SEQ ID NO: 8164

SEQ ID NO: 10389 - protein, 13 aa, homo sapiens
MGAGAGRIVAGRD

SEQ ID NO: 10390 - DNA, 42 bp, homo sapiens; identical to SEQ ID NO: 40

SEQ ID NO: 10391 - protein, 109 aa, homo sapiens; identical to SEQ ID NO: 8167

SEQ ID NO: 10392 - DNA, 330 bp, homo sapiens; identical to SEQ ID NO: 8168

SEQ ID NO: 10393 - protein, 13 aa, homo sapiens
MPLLPAAKCSLPS

SEQ ID NO: 10394 - DNA, 42 bp, homo sapiens; identical to SEQ ID NO: 8

SEQ ID NO: 10395 - protein, 15 aa, homo sapiens
MSLASNALRSFNFLQ

SEQ ID NO: 10396 - DNA, 48 bp, homo sapiens; identical to SEQ ID NO: 8134

SEQ ID NO: 10397 - protein, 29 aa, homo sapiens
MPFGLSTFYSRFCVRGNGMYSSTYRFLKN

SEQ ID NO: 10398 - DNA, 90 bp, homo sapiens; identical to SEQ ID NO: 8136

SEQ ID NO: 10399 - protein, 10 aa, homo sapiens
MVCILQLTGF

SEQ ID NO: 10400 - DNA, 33 bp, homo sapiens; identical to SEQ ID NO: 9294

SEQ ID NO: 10401 - protein, 40 aa, homo sapiens
MSEPVSDGYSCADFCHSLAASSARSCAWHKCKYACYTPGL

SEQ ID NO: 10402 - DNA, 123 bp, homo sapiens
atgagcgagcctgtttctgatggctacagctgtgcagatttctgccacagccttgctgcttcaagtgcacgatcctgtgcgtggcacaagtgtaaatatgcctgttacacgcctgggttataa

SEQ ID NO: 10403 - protein, 73 aa, homo sapiens [sequence omitted]

SEQ ID NO: 10404 - DNA, 222 bp, homo sapiens; identical to SEQ ID NO: 8138

SEQ ID NO: 10405 - protein, 12 aa, homo sapiens
MNIKLLGKNPDF

SEQ ID NO: 10406 - DNA, 39 bp, homo sapiens; identical to SEQ ID NO: 8140

SEQ ID NO: 10407 - protein, 15 aa, homo sapiens
MLDFMWLGLLQGRRP

SEQ ID NO: 10408 - DNA, 48 bp, homo sapiens; identical to SEQ ID NO: 8142

SEQ ID NO: 10409 - protein, 13 aa, homo sapiens
MLPQLMVHQLSLA

SEQ ID NO: 10410 - DNA, 42 bp, homo sapiens; identical to SEQ ID NO: 8146

SEQ ID NO: 10411 - protein, 18 aa, homo sapiens
MFQDPFKNIILNVIFSSH

SEQ ID NO: 10412 - DNA, 57 bp, homo sapiens; identical to SEQ ID NO: 8148

SEQ ID NO: 10413 - protein, 52 aa, homo sapiens [sequence omitted]

SEQ ID NO: 10414 - DNA, 159 bp, homo sapiens; identical to SEQ ID NO: 8150

SEQ ID NO: 10415 - protein, 17 aa, homo sapiens
MPNPNLFSAFATSLCKT

SEQ ID NO: 10416 - DNA, 54 bp, homo sapiens; identical to SEQ ID NO: 8152

SEQ ID NO: 10417 - protein, 13 aa, homo sapiens
MPLLPAAKCSLPS

SEQ ID NO: 10418 - DNA, 42 bp, homo sapiens; identical to SEQ ID NO: 8

SEQ ID NO: 10419 - protein, 15 aa, homo sapiens
MSLASNALRSFNFLQ

SEQ ID NO: 10420 - DNA, 48 bp, homo sapiens; identical to SEQ ID NO: 8134

SEQ ID NO: 10421 - protein, 29 aa, homo sapiens
MPFGLSTFYSRFCVRGNGMYSSTYRFLKN

SEQ ID NO: 10422 - DNA, 90 bp, homo sapiens; identical to SEQ ID NO: 8136

SEQ ID NO: 10423 - protein, 10 aa, homo sapiens
MVCILQLTGF

SEQ ID NO: 10424 - DNA, 33 bp, homo sapiens; identical to SEQ ID NO: 9294

SEQ ID NO: 10425 - protein, 50 aa, homo sapiens [sequence omitted]

SEQ ID NO: 10426 - DNA, 153 bp, homo sapiens; identical to SEQ ID NO: 38

SEQ ID NO: 10427 - protein, 48 aa, homo sapiens; identical to SEQ ID NO: 8163

SEQ ID NO: 10428 - DNA, 147 bp, homo sapiens; identical to SEQ ID NO: 8164

SEQ ID NO: 10429 - protein, 13 aa, homo sapiens
MGAGAGRIVAGRD

SEQ ID NO: 10430 - DNA, 42 bp, homo sapiens; identical to SEQ ID NO: 40

SEQ ID NO: 10431 - protein, 109 aa, homo sapiens; identical to SEQ ID NO: 8167

SEQ ID NO: 10432 - DNA, 330 bp, homo sapiens; identical to SEQ ID NO: 8168

SEQ ID NO: 10433 - protein, 13 aa, homo sapiens
MPLLPAAKCSLPS

SEQ ID NO: 10434 - DNA, 42 bp, homo sapiens; identical to SEQ ID NO: 8

SEQ ID NO: 10435 - protein, 15 aa, homo sapiens
MSLASNALRSFNFLQ

SEQ ID NO: 10436 - DNA, 48 bp, homo sapiens; identical to SEQ ID NO: 8134

SEQ ID NO: 10437 - protein, 29 aa, homo sapiens
MPFGLSTFYSRFCVRGNGMYSSTYRFLKN

SEQ ID NO: 10438 - DNA, 90 bp, homo sapiens; identical to SEQ ID NO: 8136

SEQ ID NO: 10439 - protein, 10 aa, homo sapiens
MVCILQLTGF

SEQ ID NO: 10440 - DNA, 33 bp, homo sapiens; identical to SEQ ID NO: 9294

SEQ ID NO: 10441 - protein, 54 aa, homo sapiens; identical to SEQ ID NO: 3817

SEQ ID NO: 10442 - DNA, 165 bp, homo sapiens; identical to SEQ ID NO: 3818

SEQ ID NO: 10443 - protein, 69 aa, homo sapiens; identical to SEQ ID NO: 3819

SEQ ID NO: 10444 - DNA, 210 bp, homo sapiens; identical to SEQ ID NO: 3820

SEQ ID NO: 10445 - protein, 21 aa, homo sapiens
MSSVSFERYASLAKPHLDLDL

SEQ ID NO: 10446 - DNA, 66 bp, homo sapiens; identical to SEQ ID NO: 3822

SEQ ID NO: 10447 - protein, 106 aa, homo sapiens; identical to SEQ ID NO: 3823

SEQ ID NO: 10448 - DNA, 321 bp, homo sapiens; identical to SEQ ID NO: 3824

SEQ ID NO: 10449 - protein, 70 aa, homo sapiens [sequence omitted]

SEQ ID NO: 10450 - DNA, 213 bp, homo sapiens; identical to SEQ ID NO: 3828

SEQ ID NO: 10451 - protein, 80 aa, homo sapiens [sequence omitted]

SEQ ID NO: 10452 - DNA, 243 bp, homo sapiens; identical to SEQ ID NO: 3830

SEQ ID NO: 10453 - protein, 31 aa, homo sapiens; identical to SEQ ID NO: 3831

SEQ ID NO: 10454 - DNA, 96 bp, homo sapiens; identical to SEQ ID NO: 3832

SEQ ID NO: 10455 - protein, 16 aa, homo sapiens
MHFKGWERAKPLDSFS

SEQ ID NO: 10456 - DNA, 51 bp, homo sapiens; identical to SEQ ID NO: 8200

SEQ ID NO: 10457 - protein, 40 aa, homo sapiens; identical to SEQ ID NO: 10401

SEQ ID NO: 10458 - DNA, 123 bp, homo sapiens; identical to SEQ ID NO: 10402

SEQ ID NO: 10459 - protein, 73 aa, homo sapiens [sequence omitted]

SEQ ID NO: 10460 - DNA, 222 bp, homo sapiens; identical to SEQ ID NO: 8138

SEQ ID NO: 10461 - protein, 12 aa, homo sapiens
MNIKLLGKNPDF

SEQ ID NO: 10462 - DNA, 39 bp, homo sapiens; identical to SEQ ID NO: 8140

SEQ ID NO: 10463 - protein, 15 aa, homo sapiens
MLDFMWLGLLQGRRP

SEQ ID NO: 10464 - DNA, 48 bp, homo sapiens; identical to SEQ ID NO: 8142

SEQ ID NO: 10465 - protein, 67 aa, homo sapiens; identical to SEQ ID NO: 8209

SEQ ID NO: 10466 - DNA, 204 bp, homo sapiens; identical to SEQ ID NO: 8210

SEQ ID NO: 10467 - protein, 28 aa, homo sapiens
MLRTRFSPAPARVQGAGVGPLPSGGDCK

SEQ ID NO: 10468 - DNA, 87 bp, homo sapiens; identical to SEQ ID NO: 8212

SEQ ID NO: 10469 - protein, 4 aa, homo sapiens
MLFT

SEQ ID NO: 10470 - DNA, 15 bp, homo sapiens
atgttgtttacatga

SEQ ID NO: 10471 - protein, 8 aa, homo sapiens
MKDPAGGV

SEQ ID NO: 10472 - DNA, 27 bp, homo sapiens
atgaaggatccggcgggaggagtctaa

SEQ ID NO: 10473 - protein, 27 aa, homo sapiens
MKIKDAKKPCKTGAGARQVGRAPLGPV

SEQ ID NO: 10474 - DNA, 84 bp, homo sapiens; identical to SEQ ID NO: 8218

SEQ ID NO: 10475 - protein, 51 aa, homo sapiens; identical to SEQ ID NO: 8219

SEQ ID NO: 10476 - DNA, 156 bp, homo sapiens; identical to SEQ ID NO: 8220

SEQ ID NO: 10477 - protein, 24 aa, homo sapiens
MGAEGPFEPRVRGFRPPHPPIHAW

SEQ ID NO: 10478 - DNA, 75 bp, homo sapiens; identical to SEQ ID NO: 8222

SEQ ID NO: 10479 - protein, 43 aa, homo sapiens; identical to SEQ ID NO: 8223

SEQ ID NO: 10480 - DNA, 132 bp, homo sapiens; identical to SEQ ID NO: 8224

SEQ ID NO: 10481 - protein, 39 aa, homo sapiens; identical to SEQ ID NO: 8225

SEQ ID NO: 10482 - DNA, 120 bp, homo sapiens; identical to SEQ ID NO: 8226

SEQ ID NO: 10483 - protein, 26 aa, homo sapiens
MLNSILIVRLKLRHHFILQSAVGLWP

SEQ ID NO: 10484 - DNA, 81 bp, homo sapiens; identical to SEQ ID NO: 96

SEQ ID NO: 10485 - protein, 32 aa, homo sapiens; identical to SEQ ID NO: 8229

SEQ ID NO: 10486 - DNA, 99 bp, homo sapiens; identical to SEQ ID NO: 8230

SEQ ID NO: 10487 - protein, 4 aa, homo sapiens
MCRE

SEQ ID NO: 10488 - DNA, 15 bp, homo sapiens
atgtgcagagagtaa

SEQ ID NO: 10489 - protein, 17 aa, homo sapiens
MANGWTGSRPGRRNPEL

SEQ ID NO: 10490 - DNA, 54 bp, homo sapiens; identical to SEQ ID NO: 3920

SEQ ID NO: 10491 - protein, 51 aa, homo sapiens; identical to SEQ ID NO: 8235

SEQ ID NO: 10492 - DNA, 156 bp, homo sapiens; identical to SEQ ID NO: 8236

SEQ ID NO: 10493 - protein, 6 aa, homo sapiens
MCFFVY

SEQ ID NO: 10494 - DNA, 21 bp, homo sapiens
atgtgcttctttgtttactaa

SEQ ID NO: 10495 - protein, 21 aa, homo sapiens
MLDGPVHCHGLFILRWLETDL

SEQ ID NO: 10496 - DNA, 66 bp, homo sapiens; identical to SEQ ID NO: 8240

SEQ ID NO: 10497 - protein, 33 aa, homo sapiens; identical to SEQ ID NO: 2553

SEQ ID NO: 10498 - DNA, 102 bp, homo sapiens; identical to SEQ ID NO: 2554

SEQ ID NO: 10499 - protein, 36 aa, homo sapiens; identical to SEQ ID NO: 2555

SEQ ID NO: 10500 - DNA, 111 bp, homo sapiens; identical to SEQ ID NO: 2556

SEQ ID NO: 10501 - protein, 33 aa, homo sapiens; identical to SEQ ID NO: 2557

SEQ ID NO: 10502 - DNA, 102 bp, homo sapiens; identical to SEQ ID NO: 2558

SEQ ID NO: 10503 - protein, 84 aa, homo sapiens; identical to SEQ ID NO: 2559

SEQ ID NO: 10504 - DNA, 255 bp, homo sapiens; identical to SEQ ID NO: 2560

SEQ ID NO: 10505 - protein, 40 aa, homo sapiens; identical to SEQ ID NO: 3939

SEQ ID NO: 10506 - DNA, 123 bp, homo sapiens; identical to SEQ ID NO: 3940

SEQ ID NO: 10507 - protein, 8 aa, homo sapiens
MESPSILP

SEQ ID NO: 10508 - DNA, 27 bp, homo sapiens
atggagagcccctcaatcctaccctag

SEQ ID NO: 10509 - protein, 9 aa, homo sapiens
MCLVFESRL

SEQ ID NO: 10510 - DNA, 30 bp, homo sapiens; identical to SEQ ID NO: 3944

SEQ ID NO: 10511 - protein, 5 aa, homo sapiens
MLVNF

SEQ ID NO: 10512 - DNA, 18 bp, homo sapiens
atgctggttaatttctag

SEQ ID NO: 10513 - protein, 50 aa, homo sapiens [sequence omitted]

SEQ ID NO: 10514 - DNA, 153 bp, homo sapiens; identical to SEQ ID NO: 38

SEQ ID NO: 10515 - protein, 48 aa, homo sapiens; identical to SEQ ID NO: 8163

SEQ ID NO: 10516 - DNA, 147 bp, homo sapiens; identical to SEQ ID NO: 8164

SEQ ID NO: 10517 - protein, 13 aa, homo sapiens
MGAGAGRIVAGRD

SEQ ID NO: 10518 - DNA, 42 bp, homo sapiens; identical to SEQ ID NO: 40

SEQ ID NO: 10519 - protein, 109 aa, homo sapiens; identical to SEQ ID NO: 8167

SEQ ID NO: 10520 - DNA, 330 bp, homo sapiens; identical to SEQ ID NO: 8168

SEQ ID NO: 10521 - protein, 81 aa, homo sapiens [sequence omitted]

SEQ ID NO: 10522 - DNA, 246 bp, homo sapiens; identical to SEQ ID NO: 4046

SEQ ID NO: 10523 - protein, 4 aa, homo sapiens
MGVV

SEQ ID NO: 10524 - DNA, 15 bp, homo sapiens
atgggggtggtataa

SEQ ID NO: 10525 - protein, 30 aa, homo sapiens; identical to SEQ ID NO: 8269

SEQ ID NO: 10526 - DNA, 93 bp, homo sapiens; identical to SEQ ID NO: 8270

SEQ ID NO: 10527 - protein, 23 aa, homo sapiens
MGNQMINRKRSYIMMHYIMEQNI

SEQ ID NO: 10528 - DNA, 72 bp, homo sapiens; identical to SEQ ID NO: 8272

SEQ ID NO: 10529 - protein, 6 aa, homo sapiens
MPVTYS

SEQ ID NO: 10530 - DNA, 21 bp, homo sapiens
atgcctgtgacctacagctga

SEQ ID NO: 10531 - protein, 9 aa, homo sapiens
MHFDLYLSM

SEQ ID NO: 10532 - DNA, 30 bp, homo sapiens; identical to SEQ ID NO: 8276

SEQ ID NO: 10533 - protein, 12 aa, homo sapiens
MHQLFKVIGLRK

SEQ ID NO: 10534 - DNA, 39 bp, homo sapiens; identical to SEQ ID NO: 8278

SEQ ID NO: 10535 - protein, 97 aa, homo sapiens [sequence omitted]

SEQ ID NO: 10536 - DNA, 294 bp, homo sapiens; identical to SEQ ID NO: 8280

SEQ ID NO: 10537 - protein, 9 aa, homo sapiens
MSLFSPAPS

SEQ ID NO: 10538 - DNA, 30 bp, homo sapiens; identical to SEQ ID NO: 8282

SEQ ID NO: 10539 - protein, 49 aa, homo sapiens; identical to SEQ ID NO: 8283

SEQ ID NO: 10540 - DNA, 150 bp, homo sapiens; identical to SEQ ID NO: 8284

SEQ ID NO: 10541 - protein, 77 aa, homo sapiens; identical to SEQ ID NO: 8285

SEQ ID NO: 10542 - DNA, 234 bp, homo sapiens; identical to SEQ ID NO: 8286

SEQ ID NO: 10543 - protein, 46 aa, homo sapiens; identical to SEQ ID NO: 8287

SEQ ID NO: 10544 - DNA, 141 bp, homo sapiens; identical to SEQ ID NO: 8288

SEQ ID NO: 10545 - protein, 9 aa, homo sapiens
MLEKNPECI

SEQ ID NO: 10546 - DNA, 30 bp, homo sapiens; identical to SEQ ID NO: 8292

SEQ ID NO: 10547 - protein, 40 aa, homo sapiens; identical to SEQ ID NO: 8293

SEQ ID NO: 10548 - DNA, 123 bp, homo sapiens; identical to SEQ ID NO: 8294

SEQ ID NO: 10549 - protein, 14 aa, homo sapiens
MDWTGALPHPPIHG

SEQ ID NO: 10550 - DNA, 45 bp, homo sapiens; identical to SEQ ID NO: 8296

SEQ ID NO: 10551 - protein, 85 aa, homo sapiens
MVELPALRVLGVVGSPLLAAGALTRLHYCALRSSAMILSKHLGPALGISLPITLTSHSPGRAPWACRPSPPPYPIRSLLHGNLRF

SEQ ID NO: 10552 - DNA, 258 bp, homo sapiens
atggttgagcttcccgccctgcgtgtattgggggtggtggggtcccccctgctggccgcaggtgctctgacgaggttgcactactgtgctctgagaagcagtgcaatgatattgtcaaagcatctgggaccagccttggggatctccctccctataaccctcacctcccactccccaggcagggccccttgggcttgcaggccctcccctcccccctacccaattcgctcccttctccatggaaacttgagattctag

SEQ ID NO: 10553 - protein, 14 aa, homo sapiens
MALCRAWVWGSGGP

SEQ ID NO: 10554 - DNA, 45 bp, homo sapiens; identical to SEQ ID NO: 4170

SEQ ID NO: 10555 - protein, 80 aa, homo sapiens [sequence omitted]

SEQ ID NO: 10556 - DNA, 243 bp, homo sapiens; identical to SEQ ID NO: 4172

SEQ ID NO: 10557 - protein, 80 aa, homo sapiens [sequence omitted]

SEQ ID NO: 10558 - DNA, 243 bp, homo sapiens; identical to SEQ ID NO: 4174

SEQ ID NO: 10559 - protein, 52 aa, homo sapiens; identical to SEQ ID NO: 4175

SEQ ID NO: 10560 - DNA, 159 bp, homo sapiens; identical to SEQ ID NO: 4176

SEQ ID NO: 10561 - protein, 5 aa, homo sapiens
MTLCC

SEQ ID NO: 10562 - DNA, 18 bp, homo sapiens
atgactctttgttgttaa

SEQ ID NO: 10563 - protein, 8 aa, homo sapiens
MISKSWVH

SEQ ID NO: 10564 - DNA, 27 bp, homo sapiens
atgatttctaagagctgggtccactag

SEQ ID NO: 10565 - protein, 36 aa, homo sapiens
MCNVLISLILFLSLIGRIWFSLILLLPGIGALTGNC

SEQ ID NO: 10566 - DNA, 111 bp, homo sapiens
atgtgcaatgtacttatttctcttatcctgttcttaagcttgattgggaggatttggttttcgcttattctcttactgcctggaataggagctttaactggaaattgctga

SEQ ID NO: 10567 - protein, 9 aa, homo sapiens
MYLFLLSCS

SEQ ID NO: 10568 - DNA, 30 bp, homo sapiens
atgtacttatttctcttatcctgttcttaa

SEQ ID NO: 10569 - protein, 38 aa, homo sapiens; identical to SEQ ID NO: 8297

SEQ ID NO: 10570 - DNA, 117 bp, homo sapiens; identical to SEQ ID NO: 8298

SEQ ID NO: 10571 - protein, 14 aa, homo sapiens
MQTQLLSSANLQSN

SEQ ID NO: 10572 - DNA, 45 bp, homo sapiens; identical to SEQ ID NO: 8300

SEQ ID NO: 10573 - protein, 66 aa, homo sapiens; identical to SEQ ID NO: 8301

SEQ ID NO: 10574 - DNA, 201 bp, homo sapiens; identical to SEQ ID NO: 8302

SEQ ID NO: 10575 - protein, 20 aa, homo sapiens
MQLCQRLPALDWISTILFLY

SEQ ID NO: 10576 - DNA, 63 bp, homo sapiens; identical to SEQ ID NO: 8304

SEQ ID NO: 10577 - protein, 60 aa, homo sapiens
MPGLLPASATLAHLHPRTASSPSLCLFQNSLGPSVRRVLFWFFCKNQNKKQRLLRGADAT

SEQ ID NO: 10578 - DNA, 183 bp, homo sapiens
atgccagggctgctccctgcctccgccaccctggcacaccttcacccgcgtaccgcctcctccccgtcgctctgccttttccaaaactcacttgggccctccgtgcgcagggttcttttttggtttttctgtaaaaatcaaaacaaaaaacagagacttttgagaggagcagatgccacctaa

SEQ ID NO: 10579 - protein, 26 aa, homo sapiens
MPPKVPLHSLQSAQMWKPVIGIFIFY

SEQ ID NO: 10580 - DNA, 81 bp, homo sapiens
atgccacctaaagtcccactgcattccctgcaaagcgctcaaatgtggaagccagtcattggcatttttattttttattga

SEQ ID NO: 10581 - protein, 98 aa, homo sapiens
MIPWAPSLLAGVSTEFSSWPLAFRQPRCSVLSSRVSSFPVPVPLFSISPLSSTLSGHAPPEQLQVMELGSWESNQAPPNHCSIHPPSLKECDPKKRCP

SEQ ID NO: 10582 - DNA, 297 bp, homo sapiens
atgatcccctgggccccctccctcctggctggggtaagtactgagttctcttcctggcccttggccttccgtcagccacggtgctctgtcctctcctcccgcgtgtcttccttccctgttcctgtccctctgttttccatctctcccctctccagcacactctctgggcatgccccaccagagcaattacaggtgatggagctgggcagctgggaaagtaaccaagctccaccgaaccactgtagcatccacccaccatcgctaaaggagtgtgaccctaagaaaagatgtccctga

SEQ ID NO: 10583 - protein, 8 aa, homo sapiens
MPHQSNYR

SEQ ID NO: 10584 - DNA, 27 bp, homo sapiens
atgccccaccagagcaattacaggtga

SEQ ID NO: 10585 - protein, 18 aa, homo sapiens
MGARDLQLFRRDPGPEAA

SEQ ID NO: 10586 - DNA, 57 bp, homo sapiens; identical to SEQ ID NO: 4230

SEQ ID NO: 10587 - protein, 39 aa, homo sapiens; identical to SEQ ID NO: 4231

SEQ ID NO: 10588 - DNA, 120 bp, homo sapiens; identical to SEQ ID NO: 4232

SEQ ID NO: 10589 - protein, 48 aa, homo sapiens; identical to SEQ ID NO: 8309

SEQ ID NO: 10590 - DNA, 147 bp, homo sapiens; identical to SEQ ID NO: 8310

SEQ ID NO: 10591 - protein, 15 aa, homo sapiens
MAPGWVLSAVTFREP

SEQ ID NO: 10592 - DNA, 48 bp, homo sapiens; identical to SEQ ID NO: 8312

SEQ ID NO: 10593 - protein, 43 aa, homo sapiens; identical to SEQ ID NO: 4273

SEQ ID NO: 10594 - DNA, 132 bp, homo sapiens; identical to SEQ ID NO: 4274

SEQ ID NO: 10595 - protein, 7 aa, homo sapiens
MLFLQDA

SEQ ID NO: 10596 - DNA, 24 bp, homo sapiens
atgctctttctccaagacgcttga

SEQ ID NO: 10597 - protein, 41 aa, homo sapiens; identical to SEQ ID NO: 275

SEQ ID NO: 10598 - DNA, 126 bp, homo sapiens; identical to SEQ ID NO: 276

SEQ ID NO: 10599 - protein, 5 aa, homo sapiens
MDRRQ

SEQ ID NO: 10600 - DNA, 18 bp, homo sapiens
atggacaggagacagtag

SEQ ID NO: 10601 - protein, 4 aa, homo sapiens
MGCP

SEQ ID NO: 10602 - DNA, 15 bp, homo sapiens
atggggtgcccctga

SEQ ID NO: 10603 - protein, 50 aa, homo sapiens; identical to SEQ ID NO: 8331

SEQ ID NO: 10604 - DNA, 153 bp, homo sapiens; identical to SEQ ID NO: 8332

SEQ ID NO: 10605 - protein, 63 aa, homo sapiens; identical to SEQ ID NO: 8333

SEQ ID NO: 10606 - DNA, 192 bp, homo sapiens; identical to SEQ ID NO: 8334

SEQ ID NO: 10607 - protein, 8 aa, homo sapiens
MALSPLPS

SEQ ID NO: 10608 - DNA, 27 bp, homo sapiens
atggccctgagccccctcccctcttaa

SEQ ID NO: 10609 - protein, 77 aa, homo sapiens [sequence omitted]

SEQ ID NO: 10610 - DNA, 234 bp, homo sapiens; identical to SEQ ID NO: 298

SEQ ID NO: 10611 - protein, 7 aa, homo sapiens
MWGEGVC

SEQ ID NO: 10612 - DNA, 24 bp, homo sapiens
atgtggggggagggggtctgctag

SEQ ID NO: 10613 - protein, 130 aa, homo sapiens; identical to SEQ ID NO: 301

SEQ ID NO: 10614 - DNA, 393 bp, homo sapiens; identical to SEQ ID NO: 302

SEQ ID NO: 10615 - protein, 35 aa, homo sapiens; identical to SEQ ID NO: 303

SEQ ID NO: 10616 - DNA, 108 bp, homo sapiens; identical to SEQ ID NO: 304

SEQ ID NO: 10617 - protein, 38 aa, homo sapiens; identical to SEQ ID NO: 4343

SEQ ID NO: 10618 - DNA, 117 bp, homo sapiens; identical to SEQ ID NO: 4344

SEQ ID NO: 10619 - protein, 9 aa, homo sapiens
MDSLGYTDL

SEQ ID NO: 10620 - DNA, 30 bp, homo sapiens; identical to SEQ ID NO: 9444

SEQ ID NO: 10621 - protein, 14 aa, homo sapiens
MFCRYRLLLMVSQV

SEQ ID NO: 10622 - DNA, 45 bp, homo sapiens; identical to SEQ ID NO: 9446

SEQ ID NO: 10623 - protein, 22 aa, homo sapiens
MDCGIFFLDSLFCSPFLYPFRP

SEQ ID NO: 10624 - DNA, 69 bp, homo sapiens; identical to SEQ ID NO: 9448

SEQ ID NO: 10625 - protein, 57 aa, homo sapiens; identical to SEQ ID NO: 4345

SEQ ID NO: 10626 - DNA, 174 bp, homo sapiens; identical to SEQ ID NO: 4346

SEQ ID NO: 10627 - protein, 45 aa, homo sapiens; identical to SEQ ID NO: 4347

SEQ ID NO: 10628 - DNA, 138 bp, homo sapiens; identical to SEQ ID NO: 4348

SEQ ID NO: 10629 - protein, 106 aa, homo sapiens; identical to SEQ ID NO: 4349

SEQ ID NO: 10630 - DNA, 321 bp, homo sapiens; identical to SEQ ID NO: 4350

SEQ ID NO: 10631 - protein, 74 aa, homo sapiens [sequence omitted]

SEQ ID NO: 10632 - DNA, 225 bp, homo sapiens; identical to SEQ ID NO: 4352

SEQ ID NO: 10633 - protein, 10 aa, homo sapiens
MAPFPKSRCL

SEQ ID NO: 10634 - DNA, 33 bp, homo sapiens; identical to SEQ ID NO: 8386

SEQ ID NO: 10635 - protein, 48 aa, homo sapiens; identical to SEQ ID NO: 8387

SEQ ID NO: 10636 - DNA, 147 bp, homo sapiens; identical to SEQ ID NO: 8388

SEQ ID NO: 10637 - protein, 9 aa, homo sapiens
MGASKRVQL

SEQ ID NO: 10638 - DNA, 30 bp, homo sapiens; identical to SEQ ID NO: 8390

SEQ ID NO: 10639 - protein, 16 aa, homo sapiens
MVQVTNKNSISLLYSR

SEQ ID NO: 10640 - DNA, 51 bp, homo sapiens; identical to SEQ ID NO: 8392

SEQ ID NO: 10641 - protein, 10 aa, homo sapiens
MAPFPKSRCL

SEQ ID NO: 10642 - DNA, 33 bp, homo sapiens; identical to SEQ ID NO: 8386

SEQ ID NO: 10643 - protein, 48 aa, homo sapiens; identical to SEQ ID NO: 8387

SEQ ID NO: 10644 - DNA, 147 bp, homo sapiens; identical to SEQ ID NO: 8388

SEQ ID NO: 10645 - protein, 9 aa, homo sapiens
MGASKRVQL

SEQ ID NO: 10646 - DNA, 30 bp, homo sapiens; identical to SEQ ID NO: 8390

SEQ ID NO: 10647 - protein, 16 aa, homo sapiens
MVQVTNKNSISLLYSR

SEQ ID NO: 10648 - DNA, 51 bp, homo sapiens; identical to SEQ ID NO: 8392

SEQ ID NO: 10649 - protein, 24 aa, homo sapiens
MYLIAKDFSTLFSYVFFNCKLLGF

SEQ ID NO: 10650 - DNA, 75 bp, homo sapiens; identical to SEQ ID NO: 8402

SEQ ID NO: 10651 - protein, 7 aa, homo sapiens
MDGINCC

SEQ ID NO: 10652 - DNA, 24 bp, homo sapiens
atggatggaattaattgctgttag

SEQ ID NO: 10653 - protein, 19 aa, homo sapiens
MELIAVRRLENSKYRFGRW

SEQ ID NO: 10654 - DNA, 60 bp, homo sapiens; identical to SEQ ID NO: 8406

SEQ ID NO: 10655 - protein, 18 aa, homo sapiens
MFYLFFPYFSLFQSYTWT

SEQ ID NO: 10656 - DNA, 57 bp, homo sapiens; identical to SEQ ID NO: 8408

SEQ ID NO: 10657 - protein, 79 aa, homo sapiens [sequence omitted]

SEQ ID NO: 10658 - DNA, 240 bp, homo sapiens; identical to SEQ ID NO: 4596

SEQ ID NO: 10659 - protein, 10 aa, homo sapiens
MRPSWGGLGS

SEQ ID NO: 10660 - DNA, 33 bp, homo sapiens; identical to SEQ ID NO: 4598

SEQ ID NO: 10661 - protein, 38 aa, homo sapiens; identical to SEQ ID NO: 4599

SEQ ID NO: 10662 - DNA, 117 bp, homo sapiens; identical to SEQ ID NO: 4600

SEQ ID NO: 10663 - protein, 32 aa, homo sapiens; identical to SEQ ID NO: 8431

SEQ ID NO: 10664 - DNA, 99 bp, homo sapiens; identical to SEQ ID NO: 8432

SEQ ID NO: 10665 - protein, 19 aa, homo sapiens
MSTKNFRVSDGDWICPDKK

SEQ ID NO: 10666 - DNA, 60 bp, homo sapiens; identical to SEQ ID NO: 4602

SEQ ID NO: 10667 - protein, 166 aa, homo sapiens [sequence omitted]

SEQ ID NO: 10668 - DNA, 501 bp, homo sapiens; identical to SEQ ID NO: 4604

SEQ ID NO: 10669 - protein, 59 aa, homo sapiens; identical to SEQ ID NO: 4605

SEQ ID NO: 10670 - DNA, 180 bp, homo sapiens; identical to SEQ ID NO: 4606

SEQ ID NO: 10671 - protein, 9 aa, homo sapiens
MPAAEKHVC

SEQ ID NO: 10672 - DNA, 30 bp, homo sapiens; identical to SEQ ID NO: 4608

SEQ ID NO: 10673 - protein, 24 aa, homo sapiens
MYLIAKDFSTLFSYVFFNCKLLGF

SEQ ID NO: 10674 - DNA, 75 bp, homo sapiens; identical to SEQ ID NO: 8402

SEQ ID NO: 10675 - protein, 7 aa, homo sapiens
MDGINCC

SEQ ID NO: 10676 - DNA, 24 bp, homo sapiens
atggatggaattaattgctgttag

SEQ ID NO: 10677 - protein, 19 aa, homo sapiens
MELIAVRRLENSKYRFGRW

SEQ ID NO: 10678 - DNA, 60 bp, homo sapiens; identical to SEQ ID NO: 8406

SEQ ID NO: 10679 - protein, 18 aa, homo sapiens
MFYLFFPYFSLFQSYTWT

SEQ ID NO: 10680 - DNA, 57 bp, homo sapiens; identical to SEQ ID NO: 8408

SEQ ID NO: 10681 - protein, 39 aa, homo sapiens; identical to SEQ ID NO: 8225

SEQ ID NO: 10682 - DNA, 120 bp, homo sapiens; identical to SEQ ID NO: 8226

SEQ ID NO: 10683 - protein, 26 aa, homo sapiens
MLNSILIVRLKLRHHFILQSAVGLWP

SEQ ID NO: 10684 - DNA, 81 bp, homo sapiens; identical to SEQ ID NO: 96

SEQ ID NO: 10685 - protein, 32 aa, homo sapiens; identical to SEQ ID NO: 8229

SEQ ID NO: 10686 - DNA, 99 bp, homo sapiens; identical to SEQ ID NO: 8230

SEQ ID NO: 10687 - protein, 4 aa, homo sapiens
MCRE

SEQ ID NO: 10688 - DNA, 15 bp, homo sapiens
atgtgcagagagtaa

SEQ ID NO: 10689 - protein, 4 aa, homo sapiens
MGGF

SEQ ID NO: 10690 - DNA, 15 bp, homo sapiens
atgggcgggttctga

SEQ ID NO: 10691 - protein, 6 aa, homo sapiens
MWPQGE

SEQ ID NO: 10692 - DNA, 21 bp, homo sapiens
atgtggccccagggcgagtga

SEQ ID NO: 10693 - protein, 4 aa, homo sapiens
MGCP

SEQ ID NO: 10694 - DNA, 15 bp, homo sapiens
atggggtgcccctga

SEQ ID NO: 10695 - protein, 35 aa, homo sapiens [sequence omitted]

SEQ ID NO: 10696 - DNA, 108 bp, homo sapiens; identical to SEQ ID NO: 8464

SEQ ID NO: 10697 - protein, 72 aa, homo sapiens; identical to SEQ ID NO: 4687

SEQ ID NO: 10698 - DNA, 219 bp, homo sapiens; identical to SEQ ID NO: 4688

SEQ ID NO: 10699 - protein, 32 aa, homo sapiens; identical to SEQ ID NO: 4695

SEQ ID NO: 10700 - DNA, 99 bp, homo sapiens; identical to SEQ ID NO: 4696

SEQ ID NO: 10701 - protein, 15 aa, homo sapiens
MDLCGCVPNGRSFVP

SEQ ID NO: 10702 - DNA, 48 bp, homo sapiens; identical to SEQ ID NO: 8470

SEQ ID NO: 10703 - protein, 15 aa, homo sapiens
MCSQWPVFCSLTDAT

SEQ ID NO: 10704 - DNA, 48 bp, homo sapiens; identical to SEQ ID NO: 8472

SEQ ID NO: 10705 - protein, 13 aa, homo sapiens
MEIISPNLGAQQI

SEQ ID NO: 10706 - DNA, 42 bp, homo sapiens; identical to SEQ ID NO: 9580

SEQ ID NO: 10707 - protein, 4 aa, homo sapiens
MRDD

SEQ ID NO: 10708 - DNA, 15 bp, homo sapiens
atgagagacgattaa

SEQ ID NO: 10709 - protein, 32 aa, homo sapiens; identical to SEQ ID NO: 9583

SEQ ID NO: 10710 - DNA, 99 bp, homo sapiens; identical to SEQ ID NO: 9584

SEQ ID NO: 10711 - protein, 52 aa, homo sapiens
MVWQMSPPPTATPWHFGEMNRRPEGTPSNDSFSDPGSPNSCLKGGLPRCCQP

SEQ ID NO: 10712 - DNA, 159 bp, homo sapiens
atggtgtggcaaatgtcccctcctcccacagcgaccccctggcattttggtgagatgaaccgccgccctgagggaacacccagtaacgattccttcagtgatcccggttctccaaactcttgcctcaaaggcggcctgccccggtgctgtcagccgtga

SEQ ID NO: 10713 - protein, 17 aa, homo sapiens
MRIRLGALPLASGWSII

SEQ ID NO: 10714 - DNA, 54 bp, homo sapiens; identical to SEQ ID NO: 8482

SEQ ID NO: 10715 - protein, 18 aa, homo sapiens
MEYYLISCGVSVYYGVLI

SEQ ID NO: 10716 - DNA, 57 bp, homo sapiens; identical to SEQ ID NO: 8484

SEQ ID NO: 10717 - protein, 54 aa, homo sapiens [sequence omitted]

SEQ ID NO: 10718 - DNA, 165 bp, homo sapiens; identical to SEQ ID NO: 8486

SEQ ID NO: 10719 - protein, 8 aa, homo sapiens
MGLTWKLH

SEQ ID NO: 10720 - DNA, 27 bp, homo sapiens
atggggctgacttggaagttacattag

SEQ ID NO: 10721 - protein, 36 aa, homo sapiens; identical to SEQ ID NO: 8489

SEQ ID NO: 10722 - DNA, 111 bp, homo sapiens; identical to SEQ ID NO: 8490

SEQ ID NO: 10723 - protein, 27 aa, homo sapiens
MSLPPSRSKNLLEVSYLYCFLLFSHPS

SEQ ID NO: 10724 - DNA, 84 bp, homo sapiens; identical to SEQ ID NO: 8492

SEQ ID NO: 10725 - protein, 17 aa, homo sapiens
MPPPPNIVLSLSGSCVI

SEQ ID NO: 10726 - DNA, 54 bp, homo sapiens; identical to SEQ ID NO: 8494

SEQ ID NO: 10727 - protein, 22 aa, homo sapiens
MLYLLHVASLMEKKKPNKFPES

SEQ ID NO: 10728 - DNA, 69 bp, homo sapiens; identical to SEQ ID NO: 8496

SEQ ID NO: 10729 - protein, 80 aa, homo sapiens
MSSSAHPEAPPQPSAGHAHARKPLPAAPLRRSPELKPRPQRRQRPSSTQPCSQLSTASPAPRQAPPSLSSAPRSRWEPPR

SEQ ID NO: 10730 - DNA, 243 bp, homo sapiens
atgagcagctccgcccacccagaggccccgccccagcccagtgctggccacgcccatgcacgcaagcccctccctgccgcacccctaaggcggtcgccggagcttaagccccgcccccagcggcgccaacgccccagctccacccagccttgcagccagctctccacggcaagccccgccccgcgacaagccccgccctctctaagctccgcccctcgctccaggtgggagccaccccggtga

SEQ ID NO: 10731 - protein, 10 aa, homo sapiens
MHASPSLPHP

SEQ ID NO: 10732 - DNA, 33 bp, homo sapiens
atgcacgcaagcccctccctgccgcacccctaa

SEQ ID NO: 10733 - protein, 64 aa, homo sapiens [sequence omitted]

SEQ ID NO: 10734 - DNA, 195 bp, homo sapiens
atgggcgtgctgacggtggtcgtgttgatgtcgccgatgatgctgagcgcctccttcagtgcgtggtacatgcgcagcatctcgtcgcgccgctgtgcctgctccgccgactcctccatcagcgtgttctggtccccacacgagtacaggttggccagcagctccgagaagatgaactccttggtctgcgagtag

SEQ ID NO: 10735 - protein, 15 aa, homo sapiens
MPVPPWPPHRALLGL

SEQ ID NO: 10736 - DNA, 48 bp, homo sapiens
atgcctgtgccgccctggccgccccaccgggccctgctgggactgtga

SEQ ID NO: 10737 - protein, 24 aa, homo sapiens
MYLIAKDFSTLFSYVFFNCKLLGF

SEQ ID NO: 10738 - DNA, 75 bp, homo sapiens; identical to SEQ ID NO: 8402

SEQ ID NO: 10739 - protein, 7 aa, homo sapiens
MDGINCC

SEQ ID NO: 10740 - DNA, 24 bp, homo sapiens
atggatggaattaattgctgttag

SEQ ID NO: 10741 - protein, 19 aa, homo sapiens
MELIAVRRLENSKYRFGRW

SEQ ID NO: 10742 - DNA, 60 bp, homo sapiens; identical to SEQ ID NO: 8406

SEQ ID NO: 10743 - protein, 18 aa, homo sapiens
MFYLFFPYFSLFQSYTWT

SEQ ID NO: 10744 - DNA, 57 bp, homo sapiens; identical to SEQ ID NO: 8408

SEQ ID NO: 10745 - protein, 24 aa, homo sapiens
MYLIAKDFSTLFSYVFFNCKLLGF

SEQ ID NO: 10746 - DNA, 75 bp, homo sapiens; identical to SEQ ID NO: 8402

SEQ ID NO: 10747 - protein, 7 aa, homo sapiens
MDGINCC

SEQ ID NO: 10748 - DNA, 24 bp, homo sapiens
atggatggaattaattgctgttag

SEQ ID NO: 10749 - protein, 19 aa, homo sapiens
MELIAVRRLENSKYRFGRW

SEQ ID NO: 10750 - DNA, 60 bp, homo sapiens; identical to SEQ ID NO: 8406

SEQ ID NO: 10751 - protein, 18 aa, homo sapiens
MFYLFFPYFSLFQSYTWT

SEQ ID NO: 10752 - DNA, 57 bp, homo sapiens; identical to SEQ ID NO: 8408

SEQ ID NO: 10753 - protein, 39 aa, homo sapiens; identical to SEQ ID NO: 8225

SEQ ID NO: 10754 - DNA, 120 bp, homo sapiens; identical to SEQ ID NO: 8226

SEQ ID NO: 10755 - protein, 26 aa, homo sapiens
MLNSILIVRLKLRHHFILQSAVGLWP

SEQ ID NO: 10756 - DNA, 81 bp, homo sapiens; identical to SEQ ID NO: 96

SEQ ID NO: 10757 - protein, 32 aa, homo sapiens; identical to SEQ ID NO: 8229

SEQ ID NO: 10758 - DNA, 99 bp, homo sapiens; identical to SEQ ID NO: 8230

SEQ ID NO: 10759 - protein, 4 aa, homo sapiens
MCRE

SEQ ID NO: 10760 - DNA, 15 bp, homo sapiens
atgtgcagagagtaa

SEQ ID NO: 10761 - protein, 86 aa, homo sapiens; identical to SEQ ID NO: 2749

SEQ ID NO: 10762 - DNA, 261 bp, homo sapiens; identical to SEQ ID NO: 2750

SEQ ID NO: 10763 - protein, 108 aa, homo sapiens; identical to SEQ ID NO: 2751

SEQ ID NO: 10764 - DNA, 327 bp, homo sapiens; identical to SEQ ID NO: 2752

SEQ ID NO: 10765 - protein, 15 aa, homo sapiens
MKAGQWEPRDWFKSR

SEQ ID NO: 10766 - DNA, 48 bp, homo sapiens
atgaaagcagggcagtgggaaccacgtgattggtttaaaagcaggtga

SEQ ID NO: 10767 - protein, 51 aa, homo sapiens
MVAHACNPGTFGGQGRRITRGQEFETSLANTAKPLSLLKIQKLAGHGSAHL

SEQ ID NO: 10768 - DNA, 156 bp, homo sapiens
atggtggctcatgcctgtaatcctggcacttttggaggccaaggcaggcggatcacccgaggtcaggagtttgagactagcctggccaacacggcaaaacccctgtctctactaaaaatacaaaaattagctgggcatggtagtgcacacctgtag

SEQ ID NO: 10769 - protein, 86 aa, homo sapiens; identical to SEQ ID NO: 2749

SEQ ID NO: 10770 - DNA, 261 bp, homo sapiens; identical to SEQ ID NO: 2750

SEQ ID NO: 10771 - protein, 108 aa, homo sapiens; identical to SEQ ID NO: 2751

SEQ ID NO: 10772 - DNA, 327 bp, homo sapiens; identical to SEQ ID NO: 2752

SEQ ID NO: 10773 - protein, 15 aa, homo sapiens
MKAGQWEPRDWFKSR

SEQ ID NO: 10774 - DNA, 48 bp, homo sapiens; identical to SEQ ID NO: 10766

SEQ ID NO: 10775 - protein, 51 aa, homo sapiens; identical to SEQ ID NO: 10767

SEQ ID NO: 10776 - DNA, 156 bp, homo sapiens; identical to SEQ ID NO: 10768

SEQ ID NO: 10777 - protein, 26 aa, homo sapiens
MLPPGLAHSSVASDPAHSGAAGQRDP

SEQ ID NO: 10778 - DNA, 81 bp, homo sapiens
atgctgcccccaggactagcccattcctctgtggcctcagaccctgcccacagcggagctgcaggccagagagatccctga

SEQ ID NO: 10779 - protein, 6 aa, homo sapiens
MLVIGL

SEQ ID NO: 10780 - DNA, 21 bp, homo sapiens
atgcttgtgatcggtttgtga

SEQ ID NO: 10781 - protein, 8 aa, homo sapiens
MPVTPGAL

SEQ ID NO: 10782 - DNA, 27 bp, homo sapiens
atgcctgtgacgccgggggctctgtaa

SEQ ID NO: 10783 - protein, 24 aa, homo sapiens
MHAQPLGFGTCAVSAFPGVGASTS

SEQ ID NO: 10784 - DNA, 75 bp, homo sapiens
atgcacgcccagcctctgggctttgggacctgtgctgtctcagcctttccaggagtgggcgccagcacttcctga

SEQ ID NO: 10785 - protein, 24 aa, homo sapiens
MYLIAKDFSTLFSYVFFNCKLLGF

SEQ ID NO: 10786 - DNA, 75 bp, homo sapiens; identical to SEQ ID NO: 8402

SEQ ID NO: 10787 - protein, 7 aa, homo sapiens
MDGINCC

SEQ ID NO: 10788 - DNA, 24 bp, homo sapiens
atggatggaattaattgctgttag

SEQ ID NO: 10789 - protein, 19 aa, homo sapiens
MELIAVRRLENSKYRFGRW

SEQ ID NO: 10790 - DNA, 60 bp, homo sapiens; identical to SEQ ID NO: 8406

SEQ ID NO: 10791 - protein, 18 aa, homo sapiens
MFYLFFPYFSLFQSYTWT

SEQ ID NO: 10792 - DNA, 57 bp, homo sapiens; identical to SEQ ID NO: 8408

SEQ ID NO: 10793 - protein, 39 aa, homo sapiens; identical to SEQ ID NO: 8225

SEQ ID NO: 10794 - DNA, 120 bp, homo sapiens; identical to SEQ ID NO: 8226

SEQ ID NO: 10795 - protein, 26 aa, homo sapiens
MLNSILIVRLKLRHHFILQSAVGLWP

SEQ ID NO: 10796 - DNA, 81 bp, homo sapiens; identical to SEQ ID NO: 96

SEQ ID NO: 10797 - protein, 32 aa, homo sapiens; identical to SEQ ID NO: 8229

SEQ ID NO: 10798 - DNA, 99 bp, homo sapiens; identical to SEQ ID NO: 8230

SEQ ID NO: 10799 - protein, 4 aa, homo sapiens
MCRE

SEQ ID NO: 10800 - DNA, 15 bp, homo sapiens
atgtgcagagagtaa

SEQ ID NO: 10801 - protein, 25 aa, homo sapiens
MLVGEILVFKGLLDGVNFLFFFFFF

SEQ ID NO: 10802 - DNA, 78 bp, homo sapiens; identical to SEQ ID NO: 498

SEQ ID NO: 10803 - protein, 89 aa, homo sapiens; identical to SEQ ID NO: 499

SEQ ID NO: 10804 - DNA, 270 bp, homo sapiens; identical to SEQ ID NO: 500

SEQ ID NO: 10805 - protein, 8 aa, homo sapiens
MGTPQVRL

SEQ ID NO: 10806 - DNA, 27 bp, homo sapiens
atgggcacaccacaggtaagactttaa

SEQ ID NO: 10807 - protein, 36 aa, homo sapiens; identical to SEQ ID NO: 503

SEQ ID NO: 10808 - DNA, 111 bp, homo sapiens; identical to SEQ ID NO: 504

SEQ ID NO: 10809 - protein, 192 aa, homo sapiens [sequence omitted]

SEQ ID NO: 10810 - DNA, 579 bp, homo sapiens; identical to SEQ ID NO: 4946

SEQ ID NO: 10811 - protein, 29 aa, homo sapiens
MDSDWPLEAPCPDGVACHHCEVRLGRTCT

SEQ ID NO: 10812 - DNA, 90 bp, homo sapiens; identical to SEQ ID NO: 4948

SEQ ID NO: 10813 - protein, 77 aa, homo sapiens; identical to SEQ ID NO: 4949

SEQ ID NO: 10814 - DNA, 234 bp, homo sapiens; identical to SEQ ID NO: 4950

SEQ ID NO: 10815 - protein, 7 aa, homo sapiens
MSTQFTI

SEQ ID NO: 10816 - DNA, 24 bp, homo sapiens
atgtcaacacagttcacaatatag

SEQ ID NO: 10817 - protein, 10 aa, homo sapiens
MGGIRGGGQD

SEQ ID NO: 10818 - DNA, 33 bp, homo sapiens; identical to SEQ ID NO: 8554

SEQ ID NO: 10819 - protein, 127 aa, homo sapiens; identical to SEQ ID NO: 5033

SEQ ID NO: 10820 - DNA, 384 bp, homo sapiens; identical to SEQ ID NO: 5034

SEQ ID NO: 10821 - protein, 105 aa, homo sapiens; identical to SEQ ID NO: 5035

SEQ ID NO: 10822 - DNA, 318 bp, homo sapiens; identical to SEQ ID NO: 5036

SEQ ID NO: 10823 - protein, 94 aa, homo sapiens; identical to SEQ ID NO: 5037

SEQ ID NO: 10824 - DNA, 285 bp, homo sapiens; identical to SEQ ID NO: 5038

SEQ ID NO: 10825 - protein, 139 aa, homo sapiens; identical to SEQ ID NO: 5049

SEQ ID NO: 10826 - DNA, 420 bp, homo sapiens; identical to SEQ ID NO: 5050

SEQ ID NO: 10827 - protein, 23 aa, homo sapiens
MLCKGGGERSRGRRCRGLMQPKG

SEQ ID NO: 10828 - DNA, 72 bp, homo sapiens; identical to SEQ ID NO: 5052

SEQ ID NO: 10829 - protein, 40 aa, homo sapiens; identical to SEQ ID NO: 5053

SEQ ID NO: 10830 - DNA, 123 bp, homo sapiens; identical to SEQ ID NO: 5054

SEQ ID NO: 10831 - protein, 82 aa, homo sapiens [sequence omitted]

SEQ ID NO: 10832 - DNA, 249 bp, homo sapiens; identical to SEQ ID NO: 5056

SEQ ID NO: 10833 - protein, 5 aa, homo sapiens
MWKIS

SEQ ID NO: 10834 - DNA, 18 bp, homo sapiens
atgtggaaaatttcatga

SEQ ID NO: 10835 - protein, 9 aa, homo sapiens
MSLDICKHL

SEQ ID NO: 10836 - DNA, 30 bp, homo sapiens; identical to SEQ ID NO: 8572

SEQ ID NO: 10837 - protein, 9 aa, homo sapiens
MQTPVIPSP

SEQ ID NO: 10838 - DNA, 30 bp, homo sapiens; identical to SEQ ID NO: 8574

SEQ ID NO: 10839 - protein, 29 aa, homo sapiens
MDVFNISQSFIVSLWFCVCVCVYVKNHLT

SEQ ID NO: 10840 - DNA, 90 bp, homo sapiens; identical to SEQ ID NO: 8576

SEQ ID NO: 10841 - protein, 5 aa, homo sapiens
MWKIS

SEQ ID NO: 10842 - DNA, 18 bp, homo sapiens
atgtggaaaatttcatga

SEQ ID NO: 10843 - protein, 9 aa, homo sapiens
MSLDICKHL

SEQ ID NO: 10844 - DNA, 30 bp, homo sapiens; identical to SEQ ID NO: 8572

SEQ ID NO: 10845 - protein, 9 aa, homo sapiens
MQTPVIPSP

SEQ ID NO: 10846 - DNA, 30 bp, homo sapiens; identical to SEQ ID NO: 8574

SEQ ID NO: 10847 - protein, 29 aa, homo sapiens
MDVFNISQSFIVSLWFCVCVCVYVKNHLT

SEQ ID NO: 10848 - DNA, 90 bp, homo sapiens; identical to SEQ ID NO: 8576

SEQ ID NO: 10849 - protein, 17 aa, homo sapiens
MANGWTGSRPGRRNPEL

SEQ ID NO: 10850 - DNA, 54 bp, homo sapiens; identical to SEQ ID NO: 3920

SEQ ID NO: 10851 - protein, 51 aa, homo sapiens; identical to SEQ ID NO: 8235

SEQ ID NO: 10852 - DNA, 156 bp, homo sapiens; identical to SEQ ID NO: 8236

SEQ ID NO: 10853 - protein, 6 aa, homo sapiens
MCFFVY

SEQ ID NO: 10854 - DNA, 21 bp, homo sapiens
atgtgcttctttgtttactaa

SEQ ID NO: 10855 - protein, 21 aa, homo sapiens
MLDGPVHCHGLFILRWLETDL

SEQ ID NO: 10856 - DNA, 66 bp, homo sapiens; identical to SEQ ID NO: 8240

SEQ ID NO: 10857 - protein, 15 aa, homo sapiens
MEAEVDKLELMVSAK

SEQ ID NO: 10858 - DNA, 48 bp, homo sapiens; identical to SEQ ID NO: 5326

SEQ ID NO: 10859 - protein, 43 aa, homo sapiens; identical to SEQ ID NO: 5327

SEQ ID NO: 10860 - DNA, 132 bp, homo sapiens; identical to SEQ ID NO: 5328

SEQ ID NO: 10861 - protein, 46 aa, homo sapiens; identical to SEQ ID NO: 8605

SEQ ID NO: 10862 - DNA, 141 bp, homo sapiens; identical to SEQ ID NO: 8606

SEQ ID NO: 10863 - protein, 65 aa, homo sapiens; identical to SEQ ID NO: 8607

SEQ ID NO: 10864 - DNA, 198 bp, homo sapiens; identical to SEQ ID NO: 8608

SEQ ID NO: 10865 - protein, 27 aa, homo sapiens
MGFQSDVCSCLLPRTSRGYFRSNYLVY

SEQ ID NO: 10866 - DNA, 84 bp, homo sapiens; identical to SEQ ID NO: 8610

SEQ ID NO: 10867 - protein, 54 aa, homo sapiens [sequence omitted]

SEQ ID NO: 10868 - DNA, 165 bp, homo sapiens; identical to SEQ ID NO: 8612

SEQ ID NO: 10869 - protein, 29 aa, homo sapiens
MHRICNIKKKVFVREMRKCVTVFLFFLKA

SEQ ID NO: 10870 - DNA, 90 bp, homo sapiens; identical to SEQ ID NO: 8614

SEQ ID NO: 10871 - protein, 23 aa, homo sapiens
MCYSIFIFFKSVVGQYFPEKSMK

SEQ ID NO: 10872 - DNA, 72 bp, homo sapiens; identical to SEQ ID NO: 8616

SEQ ID NO: 10873 - protein, 11 aa, homo sapiens
MQSRNFSFPYT

SEQ ID NO: 10874 - DNA, 36 bp, homo sapiens
atgcaatctagaaatttcagctttccctatacttaa

SEQ ID NO: 10875 - protein, 10 aa, homo sapiens
MCVQHFSPSS

SEQ ID NO: 10876 - DNA, 33 bp, homo sapiens; identical to SEQ ID NO: 8618

SEQ ID NO: 10877 - protein, 8 aa, homo sapiens
MGMHVFLY

SEQ ID NO: 10878 - DNA, 27 bp, homo sapiens
atgggtatgcatgtctttttatattaa

SEQ ID NO: 10879 - protein, 44 aa, homo sapiens; identical to SEQ ID NO: 8621

SEQ ID NO: 10880 - DNA, 135 bp, homo sapiens; identical to SEQ ID NO: 8622

SEQ ID NO: 10881 - protein, 26 aa, homo sapiens
MKGSPQKKKMWSLNFIPILNVLLKGN

SEQ ID NO: 10882 - DNA, 81 bp, homo sapiens
atgaaaggtagtcctcagaagaaaaaaatgtggtctcttaacttcataccaatcttaaatgttttgcttaaggggaattag

SEQ ID NO: 10883 - protein, 59 aa, homo sapiens
MFCLRGISEEITVSGRLKTVILLNKYCSFNLSSHARNYEVIFFHTCTVRPGILKSFKYK

SEQ ID NO: 10884 - DNA, 180 bp, homo sapiens
atgttttgcttaaggggaattagtgaggaaataacagtctcaggaaggttgaaaactgtgattttactcaacaaatattgctcttttaatctctccagccatgccagaaactatgaagttattttctttcacacatgcactgtaagacctggtattttaaaaagctttaaatataagtag

SEQ ID NO: 10885 - protein, 14 aa, homo sapiens
MPETMKLFSFTHAL

SEQ ID NO: 10886 - DNA, 45 bp, homo sapiens
atgccagaaactatgaagttattttctttcacacatgcactgtaa

SEQ ID NO: 10887 - protein, 11 aa, homo sapiens
MHCKTWYFKKL

SEQ ID NO: 10888 - DNA, 36 bp, homo sapiens
atgcactgtaagacctggtattttaaaaagctttaa

SEQ ID NO: 10889 - protein, 11 aa, homo sapiens
MQSRNFSFPYT

SEQ ID NO: 10890 - DNA, 36 bp, homo sapiens; identical to SEQ ID NO: 10874

SEQ ID NO: 10891 - protein, 10 aa, homo sapiens
MCVQHFSPSS

SEQ ID NO: 10892 - DNA, 33 bp, homo sapiens; identical to SEQ ID NO: 8618

SEQ ID NO: 10893 - protein, 8 aa, homo sapiens
MGMHVFLY

SEQ ID NO: 10894 - DNA, 27 bp, homo sapiens
atgggtatgcatgtctttttatattaa

SEQ ID NO: 10895 - protein, 44 aa, homo sapiens; identical to SEQ ID NO: 8621

SEQ ID NO: 10896 - DNA, 135 bp, homo sapiens; identical to SEQ ID NO: 8622

SEQ ID NO: 10897 - protein, 31 aa, homo sapiens; identical to SEQ ID NO: 699

SEQ ID NO: 10898 - DNA, 96 bp, homo sapiens; identical to SEQ ID NO: 700

SEQ ID NO: 10899 - protein, 15 aa, homo sapiens
MGRGARRGAESETWT

SEQ ID NO: 10900 - DNA, 48 bp, homo sapiens; identical to SEQ ID NO: 702

SEQ ID NO: 10901 - protein, 30 aa, homo sapiens; identical to SEQ ID NO: 703

SEQ ID NO: 10902 - DNA, 93 bp, homo sapiens; identical to SEQ ID NO: 704

SEQ ID NO: 10903 - protein, 9 aa, homo sapiens
MLSPIPQTV

SEQ ID NO: 10904 - DNA, 30 bp, homo sapiens; identical to SEQ ID NO: 8640

SEQ ID NO: 10905 - protein, 7 aa, homo sapiens
MGDKGTR

SEQ ID NO: 10906 - DNA, 24 bp, homo sapiens
atgggcgacaaagggacccggtga

SEQ ID NO: 10907 - protein, 89 aa, homo sapiens [sequence omitted]

SEQ ID NO: 10908 - DNA, 270 bp, homo sapiens; identical to SEQ ID NO: 5484

SEQ ID NO: 10909 - protein, 35 aa, homo sapiens; identical to SEQ ID NO: 5485

SEQ ID NO: 10910 - DNA, 108 bp, homo sapiens; identical to SEQ ID NO: 5486

SEQ ID NO: 10911 - protein, 70 aa, homo sapiens; identical to SEQ ID NO: 5487

SEQ ID NO: 10912 - DNA, 213 bp, homo sapiens; identical to SEQ ID NO: 5488

SEQ ID NO: 10913 - protein, 7 aa, homo sapiens
MSSFGAG

SEQ ID NO: 10914 - DNA, 24 bp, homo sapiens
atgagtagctttggagctgggtga

SEQ ID NO: 10915 - protein, 6 aa, homo sapiens
MVSPLF

SEQ ID NO: 10916 - DNA, 21 bp, homo sapiens
atggtttctccccttttctga

SEQ ID NO: 10917 - protein, 12 aa, homo sapiens
MGKGSVEACLLG

SEQ ID NO: 10918 - DNA, 39 bp, homo sapiens; identical to SEQ ID NO: 5518

SEQ ID NO: 10919 - protein, 124 aa, homo sapiens [sequence omitted]

SEQ ID NO: 10920 - DNA, 375 bp, homo sapiens; identical to SEQ ID NO: 5520

SEQ ID NO: 10921 - protein, 25 aa, homo sapiens
MPGWILQLRGFSGKQRPLLSRDPGS

SEQ ID NO: 10922 - DNA, 78 bp, homo sapiens; identical to SEQ ID NO: 8658

SEQ ID NO: 10923 - protein, 65 aa, homo sapiens; identical to SEQ ID NO: 8659

SEQ ID NO: 10924 - DNA, 198 bp, homo sapiens; identical to SEQ ID NO: 8660

SEQ ID NO: 10925 - protein, 4 aa, homo sapiens
MAFP

SEQ ID NO: 10926 - DNA, 15 bp, homo sapiens
atggccttcccctga

SEQ ID NO: 10927 - protein, 38 aa, homo sapiens; identical to SEQ ID NO: 8663

SEQ ID NO: 10928 - DNA, 117 bp, homo sapiens; identical to SEQ ID NO: 8664

SEQ ID NO: 10929 - protein, 134 aa, homo sapiens; identical to SEQ ID NO: 5579

SEQ ID NO: 10930 - DNA, 405 bp, homo sapiens; identical to SEQ ID NO: 5580

SEQ ID NO: 10931 - protein, 123 aa, homo sapiens [sequence omitted]

SEQ ID NO: 10932 - DNA, 372 bp, homo sapiens; identical to SEQ ID NO: 5582

SEQ ID NO: 10933 - protein, 6 aa, homo sapiens
MSNSPN

SEQ ID NO: 10934 - DNA, 21 bp, homo sapiens
atgagtaactcaccgaattga

SEQ ID NO: 10935 - protein, 45 aa, homo sapiens; identical to SEQ ID NO: 8671

SEQ ID NO: 10936 - DNA, 138 bp, homo sapiens; identical to SEQ ID NO: 8672

SEQ ID NO: 10937 - protein, 19 aa, homo sapiens
MPPSPAGSPGVGGHAGYAT

SEQ ID NO: 10938 - DNA, 60 bp, homo sapiens; identical to SEQ ID NO: 5612

SEQ ID NO: 10939 - protein, 34 aa, homo sapiens; identical to SEQ ID NO: 5613

SEQ ID NO: 10940 - DNA, 105 bp, homo sapiens; identical to SEQ ID NO: 5614

SEQ ID NO: 10941 - protein, 10 aa, homo sapiens
MGNPAVESPL

SEQ ID NO: 10942 - DNA, 33 bp, homo sapiens; identical to SEQ ID NO: 5616

SEQ ID NO: 10943 - protein, 15 aa, homo sapiens
MTCDLGGPQTRRVST

SEQ ID NO: 10944 - DNA, 48 bp, homo sapiens; identical to SEQ ID NO: 8680

SEQ ID NO: 10945 - protein, 6 aa, homo sapiens
MGCGDE

SEQ ID NO: 10946 - DNA, 21 bp, homo sapiens
atgggctgcggggatgaatga

SEQ ID NO: 10947 - protein, 6 aa, homo sapiens
MNESRV

SEQ ID NO: 10948 - DNA, 21 bp, homo sapiens
atgaatgagagccgagtctga

SEQ ID NO: 10949 - protein, 121 aa, homo sapiens; identical to SEQ ID NO: 8685

SEQ ID NO: 10950 - DNA, 366 bp, homo sapiens; identical to SEQ ID NO: 8686

SEQ ID NO: 10951 - protein, 34 aa, homo sapiens; identical to SEQ ID NO: 8687

SEQ ID NO: 10952 - DNA, 105 bp, homo sapiens; identical to SEQ ID NO: 8688

SEQ ID NO: 10953 - protein, 39 aa, homo sapiens; identical to SEQ ID NO: 8225

SEQ ID NO: 10954 - DNA, 120 bp, homo sapiens; identical to SEQ ID NO: 8226

SEQ ID NO: 10955 - protein, 26 aa, homo sapiens
MLNSILIVRLKLRHHFILQSAVGLWP

SEQ ID NO: 10956 - DNA, 81 bp, homo sapiens; identical to SEQ ID NO: 96

SEQ ID NO: 10957 - protein, 32 aa, homo sapiens; identical to SEQ ID NO: 8229

SEQ ID NO: 10958 - DNA, 99 bp, homo sapiens; identical to SEQ ID NO: 8230

SEQ ID NO: 10959 - protein, 4 aa, homo sapiens
MCRE

SEQ ID NO: 10960 - DNA, 15 bp, homo sapiens
atgtgcagagagtaa

SEQ ID NO: 10961 - protein, 13 aa, homo sapiens
MEIISPNLGAQQI

SEQ ID NO: 10962 - DNA, 42 bp, homo sapiens; identical to SEQ ID NO: 9580

SEQ ID NO: 10963 - protein, 4 aa, homo sapiens
MRDD

SEQ ID NO: 10964 - DNA, 15 bp, homo sapiens
atgagagacgattaa

SEQ ID NO: 10965 - protein, 32 aa, homo sapiens; identical to SEQ ID NO: 9583

SEQ ID NO: 10966 - DNA, 99 bp, homo sapiens; identical to SEQ ID NO: 9584

SEQ ID NO: 10967 - protein, 52 aa, homo sapiens; identical to SEQ ID NO: 10711

SEQ ID NO: 10968 - DNA, 159 bp, homo sapiens; identical to SEQ ID NO: 10712

SEQ ID NO: 10969 - protein, 72 aa, homo sapiens; identical to SEQ ID NO: 4687

SEQ ID NO: 10970 - DNA, 219 bp, homo sapiens; identical to SEQ ID NO: 4688

SEQ ID NO: 10971 - protein, 32 aa, homo sapiens; identical to SEQ ID NO: 4695

SEQ ID NO: 10972 - DNA, 99 bp, homo sapiens; identical to SEQ ID NO: 4696

SEQ ID NO: 10973 - protein, 15 aa, homo sapiens
MDLCGCVPNGRSFVP

SEQ ID NO: 10974 - DNA, 48 bp, homo sapiens; identical to SEQ ID NO: 8470

SEQ ID NO: 10975 - protein, 15 aa, homo sapiens
MCSQWPVFCSLTDAT

SEQ ID NO: 10976 - DNA, 48 bp, homo sapiens; identical to SEQ ID NO: 8472

SEQ ID NO: 10977 - protein, 21 aa, homo sapiens
MMTCALVFFTEPLFIKCSIKS

SEQ ID NO: 10978 - DNA, 66 bp, homo sapiens; identical to SEQ ID NO: 8714

SEQ ID NO: 10979 - protein, 7 aa, homo sapiens
MRFGLFH

SEQ ID NO: 10980 - DNA, 24 bp, homo sapiens
atgcgctttggtctttttcactga

SEQ ID NO: 10981 - protein, 7 aa, homo sapiens
MYSLHLA

SEQ ID NO: 10982 - DNA, 24 bp, homo sapiens
atgtattctttgcatctggcatag

SEQ ID NO: 10983 - protein, 60 aa, homo sapiens; identical to SEQ ID NO: 8719

SEQ ID NO: 10984 - DNA, 183 bp, homo sapiens; identical to SEQ ID NO: 8720

SEQ ID NO: 10985 - protein, 63 aa, homo sapiens
MLTPYPSPSRELPCFVLSHREMISEVSPTTQFIHATPGTPAQKALAEDLLRGWSPCPPPCPLQ

SEQ ID NO: 10986 - DNA, 192 bp, homo sapiens
atgctcactccctatcccagcccctctcgggagctaccctgttttgttctatcacatagggaaatgatctcagaggtgtctcctacaacacagttcattcacgcgacacccgggacacctgcacagaaggcacttgctgaggacttgctgcgtgggtggagtccgtgtcctccaccatgtccccttcagtga

SEQ ID NO: 10987 - protein, 12 aa, homo sapiens
MSPSVTLRRMGA

SEQ ID NO: 10988 - DNA, 39 bp, homo sapiens
atgtccccttcagtgaccttgagaagaatgggtgcctag

SEQ ID NO: 10989 - protein, 5 aa, homo sapiens
MLPDP

SEQ ID NO: 10990 - DNA, 18 bp, homo sapiens
atgctgcctgacccctga

SEQ ID NO: 10991 - protein, 29 aa, homo sapiens
MEGLSSQETLELAVQLACAAFSKAGNGLG

SEQ ID NO: 10992 - DNA, 90 bp, homo sapiens
atggagggcctctcctctcaggagacgttggaacttgctgtccagctggcttgtgctgccttctccaaagcaggaaatggtttggggtga

SEQ ID NO: 10993 - protein, 21 aa, homo sapiens
MMTCALVFFTEPLFIKCSIKS

SEQ ID NO: 10994 - DNA, 66 bp, homo sapiens; identical to SEQ ID NO: 8714

SEQ ID NO: 10995 - protein, 7 aa, homo sapiens
MRFGLFH

SEQ ID NO: 10996 - DNA, 24 bp, homo sapiens
atgcgctttggtctttttcactga

SEQ ID NO: 10997 - protein, 7 aa, homo sapiens
MYSLHLA

SEQ ID NO: 10998 - DNA, 24 bp, homo sapiens
atgtattctttgcatctggcatag

SEQ ID NO: 10999 - protein, 60 aa, homo sapiens; identical to SEQ ID NO: 8719

SEQ ID NO: 11000 - DNA, 183 bp, homo sapiens; identical to SEQ ID NO: 8720

SEQ ID NO: 11001 - protein, 21 aa, homo sapiens
MMTCALVFFTEPLFIKCSIKS

SEQ ID NO: 11002 - DNA, 66 bp, homo sapiens; identical to SEQ ID NO: 8714

SEQ ID NO: 11003 - protein, 7 aa, homo sapiens
MRFGLFH

SEQ ID NO: 11004 - DNA, 24 bp, homo sapiens
atgcgctttggtctttttcactga

SEQ ID NO: 11005 - protein, 7 aa, homo sapiens
MYSLHLA

SEQ ID NO: 11006 - DNA, 24 bp, homo sapiens
atgtattctttgcatctggcatag

SEQ ID NO: 11007 - protein, 60 aa, homo sapiens; identical to SEQ ID NO: 8719

SEQ ID NO: 11008 - DNA, 183 bp, homo sapiens; identical to SEQ ID NO: 8720

SEQ ID NO: 11009 - protein, 30 aa, homo sapiens
MVGENGKEEAARMRISDGVPGRGGAQHSGN

SEQ ID NO: 11010 - DNA, 93 bp, homo sapiens
atggttggggagaacggtaaggaggaagcggcgcgcatgcgtatttcagacggagtgccggggaggggaggcgctcagcattcgggtaattaa

SEQ ID NO: 11011 - protein, 15 aa, homo sapiens
MARGEVSCLCLAILG

SEQ ID NO: 11012 - DNA, 48 bp, homo sapiens; identical to SEQ ID NO: 8738

SEQ ID NO: 11013 - protein, 13 aa, homo sapiens
MLWPDPLEINPES

SEQ ID NO: 11014 - DNA, 42 bp, homo sapiens; identical to SEQ ID NO: 8740

SEQ ID NO: 11015 - protein, 4 aa, homo sapiens
MRRR

SEQ ID NO: 11016 - DNA, 15 bp, homo sapiens
atgaggaggcgatga

SEQ ID NO: 11017 - protein, 30 aa, homo sapiens; identical to SEQ ID NO: 11009

SEQ ID NO: 11018 - DNA, 93 bp, homo sapiens; identical to SEQ ID NO: 11010

SEQ ID NO: 11019 - protein, 15 aa, homo sapiens
MARGEVSCLCLAILG

SEQ ID NO: 11020 - DNA, 48 bp, homo sapiens; identical to SEQ ID NO: 8738

SEQ ID NO: 11021 - protein, 13 aa, homo sapiens
MLWPDPLEINPES

SEQ ID NO: 11022 - DNA, 42 bp, homo sapiens; identical to SEQ ID NO: 8740

SEQ ID NO: 11023 - protein, 4 aa, homo sapiens
MRRR

SEQ ID NO: 11024 - DNA, 15 bp, homo sapiens
atgaggaggcgatga

SEQ ID NO: 11025 - protein, 60 aa, homo sapiens [sequence omitted]

SEQ ID NO: 11026 - DNA, 183 bp, homo sapiens; identical to SEQ ID NO: 5906

SEQ ID NO: 11027 - protein, 133 aa, homo sapiens; identical to SEQ ID NO: 5907

SEQ ID NO: 11028 - DNA, 402 bp, homo sapiens; identical to SEQ ID NO: 5908

SEQ ID NO: 11029 - protein, 130 aa, homo sapiens; identical to SEQ ID NO: 5909

SEQ ID NO: 11030 - DNA, 393 bp, homo sapiens; identical to SEQ ID NO: 5910

SEQ ID NO: 11031 - protein, 38 aa, homo sapiens; identical to SEQ ID NO: 5911

SEQ ID NO: 11032 - DNA, 117 bp, homo sapiens; identical to SEQ ID NO: 5912

SEQ ID NO: 11033 - protein, 7 aa, homo sapiens
MAIPGRQ

SEQ ID NO: 11034 - DNA, 24 bp, homo sapiens
atggcgattccgggcaggcagtga

SEQ ID NO: 11035 - protein, 26 aa, homo sapiens
MRNYGDCIFGRGVLNALEVKGLCRQG

SEQ ID NO: 11036 - DNA, 81 bp, homo sapiens; identical to SEQ ID NO: 6004

SEQ ID NO: 11037 - protein, 4 aa, homo sapiens
MRWK

SEQ ID NO: 11038 - DNA, 15 bp, homo sapiens
atgcgctggaagtga

SEQ ID NO: 11039 - protein, 13 aa, homo sapiens
MEARSLREKLVRK

SEQ ID NO: 11040 - DNA, 42 bp, homo sapiens; identical to SEQ ID NO: 6008

SEQ ID NO: 11041 - protein, 12 aa, homo sapiens
MGANLTFKVFNK

SEQ ID NO: 11042 - DNA, 39 bp, homo sapiens; identical to SEQ ID NO: 8770

SEQ ID NO: 11043 - protein, 32 aa, homo sapiens; identical to SEQ ID NO: 8771

SEQ ID NO: 11044 - DNA, 99 bp, homo sapiens; identical to SEQ ID NO: 8772

SEQ ID NO: 11045 - protein, 9 aa, homo sapiens
MEGRGEKTE

SEQ ID NO: 11046 - DNA, 30 bp, homo sapiens; identical to SEQ ID NO: 8774

SEQ ID NO: 11047 - protein, 18 aa, homo sapiens
MNFSSYLQEVSYVLERNV

SEQ ID NO: 11048 - DNA, 57 bp, homo sapiens; identical to SEQ ID NO: 8776

SEQ ID NO: 11049 - protein, 4 aa, homo sapiens
MGGF

SEQ ID NO: 11050 - DNA, 15 bp, homo sapiens
atgggcgggttctga

SEQ ID NO: 11051 - protein, 6 aa, homo sapiens
MWPQGE

SEQ ID NO: 11052 - DNA, 21 bp, homo sapiens
atgtggccccagggcgagtga

SEQ ID NO: 11053 - protein, 4 aa, homo sapiens
MGCP

SEQ ID NO: 11054 - DNA, 15 bp, homo sapiens
atggggtgcccctga

SEQ ID NO: 11055 - protein, 35 aa, homo sapiens [sequence omitted]

SEQ ID NO: 11056 - DNA, 108 bp, homo sapiens; identical to SEQ ID NO: 8464

SEQ ID NO: 11057 - protein, 86 aa, homo sapiens; identical to SEQ ID NO: 2749

SEQ ID NO: 11058 - DNA, 261 bp, homo sapiens; identical to SEQ ID NO: 2750

SEQ ID NO: 11059 - protein, 108 aa, homo sapiens; identical to SEQ ID NO: 2751

SEQ ID NO: 11060 - DNA, 327 bp, homo sapiens; identical to SEQ ID NO: 2752

SEQ ID NO: 11061 - protein, 15 aa, homo sapiens
MKAGQWEPRDWFKSR

SEQ ID NO: 11062 - DNA, 48 bp, homo sapiens; identical to SEQ ID NO: 10766

SEQ ID NO: 11063 - protein, 51 aa, homo sapiens; identical to SEQ ID NO: 10767

SEQ ID NO: 11064 - DNA, 156 bp, homo sapiens; identical to SEQ ID NO: 10768

SEQ ID NO: 11065 - protein, 10 aa, homo sapiens
MVLGDGTPGV

SEQ ID NO: 11066 - DNA, 33 bp, homo sapiens; identical to SEQ ID NO: 6076

SEQ ID NO: 11067 - protein, 42 aa, homo sapiens; identical to SEQ ID NO: 6077

SEQ ID NO: 11068 - DNA, 129 bp, homo sapiens; identical to SEQ ID NO: 6078

SEQ ID NO: 11069 - protein, 59 aa, homo sapiens [sequence omitted]

SEQ ID NO: 11070 - DNA, 180 bp, homo sapiens; identical to SEQ ID NO: 6080

SEQ ID NO: 11071 - protein, 15 aa, homo sapiens
MRILVSYYILKKISL

SEQ ID NO: 11072 - DNA, 48 bp, homo sapiens; identical to SEQ ID NO: 8792

SEQ ID NO: 11073 - protein, 10 aa, homo sapiens
MVLGDGTPGV

SEQ ID NO: 11074 - DNA, 33 bp, homo sapiens; identical to SEQ ID NO: 6076

SEQ ID NO: 11075 - protein, 42 aa, homo sapiens; identical to SEQ ID NO: 6077

SEQ ID NO: 11076 - DNA, 129 bp, homo sapiens; identical to SEQ ID NO: 6078

SEQ ID NO: 11077 - protein, 59 aa, homo sapiens [sequence omitted]

SEQ ID NO: 11078 - DNA, 180 bp, homo sapiens; identical to SEQ ID NO: 6080

SEQ ID NO: 11079 - protein, 15 aa, homo sapiens
MRILVSYYILKKISL

SEQ ID NO: 11080 - DNA, 48 bp, homo sapiens; identical to SEQ ID NO: 8792

SEQ ID NO: 11081 - protein, 12 aa, homo sapiens
MGANLTFKVFNK

SEQ ID NO: 11082 - DNA, 39 bp, homo sapiens; identical to SEQ ID NO: 8770

SEQ ID NO: 11083 - protein, 32 aa, homo sapiens; identical to SEQ ID NO: 8771

SEQ ID NO: 11084 - DNA, 99 bp, homo sapiens; identical to SEQ ID NO: 8772

SEQ ID NO: 11085 - protein, 9 aa, homo sapiens
MEGRGEKTE

SEQ ID NO: 11086 - DNA, 30 bp, homo sapiens; identical to SEQ ID NO: 8774

SEQ ID NO: 11087 - protein, 18 aa, homo sapiens
MNFSSYLQEVSYVLERNV

SEQ ID NO: 11088 - DNA, 57 bp, homo sapiens; identical to SEQ ID NO: 8776

SEQ ID NO: 11089 - protein, 12 aa, homo sapiens
MGANLTFKVFNK

SEQ ID NO: 11090 - DNA, 39 bp, homo sapiens; identical to SEQ ID NO: 8770

SEQ ID NO: 11091 - protein, 32 aa, homo sapiens; identical to SEQ ID NO: 8771

SEQ ID NO: 11092 - DNA, 99 bp, homo sapiens; identical to SEQ ID NO: 8772

SEQ ID NO: 11093 - protein, 9 aa, homo sapiens
MEGRGEKTE

SEQ ID NO: 11094 - DNA, 30 bp, homo sapiens; identical to SEQ ID NO: 8774

SEQ ID NO: 11095 - protein, 18 aa, homo sapiens
MNFSSYLQEVSYVLERNV

SEQ ID NO: 11096 - DNA, 57 bp, homo sapiens; identical to SEQ ID NO: 8776

SEQ ID NO: 11097 - protein, 23 aa, homo sapiens
MLGTPGGAGPRGPAASSGSVPSR

SEQ ID NO: 11098 - DNA, 72 bp, homo sapiens; identical to SEQ ID NO: 8810

SEQ ID NO: 11099 - protein, 25 aa, homo sapiens
MKNPVPSAFFFSSLGSRHVMVLLYF

SEQ ID NO: 11100 - DNA, 78 bp, homo sapiens; identical to SEQ ID NO: 8812

SEQ ID NO: 11101 - protein, 13 aa, homo sapiens
MAHIPQHPKSSAT

SEQ ID NO: 11102 - DNA, 42 bp, homo sapiens; identical to SEQ ID NO: 8814

SEQ ID NO: 11103 - protein, 36 aa, homo sapiens; identical to SEQ ID NO: 8815

SEQ ID NO: 11104 - DNA, 111 bp, homo sapiens; identical to SEQ ID NO: 8816

SEQ ID NO: 11105 - protein, 17 aa, homo sapiens
MRIRLGALPLASGWSII

SEQ ID NO: 11106 - DNA, 54 bp, homo sapiens; identical to SEQ ID NO: 8482

SEQ ID NO: 11107 - protein, 18 aa, homo sapiens
MEYYLISCGVSVYYGVLI

SEQ ID NO: 11108 - DNA, 57 bp, homo sapiens; identical to SEQ ID NO: 8484

SEQ ID NO: 11109 - protein, 54 aa, homo sapiens [sequence omitted]

SEQ ID NO: 11110 - DNA, 165 bp, homo sapiens; identical to SEQ ID NO: 8486

SEQ ID NO: 11111 - protein, 8 aa, homo sapiens
MGLTWKLH

SEQ ID NO: 11112 - DNA, 27 bp, homo sapiens
atggggctgacttggaagttacattag

SEQ ID NO: 11113 - protein, 12 aa, homo sapiens
MGANLTFKVFNK

SEQ ID NO: 11114 - DNA, 39 bp, homo sapiens; identical to SEQ ID NO: 8770

SEQ ID NO: 11115 - protein, 32 aa, homo sapiens; identical to SEQ ID NO: 8771

SEQ ID NO: 11116 - DNA, 99 bp, homo sapiens; identical to SEQ ID NO: 8772

SEQ ID NO: 11117 - protein, 9 aa, homo sapiens
MEGRGEKTE

SEQ ID NO: 11118 - DNA, 30 bp, homo sapiens; identical to SEQ ID NO: 8774

SEQ ID NO: 11119 - protein, 18 aa, homo sapiens
MNFSSYLQEVSYVLERNV

SEQ ID NO: 11120 - DNA, 57 bp, homo sapiens; identical to SEQ ID NO: 8776

SEQ ID NO: 11121 - protein, 36 aa, homo sapiens; identical to SEQ ID NO: 8833

SEQ ID NO: 11122 - DNA, 111 bp, homo sapiens; identical to SEQ ID NO: 8834

SEQ ID NO: 11123 - protein, 48 aa, homo sapiens; identical to SEQ ID NO: 8835

SEQ ID NO: 11124 - DNA, 147 bp, homo sapiens; identical to SEQ ID NO: 8836

SEQ ID NO: 11125 - protein, 17 aa, homo sapiens
MEVNLDLSRWPKRRAGG

SEQ ID NO: 11126 - DNA, 54 bp, homo sapiens; identical to SEQ ID NO: 8838

SEQ ID NO: 11127 - protein, 38 aa, homo sapiens [sequence omitted]

SEQ ID NO: 11128 - DNA, 117 bp, homo sapiens; identical to SEQ ID NO: 8840

SEQ ID NO: 11129 - protein, 12 aa, homo sapiens
MGANLTFKVFNK

SEQ ID NO: 11130 - DNA, 39 bp, homo sapiens; identical to SEQ ID NO: 8770

SEQ ID NO: 11131 - protein, 32 aa, homo sapiens; identical to SEQ ID NO: 8771

SEQ ID NO: 11132 - DNA, 99 bp, homo sapiens; identical to SEQ ID NO: 8772

SEQ ID NO: 11133 - protein, 9 aa, homo sapiens
MEGRGEKTE

SEQ ID NO: 11134 - DNA, 30 bp, homo sapiens; identical to SEQ ID NO: 8774

SEQ ID NO: 11135 - protein, 18 aa, homo sapiens
MNFSSYLQEVSYVLERNV

SEQ ID NO: 11136 - DNA, 57 bp, homo sapiens; identical to SEQ ID NO: 8776

SEQ ID NO: 11137 - protein, 30 aa, homo sapiens; identical to SEQ ID NO: 11009

SEQ ID NO: 11138 - DNA, 93 bp, homo sapiens; identical to SEQ ID NO: 11010

SEQ ID NO: 11139 - protein, 15 aa, homo sapiens
MARGEVSCLCLAILG

SEQ ID NO: 11140 - DNA, 48 bp, homo sapiens; identical to SEQ ID NO: 8738

SEQ ID NO: 11141 - protein, 13 aa, homo sapiens
MLWPDPLEINPES

SEQ ID NO: 11142 - DNA, 42 bp, homo sapiens; identical to SEQ ID NO: 8740

SEQ ID NO: 11143 - protein, 4 aa, homo sapiens
MRRR

SEQ ID NO: 11144 - DNA, 15 bp, homo sapiens
atgaggaggcgatga

SEQ ID NO: 11145 - protein, 127 aa, homo sapiens; identical to SEQ ID NO: 8857

SEQ ID NO: 11146 - DNA, 384 bp, homo sapiens; identical to SEQ ID NO: 8858

SEQ ID NO: 11147 - protein, 12 aa, homo sapiens
MWKGSVNRHPFC

SEQ ID NO: 11148 - DNA, 39 bp, homo sapiens; identical to SEQ ID NO: 8860

SEQ ID NO: 11149 - protein, 144 aa, homo sapiens; identical to SEQ ID NO: 8861

SEQ ID NO: 11150 - DNA, 435 bp, homo sapiens; identical to SEQ ID NO: 8862

SEQ ID NO: 11151 - protein, 112 aa, homo sapiens [sequence omitted]

SEQ ID NO: 11152 - DNA, 339 bp, homo sapiens; identical to SEQ ID NO: 6802

SEQ ID NO: 11153 - protein, 5 aa, homo sapiens
MVKRQ

SEQ ID NO: 11154 - DNA, 18 bp, homo sapiens
atggtgaaaagacagtag

SEQ ID NO: 11155 - protein, 18 aa, homo sapiens
MINACKGASLLYDKSWLT

SEQ ID NO: 11156 - DNA, 57 bp, homo sapiens; identical to SEQ ID NO: 8868

SEQ ID NO: 11157 - protein, 14 aa, homo sapiens
MHAKELLFYMTSLG

SEQ ID NO: 11158 - DNA, 45 bp, homo sapiens; identical to SEQ ID NO: 8870

SEQ ID NO: 11159 - protein, 8 aa, homo sapiens
MQRSFSSI

SEQ ID NO: 11160 - DNA, 27 bp, homo sapiens
atgcaaaggagcttctcttctatatga

SEQ ID NO: 11161 - protein, 67 aa, homo sapiens; identical to SEQ ID NO: 8881

SEQ ID NO: 11162 - DNA, 204 bp, homo sapiens; identical to SEQ ID NO: 8882

SEQ ID NO: 11163 - protein, 57 aa, homo sapiens [sequence omitted]

SEQ ID NO: 11164 - DNA, 174 bp, homo sapiens; identical to SEQ ID NO: 6856

SEQ ID NO: 11165 - protein, 27 aa, homo sapiens
MLFYNKPTKQPLWLWFLVPGSQEETSC

SEQ ID NO: 11166 - DNA, 84 bp, homo sapiens; identical to SEQ ID NO: 8886

SEQ ID NO: 11167 - protein, 13 aa, homo sapiens
MNTELPCLDRLLV

SEQ ID NO: 11168 - DNA, 42 bp, homo sapiens; identical to SEQ ID NO: 8888

SEQ ID NO: 11169 - protein, 42 aa, homo sapiens; identical to SEQ ID NO: 10009

SEQ ID NO: 11170 - DNA, 129 bp, homo sapiens; identical to SEQ ID NO: 10010

SEQ ID NO: 11171 - protein, 135 aa, homo sapiens; identical to SEQ ID NO: 10011

SEQ ID NO: 11172 - DNA, 408 bp, homo sapiens; identical to SEQ ID NO: 10012

SEQ ID NO: 11173 - protein, 101 aa, homo sapiens; identical to SEQ ID NO: 10013

SEQ ID NO: 11174 - DNA, 306 bp, homo sapiens; identical to SEQ ID NO: 10014

SEQ ID NO: 11175 - protein, 68 aa, homo sapiens; identical to SEQ ID NO: 6867

SEQ ID NO: 11176 - DNA, 207 bp, homo sapiens; identical to SEQ ID NO: 6868

SEQ ID NO: 11177 - protein, 5 aa, homo sapiens
MNQGF

SEQ ID NO: 11178 - DNA, 18 bp, homo sapiens
atgaaccaaggtttctga

SEQ ID NO: 11179 - protein, 93 aa, homo sapiens [sequence omitted]

SEQ ID NO: 11180 - DNA, 282 bp, homo sapiens; identical to SEQ ID NO: 6900

SEQ ID NO: 11181 - protein, 7 aa, homo sapiens
MAASWKG

SEQ ID NO: 11182 - DNA, 24 bp, homo sapiens
atggcagcatcatggaaggggtga

SEQ ID NO: 11183 - protein, 16 aa, homo sapiens
MGDPGRGTLPGRWPGL

SEQ ID NO: 11184 - DNA, 51 bp, homo sapiens; identical to SEQ ID NO: 6904

SEQ ID NO: 11185 - protein, 80 aa, homo sapiens; identical to SEQ ID NO: 6907

SEQ ID NO: 11186 - DNA, 243 bp, homo sapiens; identical to SEQ ID NO: 6908

SEQ ID NO: 11187 - protein, 20 aa, homo sapiens
MSSSDWVPERLWTLCPAEEA

SEQ ID NO: 11188 - DNA, 63 bp, homo sapiens; identical to SEQ ID NO: 6910

SEQ ID NO: 11189 - protein, 29 aa, homo sapiens
MVLWMISNKKNGRVNYRAWTGGRGASRGR

SEQ ID NO: 11190 - DNA, 90 bp, homo sapiens; identical to SEQ ID NO: 6912

SEQ ID NO: 11191 - protein, 51 aa, homo sapiens [sequence omitted]

SEQ ID NO: 11192 - DNA, 156 bp, homo sapiens; identical to SEQ ID NO: 8896

SEQ ID NO: 11193 - protein, 43 aa, homo sapiens; identical to SEQ ID NO: 8897

SEQ ID NO: 11194 - DNA, 132 bp, homo sapiens; identical to SEQ ID NO: 8898

SEQ ID NO: 11195 - protein, 52 aa, homo sapiens; identical to SEQ ID NO: 8899

SEQ ID NO: 11196 - DNA, 159 bp, homo sapiens; identical to SEQ ID NO: 8900

SEQ ID NO: 11197 - protein, 67 aa, homo sapiens [sequence omitted]

SEQ ID NO: 11198 - DNA, 204 bp, homo sapiens; identical to SEQ ID NO: 8902

SEQ ID NO: 11199 - protein, 5 aa, homo sapiens
MCLRC

SEQ ID NO: 11200 - DNA, 18 bp, homo sapiens
atgtgtttacgatgttga

SEQ ID NO: 11201 - protein, 11 aa, homo sapiens
MGEPDLHVEKA

SEQ ID NO: 11202 - DNA, 36 bp, homo sapiens; identical to SEQ ID NO: 1562

SEQ ID NO: 11203 - protein, 36 aa, homo sapiens; identical to SEQ ID NO: 1563

SEQ ID NO: 11204 - DNA, 111 bp, homo sapiens; identical to SEQ ID NO: 1564

SEQ ID NO: 11205 - protein, 26 aa, homo sapiens
MRGGHGMGGAAVLPGGCRPRPGEGRG

SEQ ID NO: 11206 - DNA, 81 bp, homo sapiens; identical to SEQ ID NO: 1566

SEQ ID NO: 11207 - protein, 31 aa, homo sapiens; identical to SEQ ID NO: 1567

SEQ ID NO: 11208 - DNA, 96 bp, homo sapiens; identical to SEQ ID NO: 1568

SEQ ID NO: 11209 - protein, 14 aa, homo sapiens
MPPTRRVGVRRRAP

SEQ ID NO: 11210 - DNA, 45 bp, homo sapiens; identical to SEQ ID NO: 8922

SEQ ID NO: 11211 - protein, 84 aa, homo sapiens [sequence omitted]

SEQ ID NO: 11212 - DNA, 255 bp, homo sapiens; identical to SEQ ID NO: 8924

SEQ ID NO: 11213 - protein, 58 aa, homo sapiens; identical to SEQ ID NO: 8925

SEQ ID NO: 11214 - DNA, 177 bp, homo sapiens; identical to SEQ ID NO: 8926

SEQ ID NO: 11215 - protein, 6 aa, homo sapiens
MYYWVL

SEQ ID NO: 11216 - DNA, 21 bp, homo sapiens
atgtactactgggtcttgtaa

SEQ ID NO: 11217 - protein, 11 aa, homo sapiens
MVSVRGRASQG

SEQ ID NO: 11218 - DNA, 36 bp, homo sapiens; identical to SEQ ID NO: 7028

SEQ ID NO: 11219 - protein, 61 aa, homo sapiens; identical to SEQ ID NO: 7029

SEQ ID NO: 11220 - DNA, 186 bp, homo sapiens; identical to SEQ ID NO: 7030

SEQ ID NO: 11221 - protein, 24 aa, homo sapiens
MPAWEELWEKLWSGDPVPALPCSE

SEQ ID NO: 11222 - DNA, 75 bp, homo sapiens; identical to SEQ ID NO: 7032

SEQ ID NO: 11223 - protein, 35 aa, homo sapiens
MRSRPHQNRVHVSKWGLINGTAPAVARGLGAASGS

SEQ ID NO: 11224 - DNA, 108 bp, homo sapiens
atgagatcgaggccccatcaaaacagagttcatgtgagcaaatggggactcattaatgggacagcgccggccgtggctcgtggtttgggggctgccagcgggtcttga

SEQ ID NO: 11225 - protein, 6 aa, homo sapiens
MRWKVG

SEQ ID NO: 11226 - DNA, 21 bp, homo sapiens
atgcggtggaaggtcggctga

SEQ ID NO: 11227 - protein, 10 aa, homo sapiens
MDRARWPSSV

SEQ ID NO: 11228 - DNA, 33 bp, homo sapiens; identical to SEQ ID NO: 1580

SEQ ID NO: 11229 - protein, 25 aa, homo sapiens
MGYPRGADTGRLRLLEEKRGVGFLS

SEQ ID NO: 11230 - DNA, 78 bp, homo sapiens; identical to SEQ ID NO: 1582

SEQ ID NO: 11231 - protein, 4 aa, homo sapiens
MNCA

SEQ ID NO: 11232 - DNA, 15 bp, homo sapiens
atgaactgtgcctga

SEQ ID NO: 11233 - protein, 142 aa, homo sapiens; identical to SEQ ID NO: 7049

SEQ ID NO: 11234 - DNA, 429 bp, homo sapiens; identical to SEQ ID NO: 7050

SEQ ID NO: 11235 - protein, 43 aa, homo sapiens; identical to SEQ ID NO: 7051

SEQ ID NO: 11236 - DNA, 132 bp, homo sapiens; identical to SEQ ID NO: 7052

SEQ ID NO: 11237 - protein, 16 aa, homo sapiens
MRQALSSEPLFALSAA

SEQ ID NO: 11238 - DNA, 51 bp, homo sapiens; identical to SEQ ID NO: 7054

SEQ ID NO: 11239 - protein, 6 aa, homo sapiens
MDLRHK

SEQ ID NO: 11240 - DNA, 21 bp, homo sapiens
atggatttgaggcacaagtga

SEQ ID NO: 11241 - protein, 108 aa, homo sapiens [sequence omitted]

SEQ ID NO: 11242 - DNA, 327 bp, homo sapiens; identical to SEQ ID NO: 7082

SEQ ID NO: 11243 - protein, 86 aa, homo sapiens; identical to SEQ ID NO: 7083

SEQ ID NO: 11244 - DNA, 261 bp, homo sapiens; identical to SEQ ID NO: 7084

SEQ ID NO: 11245 - protein, 8 aa, homo sapiens
MEMGKNPT

SEQ ID NO: 11246 - DNA, 27 bp, homo sapiens
atggaaatggggaagaacccgacttag

SEQ ID NO: 11247 - protein, 55 aa, homo sapiens; identical to SEQ ID NO: 7087

SEQ ID NO: 11248 - DNA, 168 bp, homo sapiens; identical to SEQ ID NO: 7088

SEQ ID NO: 11249 - protein, 6 aa, homo sapiens
MSAAGL

SEQ ID NO: 11250 - DNA, 21 bp, homo sapiens
atgtcagccgctggactgtag

SEQ ID NO: 11251 - protein, 5 aa, homo sapiens
MPLQP

SEQ ID NO: 11252 - DNA, 18 bp, homo sapiens
atgcccttgcagccttga

SEQ ID NO: 11253 - protein, 41 aa, homo sapiens; identical to SEQ ID NO: 7101

SEQ ID NO: 11254 - DNA, 126 bp, homo sapiens; identical to SEQ ID NO: 7102

SEQ ID NO: 11255 - protein, 48 aa, homo sapiens; identical to SEQ ID NO: 7103

SEQ ID NO: 11256 - DNA, 147 bp, homo sapiens; identical to SEQ ID NO: 7104

SEQ ID NO: 11257 - protein, 16 aa, homo sapiens
MVHTWVAASASPGSGV

SEQ ID NO: 11258 - DNA, 51 bp, homo sapiens; identical to SEQ ID NO: 7138

SEQ ID NO: 11259 - protein, 87 aa, homo sapiens [sequence omitted]

SEQ ID NO: 11260 - DNA, 264 bp, homo sapiens; identical to SEQ ID NO: 7140

SEQ ID NO: 11261 - protein, 13 aa, homo sapiens
MIVLSGCLSFLPG

SEQ ID NO: 11262 - DNA, 42 bp, homo sapiens; identical to SEQ ID NO: 7142

SEQ ID NO: 11263 - protein, 4 aa, homo sapiens
MLAL

SEQ ID NO: 11264 - DNA, 15 bp, homo sapiens
atgctggctctgtaa

SEQ ID NO: 11265 - protein, 96 aa, homo sapiens; identical to SEQ ID NO: 7179

SEQ ID NO: 11266 - DNA, 291 bp, homo sapiens; identical to SEQ ID NO: 7180

SEQ ID NO: 11267 - protein, 22 aa, homo sapiens
MLSFSPSPLLPGACLLNDVGGG

SEQ ID NO: 11268 - DNA, 69 bp, homo sapiens; identical to SEQ ID NO: 7182

SEQ ID NO: 11269 - protein, 41 aa, homo sapiens; identical to SEQ ID NO: 7183

SEQ ID NO: 11270 - DNA, 126 bp, homo sapiens; identical to SEQ ID NO: 7184

SEQ ID NO: 11271 - protein, 55 aa, homo sapiens; identical to SEQ ID NO: 8975

SEQ ID NO: 11272 - DNA, 168 bp, homo sapiens; identical to SEQ ID NO: 8976

SEQ ID NO: 11273 - protein, 20 aa, homo sapiens
MADFDTYDDRAYSSFGGGRG

SEQ ID NO: 11274 - DNA, 63 bp, homo sapiens; identical to SEQ ID NO: 7186

SEQ ID NO: 11275 - protein, 64 aa, homo sapiens; identical to SEQ ID NO: 7187

SEQ ID NO: 11276 - DNA, 195 bp, homo sapiens; identical to SEQ ID NO: 7188

SEQ ID NO: 11277 - protein, 15 aa, homo sapiens
MPGDERPLPAPSPLR

SEQ ID NO: 11278 - DNA, 48 bp, homo sapiens; identical to SEQ ID NO: 7190

SEQ ID NO: 11279 - protein, 13 aa, homo sapiens
MVRLLAGGGRPRR

SEQ ID NO: 11280 - DNA, 42 bp, homo sapiens; identical to SEQ ID NO: 7192

SEQ ID NO: 11281 - protein, 6 aa, homo sapiens
MWTFVL

SEQ ID NO: 11282 - DNA, 21 bp, homo sapiens
atgtggacttttgttctctaa

SEQ ID NO: 11283 - protein, 7 aa, homo sapiens
MTYQRGK

SEQ ID NO: 11284 - DNA, 24 bp, homo sapiens
atgacgtaccaaagaggaaaatag

SEQ ID NO: 11285 - protein, 21 aa, homo sapiens
MLCERVVCRSPSGLMDKALAS

SEQ ID NO: 11286 - DNA, 66 bp, homo sapiens; identical to SEQ ID NO: 8990

SEQ ID NO: 11287 - protein, 35 aa, homo sapiens; identical to SEQ ID NO: 8991

SEQ ID NO: 11288 - DNA, 108 bp, homo sapiens; identical to SEQ ID NO: 8992

SEQ ID NO: 11289 - protein, 18 aa, homo sapiens
MNFSVETAPPQSLFKKQK

SEQ ID NO: 11290 - DNA, 57 bp, homo sapiens; identical to SEQ ID NO: 9002

SEQ ID NO: 11291 - protein, 19 aa, homo sapiens
MPVDALTSKIFKGEVDTRY

SEQ ID NO: 11292 - DNA, 60 bp, homo sapiens; identical to SEQ ID NO: 1620

SEQ ID NO: 11293 - protein, 11 aa, homo sapiens
MSKPLGIIESP

SEQ ID NO: 11294 - DNA, 36 bp, homo sapiens; identical to SEQ ID NO: 1622

SEQ ID NO: 11295 - protein, 29 aa, homo sapiens
MGNERRKGKEMGWKEKSRRDRPIPVGLVP

SEQ ID NO: 11296 - DNA, 90 bp, homo sapiens; identical to SEQ ID NO: 1624

SEQ ID NO: 11297 - protein, 51 aa, homo sapiens; identical to SEQ ID NO: 7339

SEQ ID NO: 11298 - DNA, 156 bp, homo sapiens; identical to SEQ ID NO: 7340

SEQ ID NO: 11299 - protein, 25 aa, homo sapiens
MSRGFSPNQCPSLAFSTIFKHTFNI

SEQ ID NO: 11300 - DNA, 78 bp, homo sapiens; identical to SEQ ID NO: 7342

SEQ ID NO: 11301 - protein, 38 aa, homo sapiens; identical to SEQ ID NO: 7343

SEQ ID NO: 11302 - DNA, 117 bp, homo sapiens; identical to SEQ ID NO: 7344

SEQ ID NO: 11303 - protein, 8 aa, homo sapiens
MATYSSSV

SEQ ID NO: 11304 - DNA, 27 bp, homo sapiens
atggccacatactcttcatctgtgtaa

SEQ ID NO: 11305 - protein, 34 aa, homo sapiens; identical to SEQ ID NO: 7347

SEQ ID NO: 11306 - DNA, 105 bp, homo sapiens; identical to SEQ ID NO: 7348

SEQ ID NO: 11307 - protein, 7 aa, homo sapiens
MRGPLGV

SEQ ID NO: 11308 - DNA, 24 bp, homo sapiens
atgcgaggacccctcggggtctga

SEQ ID NO: 11309 - protein, 11 aa, homo sapiens
MNSLGFSARDF

SEQ ID NO: 11310 - DNA, 36 bp, homo sapiens; identical to SEQ ID NO: 7352

SEQ ID NO: 11311 - protein, 8 aa, homo sapiens
MPWANVYW

SEQ ID NO: 11312 - DNA, 27 bp, homo sapiens
atgccctgggcaaatgtttattggtga

SEQ ID NO: 11313 - protein, 24 aa, homo sapiens
MRVKKGRGLVRDTVWVVGVVGNAG

SEQ ID NO: 11314 - DNA, 75 bp, homo sapiens; identical to SEQ ID NO: 9026

SEQ ID NO: 11315 - protein, 13 aa, homo sapiens
MQVEGNSLGLWGI

SEQ ID NO: 11316 - DNA, 42 bp, homo sapiens; identical to SEQ ID NO: 9028

SEQ ID NO: 11317 - protein, 39 aa, homo sapiens; identical to SEQ ID NO: 9029

SEQ ID NO: 11318 - DNA, 120 bp, homo sapiens; identical to SEQ ID NO: 9030

SEQ ID NO: 11319 - protein, 27 aa, homo sapiens
MSLPASSWWPRQPVSEGCFVWGVGVIK

SEQ ID NO: 11320 - DNA, 84 bp, homo sapiens; identical to SEQ ID NO: 9032

SEQ ID NO: 11321 - protein, 112 aa, homo sapiens [sequence omitted]

SEQ ID NO: 11322 - DNA, 339 bp, homo sapiens; identical to SEQ ID NO: 7414

SEQ ID NO: 11323 - protein, 60 aa, homo sapiens; identical to SEQ ID NO: 7415

SEQ ID NO: 11324 - DNA, 183 bp, homo sapiens; identical to SEQ ID NO: 7416

SEQ ID NO: 11325 - protein, 14 aa, homo sapiens
MATLVAGATGPCSG

SEQ ID NO: 11326 - DNA, 45 bp, homo sapiens; identical to SEQ ID NO: 9054

SEQ ID NO: 11327 - protein, 11 aa, homo sapiens
MDREWCVFLLP

SEQ ID NO: 11328 - DNA, 36 bp, homo sapiens; identical to SEQ ID NO: 9056

SEQ ID NO: 11329 - protein, 263 aa, homo sapiens [sequence omitted]

SEQ ID NO: 11330 - DNA, 792 bp, homo sapiens; identical to SEQ ID NO: 7420

SEQ ID NO: 11331 - protein, 33 aa, homo sapiens; identical to SEQ ID NO: 7421

SEQ ID NO: 11332 - DNA, 102 bp, homo sapiens; identical to SEQ ID NO: 7422

SEQ ID NO: 11333 - protein, 15 aa, homo sapiens
MKALESYGSAEEDTL

SEQ ID NO: 11334 - DNA, 48 bp, homo sapiens; identical to SEQ ID NO: 7424

SEQ ID NO: 11335 - protein, 23 aa, homo sapiens
MVYSEENDLVRCTSKNFLSRGLN

SEQ ID NO: 11336 - DNA, 72 bp, homo sapiens; identical to SEQ ID NO: 10200

SEQ ID NO: 11337 - protein, 63 aa, homo sapiens; identical to SEQ ID NO: 7433

SEQ ID NO: 11338 - DNA, 192 bp, homo sapiens; identical to SEQ ID NO: 7434

SEQ ID NO: 11339 - protein, 28 aa, homo sapiens
MQCDPSGSVCRILCVRCDPHQGVTPILG

SEQ ID NO: 11340 - DNA, 87 bp, homo sapiens; identical to SEQ ID NO: 7436

SEQ ID NO: 11341 - protein, 6 aa, homo sapiens
MCNWDP

SEQ ID NO: 11342 - DNA, 21 bp, homo sapiens
atgtgcaactgggacccttga

SEQ ID NO: 11343 - protein, 6 aa, homo sapiens
MPGCAM

SEQ ID NO: 11344 - DNA, 21 bp, homo sapiens
atgcctggctgtgcgatgtga

SEQ ID NO: 11345 - protein, 5 aa, homo sapiens
MEEGL

SEQ ID NO: 11346 - DNA, 18 bp, homo sapiens
atggaggagggattgtaa

SEQ ID NO: 11347 - protein, 9 aa, homo sapiens
MAAAGSSLL

SEQ ID NO: 11348 - DNA, 30 bp, homo sapiens; identical to SEQ ID NO: 7492

SEQ ID NO: 11349 - protein, 296 aa, homo sapiens [sequence omitted]

SEQ ID NO: 11350 - DNA, 891 bp, homo sapiens; identical to SEQ ID NO: 7494

SEQ ID NO: 11351 - protein, 23 aa, homo sapiens
MLPYSLGFSVVIPYLVTHQRFQH

SEQ ID NO: 11352 - DNA, 72 bp, homo sapiens; identical to SEQ ID NO: 7496

SEQ ID NO: 11353 - protein, 8 aa, homo sapiens
MAVLLKGL

SEQ ID NO: 11354 - DNA, 27 bp, homo sapiens
atggctgtgttgttgaagggcctgtag

SEQ ID NO: 11355 - protein, 96 aa, homo sapiens [sequence omitted]

SEQ ID NO: 11356 - DNA, 291 bp, homo sapiens; identical to SEQ ID NO: 7534

SEQ ID NO: 11357 - protein, 8 aa, homo sapiens
MLHERGLG

SEQ ID NO: 11358 - DNA, 27 bp, homo sapiens
atgctacacgagaggggcttaggatga

SEQ ID NO: 11359 - protein, 7 aa, homo sapiens
MSVGLLG

SEQ ID NO: 11360 - DNA, 24 bp, homo sapiens
atgtctgtggggctacttgggtga

SEQ ID NO: 11361 - protein, 47 aa, homo sapiens
MGAPLPTGRDGAPPLRPVGELRNLLGRFWAEGGLFWLGAVGEGPGPL

SEQ ID NO: 11362 - DNA, 144 bp, homo sapiens
atgggagccccgctgccgacggggagagatggggcgccccccctccgccccgtcggagagctgagaaacttgctgggaaggttctgggctgagggtggcctcttttggttgggcgccgttggggaggggccggggccgctctga

SEQ ID NO: 11363 - protein, 11 aa, homo sapiens
MGRPPSAPSES

SEQ ID NO: 11364 - DNA, 36 bp, homo sapiens; identical to SEQ ID NO: 9096

SEQ ID NO: 11365 - protein, 48 aa, homo sapiens
MPPPPPLSCLRGLQAPHQPGQPGFKFTVAESCDRIKDEFQFLQAQYHR

SEQ ID NO: 11366 - DNA, 147 bp, homo sapiens
atgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacaggtaa

SEQ ID NO: 11367 - protein, 32 aa, homo sapiens
MGAPPGGCQESGKVALEALGSGPQRRLSRRHA

SEQ ID NO: 11368 - DNA, 99 bp, homo sapiens
atgggggcgcccccgggggggtgtcaggaaagtggaaaagtggctctagaggcccttgggtcggggcctcagaggaggctgtccaggcgccacgcctga

SEQ ID NO: 11369 - protein, 143 aa, homo sapiens [sequence omitted]

SEQ ID NO: 11370 - DNA, 432 bp, homo sapiens; identical to SEQ ID NO: 1650

SEQ ID NO: 11371 - protein, 165 aa, homo sapiens [sequence omitted]

SEQ ID NO: 11372 - DNA, 498 bp, homo sapiens; identical to SEQ ID NO: 1652

SEQ ID NO: 11373 - protein, 13 aa, homo sapiens
MVFIPTWPPLDIP

SEQ ID NO: 11374 - DNA, 42 bp, homo sapiens; identical to SEQ ID NO: 1654

SEQ ID NO: 11375 - protein, 60 aa, homo sapiens; identical to SEQ ID NO: 1655

SEQ ID NO: 11376 - DNA, 183 bp, homo sapiens; identical to SEQ ID NO: 1656

SEQ ID NO: 11377 - protein, 63 aa, homo sapiens; identical to SEQ ID NO: 9065

SEQ ID NO: 11378 - DNA, 192 bp, homo sapiens; identical to SEQ ID NO: 9066

SEQ ID NO: 11379 - protein, 19 aa, homo sapiens
MGRKKKKQLKPWCWYPLSV

SEQ ID NO: 11380 - DNA, 60 bp, homo sapiens; identical to SEQ ID NO: 7578

SEQ ID NO: 11381 - protein, 17 aa, homo sapiens
MGFRGRQAFAVVGRVTL

SEQ ID NO: 11382 - DNA, 54 bp, homo sapiens; identical to SEQ ID NO: 7580

SEQ ID NO: 11383 - protein, 58 aa, homo sapiens; identical to SEQ ID NO: 7581

SEQ ID NO: 11384 - DNA, 177 bp, homo sapiens; identical to SEQ ID NO: 7582

SEQ ID NO: 11385 - protein, 31 aa, homo sapiens
MLSSGREVPFGGCILKLCHTGLRPHLQIGLR

SEQ ID NO: 11386 - DNA, 96 bp, homo sapiens
atgctttcttctggcagagaagtcccctttggggggtgcattttgaagctctgccacactggcctcagacctcatttgcaaattggcctgaggtga

SEQ ID NO: 11387 - protein, 23 aa, homo sapiens
MHTFRSPSSLLKTVMAGPGGSHL

SEQ ID NO: 11388 - DNA, 72 bp, homo sapiens
atgcatactttcaggtctccatcatctctattaaaaacggtgatggctgggcccggtggctcacacctgtaa

SEQ ID NO: 11389 - protein, 35 aa, homo sapiens
MQKKISRVWWRAPVVPATREAEAGEWREPGRRSLQ

SEQ ID NO: 11390 - DNA, 108 bp, homo sapiens
atgcaaaaaaaaattagccgagtgtggtggcgggcgcctgtagtcccagctactcgggaggctgaggcaggagaatggcgtgaacccgggaggcggagcttgcagtga

SEQ ID NO: 11391 - protein, 11 aa, homo sapiens
MTKSRLQKMQK

SEQ ID NO: 11392 - DNA, 36 bp, homo sapiens
atgacaaaatcccgtctacaaaagatgcaaaaatga

SEQ ID NO: 11393 - protein, 21 aa, homo sapiens
MSTFRQEDVEDHYEMGEELGR

SEQ ID NO: 11394 - DNA, 66 bp, homo sapiens; identical to SEQ ID NO: 9122

SEQ ID NO: 11395 - protein, 20 aa, homo sapiens
MRWGRSWAGELSARTAGLQG

SEQ ID NO: 11396 - DNA, 63 bp, homo sapiens; identical to SEQ ID NO: 9124

SEQ ID NO: 11397 - protein, 25 aa, homo sapiens
MLRRNESVSCGGGTNLGRGVRQPRL

SEQ ID NO: 11398 - DNA, 78 bp, homo sapiens; identical to SEQ ID NO: 9126

SEQ ID NO: 11399 - protein, 38 aa, homo sapiens; identical to SEQ ID NO: 9127

SEQ ID NO: 11400 - DNA, 117 bp, homo sapiens; identical to SEQ ID NO: 9128

SEQ ID NO: 11401 - protein, 70 aa, homo sapiens; identical to SEQ ID NO: 9129

SEQ ID NO: 11402 - DNA, 213 bp, homo sapiens; identical to SEQ ID NO: 9130

SEQ ID NO: 11403 - protein, 17 aa, homo sapiens
MKHYEVRSEKQGPCGHC

SEQ ID NO: 11404 - DNA, 54 bp, homo sapiens; identical to SEQ ID NO: 7642

SEQ ID NO: 11405 - protein, 41 aa, homo sapiens; identical to SEQ ID NO: 7643

SEQ ID NO: 11406 - DNA, 126 bp, homo sapiens; identical to SEQ ID NO: 7644

SEQ ID NO: 11407 - protein, 28 aa, homo sapiens
MGATKVRDPCSQSEGVLHKSCATPPSPA

SEQ ID NO: 11408 - DNA, 87 bp, homo sapiens; identical to SEQ ID NO: 7646

SEQ ID NO: 11409 - protein, 15 aa, homo sapiens
MGGGRAPPERLGGCR

SEQ ID NO: 11410 - DNA, 48 bp, homo sapiens; identical to SEQ ID NO: 7666

SEQ ID NO: 11411 - protein, 56 aa, homo sapiens; identical to SEQ ID NO: 7667

SEQ ID NO: 11412 - DNA, 171 bp, homo sapiens; identical to SEQ ID NO: 7668

SEQ ID NO: 11413 - protein, 85 aa, homo sapiens; identical to SEQ ID NO: 7669

SEQ ID NO: 11414 - DNA, 258 bp, homo sapiens; identical to SEQ ID NO: 7670

SEQ ID NO: 11415 - protein, 29 aa, homo sapiens
MLPQLWLGYITTALGEPCLERRGTQIRGL

SEQ ID NO: 11416 - DNA, 90 bp, homo sapiens; identical to SEQ ID NO: 7672

SEQ ID NO: 11417 - protein, 14 aa, homo sapiens
MSLSACFHLWLAAR

SEQ ID NO: 11418 - DNA, 45 bp, homo sapiens; identical to SEQ ID NO: 7674

SEQ ID NO: 11419 - protein, 21 aa, homo sapiens
MLGKGCSTYSGLYLPPAGKVL

SEQ ID NO: 11420 - DNA, 66 bp, homo sapiens; identical to SEQ ID NO: 7676

SEQ ID NO: 11421 - protein, 164 aa, homo sapiens [sequence omitted]

SEQ ID NO: 11422 - DNA, 495 bp, homo sapiens; identical to SEQ ID NO: 7678

SEQ ID NO: 11423 - protein, 24 aa, homo sapiens
MGVSSSPPGCGNSDGRFKYPTRGY

SEQ ID NO: 11424 - DNA, 75 bp, homo sapiens; identical to SEQ ID NO: 7680

SEQ ID NO: 11425 - protein, 16 aa, homo sapiens
MAWRYGATAAREFSFV

SEQ ID NO: 11426 - DNA, 51 bp, homo sapiens; identical to SEQ ID NO: 7682

SEQ ID NO: 11427 - protein, 54 aa, homo sapiens; identical to SEQ ID NO: 7683

SEQ ID NO: 11428 - DNA, 165 bp, homo sapiens; identical to SEQ ID NO: 7684

SEQ ID NO: 11429 - protein, 18 aa, homo sapiens
MWGAVQTLKSPHRSLHPE

SEQ ID NO: 11430 - DNA, 57 bp, homo sapiens; identical to SEQ ID NO: 7686

SEQ ID NO: 11431 - protein, 10 aa, homo sapiens
MRPVRVLKSP

SEQ ID NO: 11432 - DNA, 33 bp, homo sapiens; identical to SEQ ID NO: 7688

SEQ ID NO: 11433 - protein, 8 aa, homo sapiens
MRMNWVLS

SEQ ID NO: 11434 - DNA, 27 bp, homo sapiens
atgaggatgaactgggttttaagctga

SEQ ID NO: 11435 - protein, 49 aa, homo sapiens; identical to SEQ ID NO: 10315

SEQ ID NO: 11436 - DNA, 150 bp, homo sapiens; identical to SEQ ID NO: 10316

SEQ ID NO: 11437 - protein, 32 aa, homo sapiens; identical to SEQ ID NO: 10317

SEQ ID NO: 11438 - DNA, 99 bp, homo sapiens; identical to SEQ ID NO: 10318

SEQ ID NO: 11439 - protein, 7 aa, homo sapiens
MVCVFLL

SEQ ID NO: 11440 - DNA, 24 bp, homo sapiens
atggtttgtgtgttcctcctgtaa

SEQ ID NO: 11441 - protein, 25 aa, homo sapiens
MPGWILQLRGFSGKQRPLLSRDPGS

SEQ ID NO: 11442 - DNA, 78 bp, homo sapiens; identical to SEQ ID NO: 8658

SEQ ID NO: 11443 - protein, 65 aa, homo sapiens; identical to SEQ ID NO: 8659

SEQ ID NO: 11444 - DNA, 198 bp, homo sapiens; identical to SEQ ID NO: 8660

SEQ ID NO: 11445 - protein, 4 aa, homo sapiens
MAFP

SEQ ID NO: 11446 - DNA, 15 bp, homo sapiens
atggccttcccctga

SEQ ID NO: 11447 - protein, 38 aa, homo sapiens; identical to SEQ ID NO: 8663

SEQ ID NO: 11448 - DNA, 117 bp, homo sapiens; identical to SEQ ID NO: 8664

SEQ ID NO: 11449 - protein, 31 aa, homo sapiens; identical to SEQ ID NO: 9185

SEQ ID NO: 11450 - DNA, 96 bp, homo sapiens; identical to SEQ ID NO: 9186

SEQ ID NO: 11451 - protein, 7 aa, homo sapiens
MEKPRLY

SEQ ID NO: 11452 - DNA, 24 bp, homo sapiens
atggagaaaccccgtctctactaa

SEQ ID NO: 11453 - protein, 24 aa, homo sapiens
MPVIPATREAEAGESLEPGRRRLR

SEQ ID NO: 11454 - DNA, 75 bp, homo sapiens; identical to SEQ ID NO: 9190

SEQ ID NO: 11455 - protein, 19 aa, homo sapiens
MLHKRWPASRVKEDSDTGA

SEQ ID NO: 11456 - DNA, 60 bp, homo sapiens; identical to SEQ ID NO: 9192

SEQ ID NO: 11457 - protein, 31 aa, homo sapiens; identical to SEQ ID NO: 9185

SEQ ID NO: 11458 - DNA, 96 bp, homo sapiens; identical to SEQ ID NO: 9186

SEQ ID NO: 11459 - protein, 7 aa, homo sapiens
MEKPRLY

SEQ ID NO: 11460 - DNA, 24 bp, homo sapiens
atggagaaaccccgtctctactaa

SEQ ID NO: 11461 - protein, 24 aa, homo sapiens
MPVIPATREAEAGESLEPGRRRLR

SEQ ID NO: 11462 - DNA, 75 bp, homo sapiens; identical to SEQ ID NO: 9190

SEQ ID NO: 11463 - protein, 19 aa, homo sapiens
MLHKRWPASRVKEDSDTGA

SEQ ID NO: 11464 - DNA, 60 bp, homo sapiens; identical to SEQ ID NO: 9192

SEQ ID NO: 11465 - protein, 183 aa, homo sapiens; identical to SEQ ID NO: 9201

SEQ ID NO: 11466 - DNA, 552 bp, homo sapiens; identical to SEQ ID NO: 9202

SEQ ID NO: 11467 - protein, 8 aa, homo sapiens
MRCSSARA

SEQ ID NO: 11468 - DNA, 27 bp, homo sapiens
atgaggtgctcttccgcgagggcgtga

SEQ ID NO: 11469 - protein, 68 aa, homo sapiens; identical to SEQ ID NO: 9205

SEQ ID NO: 11470 - DNA, 207 bp, homo sapiens; identical to SEQ ID NO: 9206

SEQ ID NO: 11471 - protein, 5 aa, homo sapiens
MMGGK

SEQ ID NO: 11472 - DNA, 18 bp, homo sapiens
atgatgggtggcaagtag

SEQ ID NO: 11473 - protein, 31 aa, homo sapiens [sequence omitted]

SEQ ID NO: 11474 - DNA, 96 bp, homo sapiens; identical to SEQ ID NO: 7882

SEQ ID NO: 11475 - protein, 66 aa, homo sapiens; identical to SEQ ID NO: 7883

SEQ ID NO: 11476 - DNA, 201 bp, homo sapiens; identical to SEQ ID NO: 7884

SEQ ID NO: 11477 - protein, 39 aa, homo sapiens [sequence omitted]

SEQ ID NO: 11478 - DNA, 120 bp, homo sapiens; identical to SEQ ID NO: 7886

SEQ ID NO: 11479 - protein, 25 aa, homo sapiens
MRGMRPRDRVVGGGGGRRSAPPSST

SEQ ID NO: 11480 - DNA, 78 bp, homo sapiens; identical to SEQ ID NO: 7888

SEQ ID NO: 11481 - protein, 19 aa, homo sapiens
MGTLPDLFPGGVSAVSFSP

SEQ ID NO: 11482 - DNA, 60 bp, homo sapiens; identical to SEQ ID NO: 8002

SEQ ID NO: 11483 - protein, 172 aa, homo sapiens; identical to SEQ ID NO: 8003

SEQ ID NO: 11484 - DNA, 519 bp, homo sapiens; identical to SEQ ID NO: 8004

SEQ ID NO: 11485 - protein, 75 aa, homo sapiens; identical to SEQ ID NO: 8005

SEQ ID NO: 11486 - DNA, 228 bp, homo sapiens; identical to SEQ ID NO: 8006

SEQ ID NO: 11487 - protein, 23 aa, homo sapiens
MGPFLAVWVTAWEADLREKSVEI

SEQ ID NO: 11488 - DNA, 72 bp, homo sapiens; identical to SEQ ID NO: 8008

SEQ ID NO: 11489 - protein, 24 aa, homo sapiens
MYLIAKDFSTLFSYVFFNCKLLGF

SEQ ID NO: 11490 - DNA, 75 bp, homo sapiens; identical to SEQ ID NO: 8402

SEQ ID NO: 11491 - protein, 7 aa, homo sapiens
MDGINCC

SEQ ID NO: 11492 - DNA, 24 bp, homo sapiens
atggatggaattaattgctgttag

SEQ ID NO: 11493 - protein, 19 aa, homo sapiens
MELIAVRRLENSKYRFGRW

SEQ ID NO: 11494 - DNA, 60 bp, homo sapiens; identical to SEQ ID NO: 8406

SEQ ID NO: 11495 - protein, 18 aa, homo sapiens
MFYLFFPYFSLFQSYTWT

SEQ ID NO: 11496 - DNA, 57 bp, homo sapiens; identical to SEQ ID NO: 8408

SEQ ID NO: 11497 - protein, 39 aa, homo sapiens; identical to SEQ ID NO: 8225

SEQ ID NO: 11498 - DNA, 120 bp, homo sapiens; identical to SEQ ID NO: 8226

SEQ ID NO: 11499 - protein, 26 aa, homo sapiens
MLNSILIVRLKLRHHFILQSAVGLWP

SEQ ID NO: 11500 - DNA, 81 bp, homo sapiens; identical to SEQ ID NO: 96

SEQ ID NO: 11501 - protein, 32 aa, homo sapiens; identical to SEQ ID NO: 8229

SEQ ID NO: 11502 - DNA, 99 bp, homo sapiens; identical to SEQ ID NO: 8230

SEQ ID NO: 11503 - protein, 4 aa, homo sapiens
MCRE

SEQ ID NO: 11504 - DNA, 15 bp, homo sapiens
atgtgcagagagtaa

SEQ ID NO: 11505 - protein, 39 aa, homo sapiens; identical to SEQ ID NO: 9241

SEQ ID NO: 11506 - DNA, 120 bp, homo sapiens; identical to SEQ ID NO: 9242

SEQ ID NO: 11507 - protein, 73 aa, homo sapiens; identical to SEQ ID NO: 9243

SEQ ID NO: 11508 - DNA, 222 bp, homo sapiens; identical to SEQ ID NO: 9244

SEQ ID NO: 11509 - protein, 19 aa, homo sapiens
MGFTDTELSFGEQSGIGDR

SEQ ID NO: 11510 - DNA, 60 bp, homo sapiens; identical to SEQ ID NO: 9246

SEQ ID NO: 11511 - protein, 36 aa, homo sapiens [sequence omitted]

SEQ ID NO: 11512 - DNA, 111 bp, homo sapiens; identical to SEQ ID NO: 9248

SEQ ID NO: 11513 - protein, 17 aa, homo sapiens
MANGWTGSRPGRRNPEL

SEQ ID NO: 11514 - DNA, 54 bp, homo sapiens; identical to SEQ ID NO: 3920

SEQ ID NO: 11515 - protein, 51 aa, homo sapiens; identical to SEQ ID NO: 8235

SEQ ID NO: 11516 - DNA, 156 bp, homo sapiens; identical to SEQ ID NO: 8236

SEQ ID NO: 11517 - protein, 6 aa, homo sapiens
MCFFVY

SEQ ID NO: 11518 - DNA, 21 bp, homo sapiens
atgtgcttctttgtttactaa

SEQ ID NO: 11519 - protein, 21 aa, homo sapiens
MLDGPVHCHGLFILRWLETDL

SEQ ID NO: 11520 - DNA, 66 bp, homo sapiens; identical to SEQ ID NO: 8240

SEQ ID NO: 11521 - protein, 13 aa, homo sapiens
MLPQLMVHQLSLA

SEQ ID NO: 11522 - DNA, 42 bp, homo sapiens; identical to SEQ ID NO: 8146

SEQ ID NO: 11523 - protein, 18 aa, homo sapiens
MFQDPFKNIILNVIFSSH

SEQ ID NO: 11524 - DNA, 57 bp, homo sapiens; identical to SEQ ID NO: 8148

SEQ ID NO: 11525 - protein, 52 aa, homo sapiens [sequence omitted]

SEQ ID NO: 11526 - DNA, 159 bp, homo sapiens; identical to SEQ ID NO: 8150

SEQ ID NO: 11527 - protein, 17 aa, homo sapiens
MPNPNLFSAFATSLCKT

SEQ ID NO: 11528 - DNA, 54 bp, homo sapiens; identical to SEQ ID NO: 8152

SEQ ID NO: 11529 - protein, 50 aa, homo sapiens [sequence omitted]

SEQ ID NO: 11530 - DNA, 153 bp, homo sapiens; identical to SEQ ID NO: 38

SEQ ID NO: 11531 - protein, 48 aa, homo sapiens; identical to SEQ ID NO: 8163

SEQ ID NO: 11532 - DNA, 147 bp, homo sapiens; identical to SEQ ID NO: 8164

SEQ ID NO: 11533 - protein, 13 aa, homo sapiens
MGAGAGRIVAGRD

SEQ ID NO: 11534 - DNA, 42 bp, homo sapiens; identical to SEQ ID NO: 40

SEQ ID NO: 11535 - protein, 109 aa, homo sapiens; identical to SEQ ID NO: 8167

SEQ ID NO: 11536 - DNA, 330 bp, homo sapiens; identical to SEQ ID NO: 8168

SEQ ID NO: 11537 - protein, 38 aa, homo sapiens; identical to SEQ ID NO: 7715

SEQ ID NO: 11538 - DNA, 117 bp, homo sapiens; identical to SEQ ID NO: 7716

SEQ ID NO: 11539 - protein, 47 aa, homo sapiens; identical to SEQ ID NO: 9171

SEQ ID NO: 11540 - DNA, 144 bp, homo sapiens; identical to SEQ ID NO: 9172

SEQ ID NO: 11541 - protein, 127 aa, homo sapiens; identical to SEQ ID NO: 7717

SEQ ID NO: 11542 - DNA, 384 bp, homo sapiens; identical to SEQ ID NO: 7718

SEQ ID NO: 11543 - protein, 45 aa, homo sapiens; identical to SEQ ID NO: 7719

SEQ ID NO: 11544 - DNA, 138 bp, homo sapiens; identical to SEQ ID NO: 7720

SEQ ID NO: 11545 - protein, 142 aa, homo sapiens
MSGGGEAQHPCSLGDPGFQVPDPSSLRSGSTPPSPPPIPESEPPAPFFPGSRSLSPQSVLSDQGIHTPAPNSFKTPEFRTSAPLPKERGPQPSVPLEPKRSGSGIFLPLKPAVLGIPRPLLLRNPGVPTSSLAPAGVQPSRG

SEQ ID NO: 11546 - DNA, 429 bp, homo sapiens
atgtctggaggaggagaggcccagcatccatgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaactccttcaaaaccccagagttcagaacctcagcccctcttcccaaggagcgcggcccccaaccctctgttcctctagaacccaagcgttcaggctccggcatctttctccctttgaagcctgcagttctggggatccccaggcccctcctcctccggaacccaggagtccccacctcctctttagccccagctggagtccagccctccaggggttaa

SEQ ID NO: 11547 - protein, 60 aa, homo sapiens
MLPRGPGIPGPRPLLPQIWEYTTQSPTHSRIRAPSPLFSRIQESEPPVCSLRPGNPHSSP

SEQ ID NO: 11548 - DNA, 183 bp, homo sapiens
atgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaa

SEQ ID NO: 11549 - protein, 55 aa, homo sapiens
MVPDCLGLLSDPWGLPRVRREGEGDLGLGEVQSLPLPQSGAMGPGSSRFHQRLVQ

SEQ ID NO: 11550 - DNA, 168 bp, homo sapiens
atggtgccagactgtttgggtctgctctctgacccttgggggctccccagggtccgcagagagggggagggggacctaggcctgggggaagtccagagcctaccccttccccaaagcggggctatgggcccagggagttcgcgtttccaccaacgccttgtccagtga

SEQ ID NO: 11551 - protein, 60 aa, homo sapiens
MLRSGESLRFSASPLPSPSSSGPRQPRGMLGTQAWAPGQVGVGGWGRGQPPPFPFLPTLA

SEQ ID NO: 11552 - DNA, 183 bp, homo sapiens
atgcttaggtccggggaatctctgagattctcggcttcccctctcccctcaccctcctcctcaggccccaggcagccccggggcatgctgggaacccaggcctgggctccgggccaggttggtgtgggggggtgggggcgggggcagcctcctcccttccccttcctccccaccttggcctga

SEQ ID NO: 11553 - protein, 80 aa, homo sapiens [sequence omitted]

SEQ ID NO: 11554 - DNA, 243 bp, homo sapiens; identical to SEQ ID NO: 3830

SEQ ID NO: 11555 - protein, 31 aa, homo sapiens; identical to SEQ ID NO: 3831

SEQ ID NO: 11556 - DNA, 96 bp, homo sapiens; identical to SEQ ID NO: 3832

SEQ ID NO: 11557 - protein, 16 aa, homo sapiens
MHFKGWERAKPLDSFS

SEQ ID NO: 11558 - DNA, 51 bp, homo sapiens; identical to SEQ ID NO: 8200

SEQ ID NO: 11559 - protein, 33 aa, homo sapiens
MPNLVCTCFTSFFSCRLEWCERSAELALEGQKK

SEQ ID NO: 11560 - DNA, 102 bp, homo sapiens
atgccaaatttagtgtgtacctgttttacttcattctttagctgtaggttggagtggtgtgagcgatctgcagaactggcattagaggggcagaagaagtag

SEQ ID NO: 11561 - protein, 12 aa, homo sapiens
MLWFTKRETDFF

SEQ ID NO: 11562 - DNA, 39 bp, homo sapiens
atgctctggttcaccaagagggagactgattttttttaa

SEQ ID NO: 11563 - protein, 80 aa, homo sapiens
MLIIIIIIIIIIITFLIMVIISSCQVERPPAPARLLRLPQRRQQAVRAWPWRPLPGCFLHLQHPPPYSSACVLSRSFSFQ

SEQ ID NO: 11564 - DNA, 243 bp, homo sapiens
atgctcatcatcatcatcatcatcatcatcatcatcatcacgttccttatcatggttatcatttcctcctgccaggtggagcgaccaccagcgccggctcgcctcctgcgccttccccagcgaaggcagcaagcagttcgggcttggccgtggcggccgctcccaggatgcttcctgcacctccagcatccccccccttattcatctgcctgtgtattatctcgatccttttcatttcagtag

SEQ ID NO: 11565 - protein, 111 aa, homo sapiens
MLPAPPASPPLFICLCIISILFISVDPLPLVGPAESLGTAASLLKKENKKPKTLCGRRDKAPWVRREGTRRSAEPRTRVAAAEGRPPGVRNAEGIRIVFYLSLWLAFTVST

SEQ ID NO: 11566 - DNA, 336 bp, homo sapiens
atgcttcctgcacctccagcatccccccccttattcatctgcctgtgtattatctcgatccttttcatttcagtagatccactgcctttggttgggccggctgaatcgctggggactgcggccagtctcttaaaaaaggagaacaaaaagccgaagaccttgtgtggccgccgggacaaagcaccttgggttcggcgagaagggacgcgcaggagcgctgaacccagaacacgcgtggccgctgcggaagggcgtccgcccggcgtgcggaacgctgagggtattcggattgtcttttatttgtccctgtggcttgctttcacagtgtctacgtag

SEQ ID NO: 11567 - protein, 27 aa, homo sapiens
MRGLERGQGTQGLEKRRSPLLPGGLRE

SEQ ID NO: 11568 - DNA, 84 bp, homo sapiens
atgcgggggttggaaaggggacaggggactcaaggcttagaaaagagaaggagccctctgctgcctggagggctaagggagtag

SEQ ID NO: 11569 - protein, 142 aa, homo sapiens; identical to SEQ ID NO: 11545

SEQ ID NO: 11570 - DNA, 429 bp, homo sapiens; identical to SEQ ID NO: 11546

SEQ ID NO: 11571 - protein, 60 aa, homo sapiens; identical to SEQ ID NO: 11547

SEQ ID NO: 11572 - DNA, 183 bp, homo sapiens; identical to SEQ ID NO: 11548

SEQ ID NO: 11573 - protein, 55 aa, homo sapiens; identical to SEQ ID NO: 11549

SEQ ID NO: 11574 - DNA, 168 bp, homo sapiens; identical to SEQ ID NO: 11550

SEQ ID NO: 11575 - protein, 60 aa, homo sapiens; identical to SEQ ID NO: 11551

SEQ ID NO: 11576 - DNA, 183 bp, homo sapiens; identical to SEQ ID NO: 11552

SEQ ID NO: 11577 - protein, 44 aa, homo sapiens [sequence omitted]

SEQ ID NO: 11578 - DNA, 135 bp, homo sapiens; identical to SEQ ID NO: 4228

SEQ ID NO: 11579 - protein, 18 aa, homo sapiens
MGARDLQLFRRDPGPEAA

SEQ ID NO: 11580 - DNA, 57 bp, homo sapiens; identical to SEQ ID NO: 4230

SEQ ID NO: 11581 - protein, 39 aa, homo sapiens; identical to SEQ ID NO: 4231

SEQ ID NO: 11582 - DNA, 120 bp, homo sapiens; identical to SEQ ID NO: 4232

SEQ ID NO: 11583 - protein, 48 aa, homo sapiens; identical to SEQ ID NO: 8309

SEQ ID NO: 11584 - DNA, 147 bp, homo sapiens; identical to SEQ ID NO: 8310

SEQ ID NO: 11585 - protein, 21 aa, homo sapiens
MGWDGFWGGVPNSDWEWRNPS

SEQ ID NO: 11586 - DNA, 66 bp, homo sapiens; identical to SEQ ID NO: 4722

SEQ ID NO: 11587 - protein, 13 aa, homo sapiens
MRLGRLLSPAPQM

SEQ ID NO: 11588 - DNA, 42 bp, homo sapiens; identical to SEQ ID NO: 4724

SEQ ID NO: 11589 - protein, 59 aa, homo sapiens [sequence omitted]

SEQ ID NO: 11590 - DNA, 180 bp, homo sapiens; identical to SEQ ID NO: 4726

SEQ ID NO: 11591 - protein, 32 aa, homo sapiens; identical to SEQ ID NO: 4727

SEQ ID NO: 11592 - DNA, 99 bp, homo sapiens; identical to SEQ ID NO: 4728

SEQ ID NO: 11593 - protein, 7 aa, homo sapiens
MQKPLLY

SEQ ID NO: 11594 - DNA, 24 bp, homo sapiens
atgcagaaaccccttctctactaa

SEQ ID NO: 11595 - protein, 96 aa, homo sapiens
MNPGGRACSEPRLCHCTPAWATETDSISKKKKKLASVSPSASCPSIKFFLLRQRESRPLLTYFGAETQIHSASNRALKAHLSSTLHLGTRNPQPEW

SEQ ID NO: 11596 - DNA, 291 bp, homo sapiens
atgaacccgggaggcagagcttgcagtgagccgagattgtgccactgcactccagcctgggcgacagagacagactccatctcaaaaaaaaaaaaaaaacttgcctcagtctctccttcagcctcatgtccttccatcaaattctttcttctgaggcagcgagaatcgaggccgctgctgacatactttggtgctgaaactcagatacattctgccagtaatagagctctgaaggctcacctgagctccacactccacctcggcacacgcaaccctcagccagagtggtga

SEQ ID NO: 11597 - protein, 23 aa, homo sapiens
MSFHQILSSEAARIEAAADILWC

SEQ ID NO: 11598 - DNA, 72 bp, homo sapiens
atgtccttccatcaaattctttcttctgaggcagcgagaatcgaggccgctgctgacatactttggtgctga

SEQ ID NO: 11599 - protein, 4 aa, homo sapiens
MSHF

SEQ ID NO: 11600 - DNA, 15 bp, homo sapiens
atgtcccacttctga

SEQ ID NO: 11601 - protein, 7 aa, homo sapiens
MQKPLLY

SEQ ID NO: 11602 - DNA, 24 bp, homo sapiens
atgcagaaaccccttctctactaa

SEQ ID NO: 11603 - protein, 96 aa, homo sapiens; identical to SEQ ID NO: 11595

SEQ ID NO: 11604 - DNA, 291 bp, homo sapiens; identical to SEQ ID NO: 11596

SEQ ID NO: 11605 - protein, 23 aa, homo sapiens
MSFHQILSSEAARIEAAADILWC

SEQ ID NO: 11606 - DNA, 72 bp, homo sapiens; identical to SEQ ID NO: 11598

SEQ ID NO: 11607 - protein, 4 aa, homo sapiens
MSHF

SEQ ID NO: 11608 - DNA, 15 bp, homo sapiens
atgtcccacttctga

SEQ ID NO: 11609 - protein, 44 aa, homo sapiens [sequence omitted]

SEQ ID NO: 11610 - DNA, 135 bp, homo sapiens; identical to SEQ ID NO: 4228

SEQ ID NO: 11611 - protein, 18 aa, homo sapiens
MGARDLQLFRRDPGPEAA

SEQ ID NO: 11612 - DNA, 57 bp, homo sapiens; identical to SEQ ID NO: 4230

SEQ ID NO: 11613 - protein, 39 aa, homo sapiens; identical to SEQ ID NO: 4231

SEQ ID NO: 11614 - DNA, 120 bp, homo sapiens; identical to SEQ ID NO: 4232

SEQ ID NO: 11615 - protein, 48 aa, homo sapiens; identical to SEQ ID NO: 8309

SEQ ID NO: 11616 - DNA, 147 bp, homo sapiens; identical to SEQ ID NO: 8310

SEQ ID NO: 11617 - protein, 192 aa, homo sapiens [sequence omitted]

SEQ ID NO: 11618 - DNA, 579 bp, homo sapiens; identical to SEQ ID NO: 4946

SEQ ID NO: 11619 - protein, 29 aa, homo sapiens
MDSDWPLEAPCPDGVACHHCEVRLGRTCT

SEQ ID NO: 11620 - DNA, 90 bp, homo sapiens; identical to SEQ ID NO: 4948

SEQ ID NO: 11621 - protein, 77 aa, homo sapiens; identical to SEQ ID NO: 4949

SEQ ID NO: 11622 - DNA, 234 bp, homo sapiens; identical to SEQ ID NO: 4950

SEQ ID NO: 11623 - protein, 7 aa, homo sapiens
MSTQFTI

SEQ ID NO: 11624 - DNA, 24 bp, homo sapiens
atgtcaacacagttcacaatatag

SEQ ID NO: 11625 - protein, 19 aa, homo sapiens
MGMRSEGEENKDEEKRKCE

SEQ ID NO: 11626 - DNA, 60 bp, homo sapiens
atgggaatgaggagtgagggagaagagaataaagatgaagagaaaagaaaatgtgagtag

SEQ ID NO: 11627 - protein, 25 aa, homo sapiens
MKRKENVSRKWYKDKEMDLIGEGEK

SEQ ID NO: 11628 - DNA, 78 bp, homo sapiens
atgaagagaaaagaaaatgtgagtagaaaatggtacaaggacaaggaaatggacttaataggagagggagagaagtga

SEQ ID NO: 11629 - protein, 25 aa, homo sapiens
MVQGQGNGLNRRGREVNEKKRRGDR

SEQ ID NO: 11630 - DNA, 78 bp, homo sapiens
atggtacaaggacaaggaaatggacttaataggagagggagagaagtgaatgagaaaaaaaggagaggagacagatga

SEQ ID NO: 11631 - protein, 17 aa, homo sapiens
MRKKGEETDEERRKNFK

SEQ ID NO: 11632 - DNA, 54 bp, homo sapiens
atgagaaaaaaaggagaggagacagatgaagaaagaagaaaaaattttaagtaa

SEQ ID NO: 11633 - protein, 10 aa, homo sapiens
MAPFGLPRAQ

SEQ ID NO: 11634 - DNA, 33 bp, homo sapiens; identical to SEQ ID NO: 2842

SEQ ID NO: 11635 - protein, 151 aa, homo sapiens; identical to SEQ ID NO: 2843

SEQ ID NO: 11636 - DNA, 456 bp, homo sapiens; identical to SEQ ID NO: 2844

SEQ ID NO: 11637 - protein, 41 aa, homo sapiens; identical to SEQ ID NO: 2845

SEQ ID NO: 11638 - DNA, 126 bp, homo sapiens; identical to SEQ ID NO: 2846

SEQ ID NO: 11639 - protein, 101 aa, homo sapiens; identical to SEQ ID NO: 2847

SEQ ID NO: 11640 - DNA, 306 bp, homo sapiens; identical to SEQ ID NO: 2848

SEQ ID NO: 11641 - protein, 10 aa, homo sapiens
MAPFGLPRAQ

SEQ ID NO: 11642 - DNA, 33 bp, homo sapiens; identical to SEQ ID NO: 2842

SEQ ID NO: 11643 - protein, 151 aa, homo sapiens; identical to SEQ ID NO: 2843

SEQ ID NO: 11644 - DNA, 456 bp, homo sapiens; identical to SEQ ID NO: 2844

SEQ ID NO: 11645 - protein, 41 aa, homo sapiens; identical to SEQ ID NO: 2845

SEQ ID NO: 11646 - DNA, 126 bp, homo sapiens; identical to SEQ ID NO: 2846

SEQ ID NO: 11647 - protein, 101 aa, homo sapiens; identical to SEQ ID NO: 2847

SEQ ID NO: 11648 - DNA, 306 bp, homo sapiens; identical to SEQ ID NO: 2848

SEQ ID NO: 11649 - protein, 10 aa, homo sapiens
MAPFGLPRAQ

SEQ ID NO: 11650 - DNA, 33 bp, homo sapiens; identical to SEQ ID NO: 2842

SEQ ID NO: 11651 - protein, 151 aa, homo sapiens; identical to SEQ ID NO: 2843

SEQ ID NO: 11652 - DNA, 456 bp, homo sapiens; identical to SEQ ID NO: 2844

SEQ ID NO: 11653 - protein, 41 aa, homo sapiens; identical to SEQ ID NO: 2845

SEQ ID NO: 11654 - DNA, 126 bp, homo sapiens; identical to SEQ ID NO: 2846

SEQ ID NO: 11655 - protein, 101 aa, homo sapiens; identical to SEQ ID NO: 2847

SEQ ID NO: 11656 - DNA, 306 bp, homo sapiens; identical to SEQ ID NO: 2848

SEQ ID NO: 11657 - protein, 5 aa, homo sapiens
MVSCI

SEQ ID NO: 11658 - DNA, 18 bp, homo sapiens
atggtgtcttgcatctag

SEQ ID NO: 11659 - protein, 56 aa, homo sapiens
MVSICILHQNFVVVFSLLQYVTNEVKTVGMGNLNEWHSSALSPTHTCQHAPQPSRK

SEQ ID NO: 11660 - DNA, 171 bp, homo sapiens
atggtttccatttgtatactccatcaaaattttgtggttgtgttcagcctattacaatatgtcactaatgaggtcaagactgtaggtatgggtaacctgaatgagtggcacagctctgccctgtcccccacccatacttgtcaacatgctccacagccttcaagaaaatag

SEQ ID NO: 11661 - protein, 8 aa, homo sapiens
MSLMRSRL

SEQ ID NO: 11662 - DNA, 27 bp, homo sapiens
atgtcactaatgaggtcaagactgtag

SEQ ID NO: 11663 - protein, 51 aa, homo sapiens
MSGTALPCPPPILVNMLHSLQENRTYQRFRRLGENTAMCAGNGTWHWQLHP

SEQ ID NO: 11664 - DNA, 156 bp, homo sapiens
atgagtggcacagctctgccctgtcccccacccatacttgtcaacatgctccacagccttcaagaaaataggacctatcagagatttagaagattgggtgagaatacggctatgtgtgctgggaatggcacttggcattggcaacttcatccatga

SEQ ID NO: 11665 - protein, 5 aa, homo sapiens
MVSCI

SEQ ID NO: 11666 - DNA, 18 bp, homo sapiens
atggtgtcttgcatctag

SEQ ID NO: 11667 - protein, 56 aa, homo sapiens; identical to SEQ ID NO: 11659

SEQ ID NO: 11668 - DNA, 171 bp, homo sapiens; identical to SEQ ID NO: 11660

SEQ ID NO: 11669 - protein, 8 aa, homo sapiens
MSLMRSRL

SEQ ID NO: 11670 - DNA, 27 bp, homo sapiens
atgtcactaatgaggtcaagactgtag

SEQ ID NO: 11671 - protein, 51 aa, homo sapiens; identical to SEQ ID NO: 11663

SEQ ID NO: 11672 - DNA, 156 bp, homo sapiens; identical to SEQ ID NO: 11664

SEQ ID NO: 11673 - protein, 36 aa, homo sapiens; identical to SEQ ID NO: 779

SEQ ID NO: 11674 - DNA, 111 bp, homo sapiens; identical to SEQ ID NO: 780

SEQ ID NO: 11675 - protein, 34 aa, homo sapiens; identical to SEQ ID NO: 781

SEQ ID NO: 11676 - DNA, 105 bp, homo sapiens; identical to SEQ ID NO: 782

SEQ ID NO: 11677 - protein, 44 aa, homo sapiens; identical to SEQ ID NO: 783

SEQ ID NO: 11678 - DNA, 135 bp, homo sapiens; identical to SEQ ID NO: 784

SEQ ID NO: 11679 - protein, 22 aa, homo sapiens
MKQSHARKAKSLEVKPLHPCNG

SEQ ID NO: 11680 - DNA, 69 bp, homo sapiens
atgaaacagtctcatgccaggaaagcaaaatccctggaggtgaagcccctccatccatgtaacggttaa

SEQ ID NO: 11681 - protein, 36 aa, homo sapiens; identical to SEQ ID NO: 779

SEQ ID NO: 11682 - DNA, 111 bp, homo sapiens; identical to SEQ ID NO: 780

SEQ ID NO: 11683 - protein, 34 aa, homo sapiens; identical to SEQ ID NO: 781

SEQ ID NO: 11684 - DNA, 105 bp, homo sapiens; identical to SEQ ID NO: 782

SEQ ID NO: 11685 - protein, 44 aa, homo sapiens; identical to SEQ ID NO: 783

SEQ ID NO: 11686 - DNA, 135 bp, homo sapiens; identical to SEQ ID NO: 784

SEQ ID NO: 11687 - protein, 22 aa, homo sapiens
MKQSHARKAKSLEVKPLHPCNG

SEQ ID NO: 11688 - DNA, 69 bp, homo sapiens; identical to SEQ ID NO: 11680

SEQ ID NO: 11689 - protein, 17 aa, homo sapiens
MRRTEEERGEKGEGVRD

SEQ ID NO: 11690 - DNA, 54 bp, homo sapiens
atgaggaggacagaggaagaaaggggggaaaaaggtgagggggtgagagactag

SEQ ID NO: 11691 - protein, 18 aa, homo sapiens
MFGVGTVGRTHGADSSAS

SEQ ID NO: 11692 - DNA, 57 bp, homo sapiens
atgtttggagtagggacagttgggagaacccatggcgctgacagctccgcatcttga

SEQ ID NO: 11693 - protein, 32 aa, homo sapiens
MALTAPHLDKVISCLSDIIRALEFSYQRFIQE

SEQ ID NO: 11694 - DNA, 99 bp, homo sapiens
atggcgctgacagctccgcatcttgataaagtcatttcctgtttatcagacatcattagggcattagagttctcataccaaagatttatccaagagtag

SEQ ID NO: 11695 - protein, 101 aa, homo sapiens
MSFLKTPEKFQPCVPHCSAVLCPNELLRGSCHPVSSGFSCPQFHLERPSPQDRMVRSYQSTAPVMLLLIFCMAFSSWLRQNSPLSNKDNMLLTELFLQFTY

SEQ ID NO: 11696 - DNA, 306 bp, homo sapiens
atgagcttcttaaagacaccagaaaagtttcaaccttgtgtgccacattgttctgctgtgctttgtccaaatgaacttttgcgaggcagctgccatccagtttcaagtggattctcttgcccacaatttcacttggaaagaccaagtcctcaagatcgcatggtacgcagctatcagagtacagctcctgtgatgcttttgcttattttttgtatggctttttcaagttggcttaggcagaattctcctctgagcaataaagacaacatgcttctcactgaactttttctccaattcacatactag

SEQ ID NO: 11697 - protein, 7 aa, homo sapiens
MQKPLLY

SEQ ID NO: 11698 - DNA, 24 bp, homo sapiens
atgcagaaaccccttctctactaa

SEQ ID NO: 11699 - protein, 96 aa, homo sapiens; identical to SEQ ID NO: 11595

SEQ ID NO: 11700 - DNA, 291 bp, homo sapiens; identical to SEQ ID NO: 11596

SEQ ID NO: 11701 - protein, 23 aa, homo sapiens
MSFHQILSSEAARIEAAADILWC

SEQ ID NO: 11702 - DNA, 72 bp, homo sapiens; identical to SEQ ID NO: 11598

SEQ ID NO: 11703 - protein, 4 aa, homo sapiens
MSHF

SEQ ID NO: 11704 - DNA, 15 bp, homo sapiens
atgtcccacttctga

SEQ ID NO: 11705 - protein, 21 aa, homo sapiens
MGWDGFWGGVPNSDWEWRNPS

SEQ ID NO: 11706 - DNA, 66 bp, homo sapiens; identical to SEQ ID NO: 4722

SEQ ID NO: 11707 - protein, 13 aa, homo sapiens
MRLGRLLSPAPQM

SEQ ID NO: 11708 - DNA, 42 bp, homo sapiens; identical to SEQ ID NO: 4724

SEQ ID NO: 11709 - protein, 59 aa, homo sapiens [sequence omitted]

SEQ ID NO: 11710 - DNA, 180 bp, homo sapiens; identical to SEQ ID NO: 4726

SEQ ID NO: 11711 - protein, 32 aa, homo sapiens; identical to SEQ ID NO: 4727

SEQ ID NO: 11712 - DNA, 99 bp, homo sapiens; identical to SEQ ID NO: 4728

SEQ ID NO: 11713 - protein, 17 aa, homo sapiens
MRRTEEERGEKGEGVRD

SEQ ID NO: 11714 - DNA, 54 bp, homo sapiens; identical to SEQ ID NO: 11690

SEQ ID NO: 11715 - protein, 18 aa, homo sapiens
MFGVGTVGRTHGADSSAS

SEQ ID NO: 11716 - DNA, 57 bp, homo sapiens; identical to SEQ ID NO: 11692

SEQ ID NO: 11717 - protein, 32 aa, homo sapiens; identical to SEQ ID NO: 11693

SEQ ID NO: 11718 - DNA, 99 bp, homo sapiens; identical to SEQ ID NO: 11694

SEQ ID NO: 11719 - protein, 101 aa, homo sapiens; identical to SEQ ID NO: 11695

SEQ ID NO: 11720 - DNA, 306 bp, homo sapiens; identical to SEQ ID NO: 11696

SEQ ID NO: 11721 - protein, 91 aa, homo sapiens
MQLILFMRSASLNPSHMHKGGSYQKAGVILGAAHHTPVYEESYNNYILVITCKLLKFGNALTKHIISKKEDYLRKRVLPLILTLAFRNLAV

SEQ ID NO: 11722 - DNA, 276 bp, homo sapiens
atgcagctcattctattcatgagaagtgcgtcattaaatccatcccacatgcacaaaggagggagttaccaaaaggcaggggtcatcttaggggctgcccaccacacacctgtgtatgaagaaagttacaacaattacattctagtcattacgtgcaaattactaaagtttgggaatgcacttactaaacatatcatctccaaaaaggaagattatctcagaaaacgagttctgcctttaatcctgactctggcatttagaaacctggctgtgtag

SEQ ID NO: 11723 - protein, 9 aa, homo sapiens
MKKVTTITF

SEQ ID NO: 11724 - DNA, 30 bp, homo sapiens
atgaagaaagttacaacaattacattctag

SEQ ID NO: 11725 - protein, 21 aa, homo sapiens
MHLLNISSPKRKIISENEFCL

SEQ ID NO: 11726 - DNA, 66 bp, homo sapiens
atgcacttactaaacatatcatctccaaaaaggaagattatctcagaaaacgagttctgcctttaa

SEQ ID NO: 11727 - protein, 50 aa, homo sapiens
MLLFPLLPVLACCVKTQTHRPTISGELNFPKQFLYSFTSECLFMPIPVFI

SEQ ID NO: 11728 - DNA, 153 bp, homo sapiens
atgctcctgtttcctcttctgcctgtcttggcatgttgtgtaaagacacaaacacacagacccaccatttcaggagagctcaactttcccaaacaattcctatattcctttacctctgagtgtctgttcatgcccatcccagtgtttatttag

SEQ ID NO: 11729 - protein, 37 aa, homo sapiens
MTKVSARQQDTEFNSSTTCQVDSVHDSAEQEVWAPSL

SEQ ID NO: 11730 - DNA, 114 bp, homo sapiens
atgaccaaagtctcagccaggcagcaggataccgagtttaactcatctaccacctgccaggtggactctgtgcatgactctgcagaacaagaagtttgggccccatctctttga

SEQ ID NO: 11731 - protein, 15 aa, homo sapiens
MTLQNKKFGPHLFEL

SEQ ID NO: 11732 - DNA, 48 bp, homo sapiens
atgactctgcagaacaagaagtttgggccccatctctttgagctctaa

SEQ ID NO: 11733 - protein, 23 aa, homo sapiens
MRELEKLAQGSHGRPEWKELPAA

SEQ ID NO: 11734 - DNA, 72 bp, homo sapiens
atgagggaactggagaagcttgcccagggttcccatgggagaccagagtggaaggagctaccagctgcctga

SEQ ID NO: 11735 - protein, 27 aa, homo sapiens
MGDQSGRSYQLPDNPAFSSPPRRTVPG

SEQ ID NO: 11736 - DNA, 84 bp, homo sapiens
atgggagaccagagtggaaggagctaccagctgcctgataacccagccttctcttctccacccaggagaactgttcctgggtga

SEQ ID NO: 11737 - protein, 142 aa, homo sapiens; identical to SEQ ID NO: 11545

SEQ ID NO: 11738 - DNA, 429 bp, homo sapiens; identical to SEQ ID NO: 11546

SEQ ID NO: 11739 - protein, 60 aa, homo sapiens; identical to SEQ ID NO: 11547

SEQ ID NO: 11740 - DNA, 183 bp, homo sapiens; identical to SEQ ID NO: 11548

SEQ ID NO: 11741 - protein, 55 aa, homo sapiens; identical to SEQ ID NO: 11549

SEQ ID NO: 11742 - DNA, 168 bp, homo sapiens; identical to SEQ ID NO: 11550

SEQ ID NO: 11743 - protein, 60 aa, homo sapiens; identical to SEQ ID NO: 11551

SEQ ID NO: 11744 - DNA, 183 bp, homo sapiens; identical to SEQ ID NO: 11552

SEQ ID NO: 11745 - protein, 16 aa, homo sapiens
MVGLNPPLWQETGEYT

SEQ ID NO: 11746 - DNA, 51 bp, homo sapiens
atggttggtttaaatccacccctctggcaggagactggggaatacacatga

SEQ ID NO: 11747 - protein, 34 aa, homo sapiens
MSLCLSPSLTPTPGSTGPPHTMLPVSRSLRPFNL

SEQ ID NO: 11748 - DNA, 105 bp, homo sapiens
atgtctctgtgcctatctccatctctgacccccaccccagggtctaccgggccaccgcacaccatgttgccagtctctaggtccctgagaccctttaacctgtga

SEQ ID NO: 11749 - protein, 84 aa, homo sapiens [sequence omitted]

SEQ ID NO: 11750 - DNA, 255 bp, homo sapiens
atgtttaaacatagatttttttacatgcattctttttttcctgaaagaaaatattttttatattctttaggcgcgaatgtgtgtttaaaaaaaataaaaccttggagtaaagtagcagcacataatggtttgtggattttgaaaaggtgcaggccatattgtgctgcctcaaaaatacaaggatctgatcttctgaagaaaatatatttctttttattcatagctcttatgatagcaatgtcagcagtgccttag

SEQ ID NO: 11751 - protein, 10 aa, artificial sequence
  miPEP fragment
MVGLNPPLWQ

SEQ ID NO: 11752 - protein, 10 aa, artificial sequence
  miPEP fragment
MSLCLSPSLT

SEQ ID NO: 11753 - protein, 10 aa, artificial sequence
  miPEP fragment
MFKHRFFYMH

SEQ ID NO: 11754 - protein, 11 aa, artificial sequence
  penetration peptide
YGRKKRRQRRR

SEQ ID NO: 11755 - protein, 21 aa, artificial sequence
  miPEP fragment + penetration peptide
MVGLNPPLWQYGRKKRRQRRR

SEQ ID NO: 11756 - protein, 21 aa, artificial sequence
  miPEP fragment + penetration peptide
MSLCLSPSLTYGRKKRRQRRR

SEQ ID NO: 11757 - protein, 21 aa, artificial sequence
  miPEP fragment + penetration peptide
MFKHRFFYMHYGRKKRRQRRR

SEQ ID NO: 11758 - protein, 10 aa, artificial sequence
  scramble peptide
IQVGHEDETD

SEQ ID NO: 11759 - DNA, 21 bp, artificial sequence
  Primer
tctttgggaccttgtctgcaa

SEQ ID NO: 11760 - DNA, 22 bp, artificial sequence
  Primer
gccgaggaaaaccgtgtactat

SEQ ID NO: 11761 - DNA, 23 bp, artificial sequence
  Primer
gggcagtagtgactcatccgaag

SEQ ID NO: 11762 - DNA, 24 bp, artificial sequence
  Primer
ctccatagcccagtgttgtagcag

SEQ ID NO: 11763 - DNA, 19 bp, artificial sequence
  Primer
ctcctgcgactgccctaat

SEQ ID NO: 11764 - DNA, 19 bp, artificial sequence
  Primer
gccttgccatacaccttgc

SEQ ID NO: 11765 - DNA, 20 bp, artificial sequence
  Primer
acatctgcgtccacatcagg

SEQ ID NO: 11766 - DNA, 22 bp, artificial sequence
  Primer
ccgttcacgagtctcattggtg

SEQ ID NO: 11767 - DNA, 22 bp, artificial sequence
  Primer
gcggaggaaaagctgatcctga

SEQ ID NO: 11768 - DNA, 20 bp, artificial sequence
  Primer
tccgcagcatgcctctcctt

SEQ ID NO: 11769 - DNA, 25 bp, artificial sequence
  Primer
ataaaaccttggagtaaagtagcag

SEQ ID NO: 11770 - DNA, 19 bp, artificial sequence
  Primer
gcacaatatggcctgcacc

SEQ ID NO: 11771 - DNA, 22 bp, artificial sequence
  Primer
cagcacgtaaatattggcgtta

SEQ ID NO: 11772 - DNA, 21 bp, artificial sequence
  Primer
tcaaccttacttcagcagcac

The invention claimed is:

1. A pharmaceutical composition comprising:
   a miPEP consisting of SEQ ID NO: 11 745, SEQ ID NO: 11 747, or SEQ ID NO: 11 749, or a fragment of said miPEP consisting of: SEQ ID NO: 11 751, SEQ ID NO: 11 752, or SEQ ID NO: 11 753, said miPEP, or said fragment of said miPEP, being capable of modulating the accumulation of said miR in a eukaryotic cell; or
   a nucleic acid consisting of SEQ ID NO: 11 746, SEQ ID NO: 11 748, or SEQ ID NO: 11 750, said nucleic acid encoding said miPEP, or a nucleic acid encoding said fragment of said miPEP, said miPEP, or said fragment of said miPEP, being capable of modulating the accumulation of said miR in a eukaryotic cell, and
   a pharmaceutically acceptable excipient.

2. The pharmaceutical composition of claim 1, wherein said miPEP is identified, or as identified, by implementing of a process for identifying a miPEP modulating the accumulation of a miR involved in osteoporosis, comprising:
   a) a step of detecting an open reading frame from 12 to 1 503 nucleotides contained in the sequence of the primary transcript of said miR, then
   b) a step of comparison between:
      i. the accumulation of said miR in a specified eukaryotic cell expressing the primary transcript of said miR, in the presence of a peptide encoded by a nucleotide sequence that is identical or degenerate relative to that of said open reading frame, said peptide being present in the cell independently of transcription of the primary transcript of said miR, and
      ii. the accumulation of said miR in a eukaryotic cell of the same type as the aforesaid specified eukaryotic cell expressing the primary transcript of said miR, in the absence of said peptide,
   in which a modulation of the accumulation of said miR in the presence of said peptide relative to the accumulation of said miR in the absence of said peptide indicates the existence of a miPEP, the latter being encoded by said open reading frame and being capable of modulating the accumulation of said miR involved in osteoporosis.

3. The pharmaceutical composition of claim 1, wherein said miPEP, or said fragment of said miPEP, is fused or linked to one or more molecules facilitating the entry of the miPEP, or miPEP fragment, into the cell.

4. The pharmaceutical composition of claim 1, wherein said miPEP, or fragment of said miPEP, is fused in N-ter or in C-ter to the TAT peptide (YGRKKRRQRRR, SEQ ID NO: 11 754).

5. A method of treatment of osteoporosis comprising the administration of a microRNA encoded PEPtides (miPEP), or a fragment of said miPEP, as a drug, wherein said miPEP consists of: SEQ ID NO: 11 745, SEQ ID NO: 11 747 or SEQ ID NO: 11 749, or said fragment of said miPEP consists of: SEQ ID NO: 11 751, SEQ ID NO: 11 752 or SEQ ID NO: 11 753,
   the sequence of which is encoded by a nucleotide sequence contained in the primary transcript of a microRNA (miR), said miPEP or said fragment of said miPEP being capable of modulating the accumulation of said miR in a eukaryotic cell, which miR regulates expression of at least one gene involved in said osteoporosis.

6. The method of claim 5, wherein said miPEP is identified, or as identified, by implementing of a process for identifying a miPEP modulating the accumulation of a miR involved in osteoporosis, comprising:
   a) a step of detecting an open reading frame from 12 to 1 503 nucleotides contained in the sequence of the primary transcript of said miR, then
   b) a step of comparison between:
      i. the accumulation of said miR in a specified eukaryotic cell expressing the primary transcript of said miR, in the presence of a peptide encoded by a nucleotide sequence that is identical or degenerate relative to that of said open reading frame, said peptide being present in the cell independently of transcription of the primary transcript of said miR, and
      ii. the accumulation of said miR in a eukaryotic cell of the same type as the aforesaid specified eukaryotic cell expressing the primary transcript of said miR, in the absence of said peptide,
   in which a modulation of the accumulation of said miR in the presence of said peptide relative to the accumulation of said miR in the absence of said peptide indicates the existence of a miPEP, the latter being encoded by said open reading frame and being capable of modulating the accumulation of said miR involved in said osteoporosis.

7. The method of claim 5, wherein said miPEP is encoded by a nucleotide sequence contained in the primary transcript of a miR selected from the group consisting of: miR15a-16-1, miR125a-1, and miR145-2.

8. The method of claim 5, wherein said miPEP, or said fragment of said miPEP, is fused or linked to one or more molecules facilitating the entry of the miPEP, or miPEP fragment, into the cell.

9. The method of claim 5, wherein said miPEP, or fragment of said miPEP, is fused in N-ter or in C-ter to the TAT peptide (YGRKKRRQRRR, SEQ ID NO: 11 754).

* * * * *